United States Patent 9,675,668 (MODIFIED POLYNUCLEOTIDES ENCODING HEPATITIS A VIRUS CELLULAR RECEPTOR 2) - sequence listing, part 7

SEQ ID NO: 7170 - DNA, 1394 bp, Homo sapiens
tttggcgcctgcgcgctgagtgcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtggcagcagagagggaccatccaaatacctaagagaaaacagacctagtcaggatatgaatttgtttcagctgttcccaaaggcctgggagctttttgaaaagaaagaaaaaagtgtgttggctttttttttttttagaaagttagaattgtttttaccaagagtctatgtggggcttgattcacccttcatccattggctggaacatggattggggatttg

SEQ ID NO: 7171 - DNA, 1515 bp, Homo sapiens
gaccgaagaggctggtaagtcctcaagctggcaggtggtcgggggagcggccggagaggagctgccgggagttcgtgccctgcaggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtcagtacatatgtgactactaacgtctcccttattccacctcggagtgagcaactggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtggcagcagagagggaccatccaaatacctaagagaaaacagacctagtcaggatatgaatttgtttcagctgttcccaaaggcctgggagctttttgaaaagaaagaaaaaagtgtgttggctttttttttttttagaaagttagaattgtttttaccaagagtctatgtggggcttgattcacccttcatccattggctggaacatggattggggatttgatagaaaaataaaccctgcttttgattca

SEQ ID NO: 7172 - DNA, 1414 bp, Homo sapiens
taagtcctcaagctggcaggtggtcgggggagcggccggagaggagctgccgggagttcgtgccctgcaggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtggcagcagagagggaccatccaaatacctaagagaaaacagacctagtcaggatatgaatttgtttcagctgttcccaaaggcctgggagctttttgaaaagaaagaaaaaagtgtgttggctttttttttttttagaaagttagaattgtttttaccaagagtctatgtggggcttgattcacccttcatccattggctggaacatggattggggatttg

SEQ ID NO: 7173 - DNA, 810 bp, Homo sapiens
gcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaatgagttggtggctttgatcccacacagtgatcagagattgcgccctcagcgaactaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggccaccctgaaaatcaggaactccaacttctacacggtggcagtgaccagcctgtccagccagattcagtacatgaacacagtggtcagtacatatgtgactactaacgtctcccttattccacctcggagtgagcaactggtgaattttaccgggaaggccgagatgggaggaccgttttcctatgtgtacttcttctgcacggtacctgagatcctggtgcacaacatagtgatcttcatgcgaacttcagtgaagatttcatacattggcctcatgacccagagctccttggagacacatcactatgtggattgtggaggaaattccacagctatttaa

SEQ ID NO: 7174 - DNA, 756 bp, Homo sapiens
gagcgggcgggaaggaggcgttcgtctagatttgtcggcttgcggggagacttcaggagtcgctgtctctgaacttccagcctcagagaccgccgcccttgtccccgagggccatgggccgggtctcagggcttgtgccctctcgcttcctgacgctcctggcgcatctggtggtcgtcatcaccttattctggtcccgggacagcaacatacaggcctgcctgcctctcacgttcacccccgaggagtatgacaagcaggacattcatccacttcctctctgcaggctggtggccgcgctctctgtcaccctgggcctctttgcagtggagctggccggtttcctctcaggagtctccatgttcaacagcacccagagcctcatctccattggggctcactgtagtgcatccgtggccctgtccttcttcatattcgagcgttgggagtgcactacgtattggtacatttttgtcttctgcagtgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaa

SEQ ID NO: 7175 - DNA, 492 bp, Homo sapiens
atgggccgggtctcagggcttgtgccctctcgcttcctgacgctcctggcgcatctggtggtcgtcatcaccttattctggtcccgggtaagacccacggctgcactcaatccgtccccattcccatctctgagtggtcctagtcctaccctgccccctcccagtgtcttaccctcttgggttttcttgtttcccgccgcccccaggcctgccctgcagcctgcccctttttcacttctctctgcaggctggtggccgcgctctctgtcaccctgggcctctttgcagtggagctggccggtttcctctcaggagtctccatgttcaacagcacccagagcctcatctgtatcctttctgcctgcccacctttcccacacgacccacttctatcaggactcccttcagccacctgacacaatagtgtctgctgtagccaatccttccagttcaaagatcttcaacgatgtgctaaatcctgctgtttactag

SEQ ID NO: 7176 - DNA, 747 bp, Homo sapiens
ctagatttgtcggcttgcggggagacttcaggagtcgctgtctctgaacttccagcctcagagaccgccgcccttgtccccgagggccatgggccgggtctcagggcttgtgccctctcgcttcctgacgctcctggcgcatctggtggtcgtcatcaccttattctggtcccgggacagcaacatacaggcctgcctgcctctcacgttcacccccgaggagtatgacaagcaggacattcagctggtggccgcgctctctgtcaccctgggcctctttgcagtggagctggccggtttcctctcaggagtctccatgttcaacagcacccagagcctcatctccattggggctcactgtagtgcatccgtggccctgtccttcttcatattcgagcgttgggagtgcactacgtattggtacatttttgtcttctgcagtgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaacattaagacttatatacagttttaggggacaatt

SEQ ID NO: 7177 - DNA, 726 bp, Homo sapiens
aaggaggcgttcgtctagatttgtcggcttgcggggagacttcaggagtcgctgtctctgaacttccagcctcagagaccgccgcccttgtccccgagggccatgggccgggtctcagggcttgtgccctctcgcttcctgacgctcctggcgcatctggtggtcgtcatcaccttattctggtcccgggacagcaacatacaggcctgcctgcctctcacgttcacccccgaggagtatgacaagcaggacattcatccacttcctctctgcaggctggtggccgcgctctctgtcaccctgggcctctttgcagtggagctggccggtttcctctcaggagtctccatgttcaacagcacccagagcctcatctccattggggctcactgtagtgcatccgtggccctgtccttcttcatattcgagcgttgggagtgcactacgtattgtgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaaca

SEQ ID NO: 7178 - DNA, 3744 bp, Homo sapiens
gctttctcctgagccgtcggagggagccggagcgcttctcccgagttggtgatagattggtggtcatccaacatgcagaaatgaatgagcagtgaaaagcagcagagccgatgggtcatgaggatgtaagtgcgtttgaaggcttccacaccctctactccaggacagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctcttcccgaaaaggggctggtaattcatcacgccctgtcccgcctgcacctggtggccactccaggagtaaagaaggacagcgaggacgaaatccaagctccacacctctggggcagaagcggcccctggggaaaatctttcagatctacaagggcaacttcacagggtctgtggaaccggagccctctaccctcacccccaggaccccactctggggctactcctcttcaccacagccccagacagtggctgcgaccacagtgcccagcaatacctcatgggcacccaccaccacctccctggggcctgcaaaggacaagccaggccttcgcagagcagcccaggggggtggttctaccttcaccagccaaggagggacaccagatgccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagggtctcagaaagcactatttctggagccaaggaggagactgtggccaccctcaccatgaccgaccgggtgcccagtcctctctccacagtggtatccacagccacaggcaatttcctcaaccgcctggtccccgccgggacctggaagcctgggacagcagggaacatctcccatgtggccgagggggacaaaccgcagcacagagccaccatctgcctgagcaagatggatatcgcctgggtgatcctggccatcagcgtgcccatctcctcctgctctgtcctgctgacggtgtgctgcatgaagaggaagaagaagaccgccaacccggagaacaacctgagctactggaacaacaccatcaccatggactacttcaacaggcatgctgtggagctgcccagggagatccagtcccttgaaacctctgaggaccagctctcagagccccgctccccagccaatggcgactatagagacactgggatggtccttgttaaccccttctgtcaagaaacactgtttgtgggaaacgatcaagtatctgagatctaactacagcaggcatcactttgccattccgtatttttcgtctctaaattataaatatacaaatacatatattataaatataacctttgtgtaaccctgacttaatgagaaacattttcagctttttttcctatgaattgtcaacatcttttttacaagtgtggtttaaaaaaaaaaaaaactttacagaatgatctgtggctttataaaataaaggtatttctaagcaaagcagttgcattgattgcttctcttaataactattcttgagcacctggggatcccaggaaccctggtcaggtgaggtaagagactgacctcctgtagaagctgaatgttacagtgcaagcgcacgattctttgagtgattcttaaagctctggttcctcttgatttggtgtgaccccatttcctcccttctcatacgcacacctgtaaagggaactggaccgcctcaggggaagacggcagactcatgcacagagaaggaaaagggaacatctcatcacctctgaggatgagtaccctggagccttatgacggcaccattggatgtcatgtttaattccatccaagttgtggatggcaggcaggagcatggagccctcaggaatccatggaggacatcaaggcatcccaaggccatattcccctaacattacttccactgctaacaacaggactgcctttccctggtgggaaaatgctccctttatgcccattcctgtatcccctccaacacccacatctgcattaaacacccgtgcctttctcttggagagggtttagatgcagatcccggccctggagctttaaaatgcttgcccttccttcttcaaggatcaaatgtttattggggttcagctttgttttctcaaaaggccatggtatcgtgcccctgaggaacatgtttatctaagaagctttgaggtagtagagcgataatttttgaaaccttcctcctgcaatctttaaaaaagaaaaaaaagattgcccaaacaaatcatttgggagaagacatcattatactcctacttggcactgcaaacctgctcgcagcaccagccggtggacttgccatccagctctcagcttccactgctccccttgttcccggccggctggctgcctccccgtgctgtgtccagcacggccaacaacgtcagaccctcagagacgcccaaggggcttccagaggtggccgcttctctattttttcctgattgtggctgagagagatgattactgctttgacacttcctttctctaaaagaaaaatagtttgatagtatattttgaatatagatgctcttatagtcagattgggaattgaacttgaatattgggtcatatgtttgtgttgttgctgtagtctatcatgacttttttctttctgcattttccttaaaaaaaaaaaaaagatggccttcaaaagtgtgttctcaatgttgtatgaacctccttcacatgagttcggttgttgtctctcttcaaagactcttcaacccacaaagaagcaactaaatgtttctctaagtttaattttctagcgtgttgttgtcttacctttttaaccttaccataatatttctgttaactgttacatttaatataccaatgtgtgtaagtatacagagaaaaatctgtttgtaaagtaaaatttatatataatatatgtaatcaaagatacatatgttatatatacatatgtggatgtatgacttatttttccttatccacagatttcagctaccatgtatatataaataaacttattttattagccagaggattctgttgctaatacat

SEQ ID NO: 7179 - DNA, 2165 bp, Homo sapiens
agccgtcggagggagccggagcgcttctcccgagttggtgatagattggtggtcatccaacatgcagaaatgaatgagcagtgaaaagcagcagagccgatgggtcatgaggatgtaagtgcgtttgaaggcttccacaccctctactccaggaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctcttcccgaaaaggggctggtaattcatcacgccctgtcccgcctgcacctggtggccactccaggagtaaagaaggacagcgaggacgaaatccaagctccacacctctggggcagaagcggcccctggggaaaatctttcagatctacaagggcaacttcacagggtctgtggaaccggagccctctaccctcacccccaggaccccactctggggctactcctcttcaccacagccccagacagtggctgcgaccacagtgcccagcaatacctcatgggcacccaccaccacctccctggggcctgcaaaggacaagccaggccttcgcagagcagcccaggggggtggttctaccttcaccagccaaggagggacaccagatgccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagggtctcagaaagcactatttctggagccaaggaggagactgtggccaccctcaccatgaccgaccgggtgcccagtcctctctccacagtggtatccacagccacaggcaatttcctcaaccgcctggtccccgccgggacctggaagcctgggacagcagggaacatctcccatgtggccgagggggacaaaccgcagcacagagccaccatctgcctgagcaagatggatatcgcctgggtgatcctggccatcagcgtgcccatctcctcctgctctgtcctgctgacggtgtgctgcatgaagaggaagaagaagaccgccaacccggagaacaacctgagctactggaacaacaccatcaccatggactacttcaacaggcatgctgtggagctgcccagggagatccagtcccttgaaacctctgaggaccagctctcagagccccgctccccagccaatggcgactatagagacactgggatggtccttgttaaccccttctgtcaagaaacactgtttgtgggaaacgatcaagtatctgagatctaactacagcaggcatcactttgccattccgtatttttcgtctctaaattataaatatacaaatacatatattataaatataacctttgtgtaaccctgacttaatgagaaacattttcagctttttttcctatgaattgtcaacatcttttttacaagtgtggtttaaaaaaaaaaaaaactttacagaatgatctgtggctttataaaataaaggtatttctaagcaaagcagttgcattgat

SEQ ID NO: 7180 - DNA, 2470 bp, Homo sapiens
gagagcaagacggcagcatctacggttctttctgctcaggaatgggaacccagagtgggcagtagagcggaggcaagccatgcagaggcaggagcagatgagaccctagatgccacgagaagctaaacatgtggggaaaataaagagcagattaactcaggaaaattatatggggagctcttatgctactctgaagatctgagactcgttggagaatttacaatcccaaattaactcagggagaattccaactagactctgaaatgaattagatggagatttaaaatagggcaatttagtgggaagagatacttaatttgaagacagaatcatgaataaactggaggataagcaggaccagatgataccatgaagagaagtttacaggccctctattgccaactgttaactgtcctgctgacggtgtgctgcatgaagaggaagaagaagaccgccaacccggagaacaacctgagctactggaacaacaccatcaccatggactacttcaacaggcatgctgtggagctgcccagggagatccagtcccttgaaacctctgaggaccagctctcagagccccgctccccagccaatggcgactatagagacactgggatggtccttgttaaccccttctgtcaagaaacactgtttgtgggaaacgatcaagtatctgagatctaactacagcaggcatcactttgccattccgtatttttcgtctctaaattataaatatacaaatacatatattataaatataacctttgtgtaaccctgacttaatgagaaacattttcagctttttttcctatgaattgtcaacatcttttttacaagtgtggtttaaaaaaaaaaaaaactttacagaatgatctgtggctttataaaataaaggtatttctaagcaaagcagttgcattgattgcttctcttaataactattcttgagcacctggggatcccaggaaccctggtcaggtgaggtaagagactgacctcctgtagaagctgaatgttacagtgcaagcgcacgattctttgagtgattcttaaagctctggttcctcttgatttggtgtgaccccatttcctcccttctcatacgcacacctgtaaagggaactggaccgcctcaggggaagacggcagactcatgcacagagaaggaaaagggaacatctcatcacctctgaggatgagtaccctggagccttatgacggcaccattggatgtcatgtttaattccatccaagttgtggatggcaggcaggagcatggagccctcaggaatccatggaggacatcaaggcatcccaaggccatattcccctaacattacttccactgctaacaacaggactgcctttccctggtgggaaaatgctccctttatgcccattcctgtatcccctccaacacccacatctgcattaaacacccgtgcctttctcttggagagggtttagatgcagatcccggccctggagctttaaaatgcttgcccttccttcttcaaggatcaaatgtttattggggttcagctttgttttctcaaaaggccatggtatcgtgcccctgaggaacatgtttatctaagaagctttgaggtagtagagcgataatttttgaaaccttcctcctgcaatctttaaaaaagaaaaaaaagattgcccaaacaaatcatttgggagaagacatcattatactcctacttggcactgcaaacctgctcgcagcaccagccggtggacttgccatccagctctcagcttccactgctccccttgttcccggccggctggctgcctccccgtgctgtgtccagcacggccaacaacgtcagaccctcagagacgcccaaggggcttccagaggtggccgcttctctattttttcctgattgtggctgagagagatgattactgctttgacacttcctttctctaaaagaaaaatagtttgatagtatattttgaatatagatgctcttatagtcagattgggaattgaacttgaatattgggtcatatgtttgtgttgttgctgtagtctatcatgacttttttctttctgcattttccttaaaaaaaaaaaaaagatggccttcaaaagtgtgttctcaatgttgtatgaacctccttcacatgagttcggttgttgtctctcttcaaagactcttcaacccacaaagaagcaactaaatgtttctctaagtttaattttctagcgtgttgttgtcttacctttttaaccttaccataatatttctgttaactgttacatttaatataccaatgtgtgtaagtatacagagaaaaatctgtttgtaaagtaaaatttatatataatatatgtaatcaaagatacatatgttatatatacatatgtggatgtatgacttatttttccttatccacagatttcagctaccatgtatatataaataaacttattttattagcc

SEQ ID NO: 7181 - DNA, 555 bp, Homo sapiens
ggtgaggcggccagcttcatgaggaaggagaatgcattgggaagcaagaaaagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgcccca

SEQ ID NO: 7182 - DNA, 510 bp, Homo sapiens
gtatgcaaagacagagcctctcatgagaacttggatggtggagtataaacactcatttaaaaataaatccagatgtagttggctgcagtcatctgacagaaccctgattctctcttcaataatgacgttcatttgtacctcattaattgagagtttttaataatttctccagggtaagaaaactgagtcacacaaggatatatttgtgtaacacaatttcaaaaaggcaaactcttgctcttgttaacgacagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatgg

SEQ ID NO: 7183 - DNA, 681 bp, Homo sapiens
gaagctagtctacacacatggatgggactatggaaatatacatgtgacttttaaacctgaacagtagctgttggtgatagattggtggtcatccaacatgcagaaatgaatgagcagtgaaaagcagcagagccgatgggtcatgaggatgtaagtgcgtttgaaggcttccacaccctctactccaggacagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggc

SEQ ID NO: 7184 - DNA, 4833 bp, Homo sapiens
tccaactagactctgaaatgaattagatggagatttaaaatagggcaatttagtgggaagagatacttaatttgaagacagaatcatgaataaactggaggataagcaggaccagatgataccatgaagagaagtttacaggccctctattgccaactgttaagtttcctgctgatcttggcactgaccgaagcgctggcatttgccatccaggaaccatctcccagggaatctcttcaggtcctcccttcaggcactcccccgggaaccatggtgacagcaccccacagctctaccagacatacttctgtggtgatgctgacccccaatcccgatggacccccctcacaggctgcagctcccatggcaacaccgacaccccgtgcagaggggcaccctcctacgcacaccatctccaccatcgctgcgacagtaaccgccccccattctgaaagctccctgtccacagggcccgctccagcagccatggcaaccacatcctccaagccagagggccgccctcgagggcaggctgcccccaccatcctgctgacaaagccaccgggggccaccagccgccccaccacagcgcccccccgcactaccacacgcaggccccccaggcccccaggctcttcccgaaaaggggctggtaattcatcacgccctgtcccgcctgcacctggtggccactccaggagtaaagaaggacagcgaggacgaaatccaagctccacacctctggggcagaagcggcccctggggaaaatctttcagatctacaagggcaacttcacagggtctgtggaaccggagccctctaccctcacccccaggaccccactctggggctactcctcttcaccacagccccagacagtggctgcgaccacagtgcccagcaatacctcatgggcacccaccaccacctccctggggcctgcaaaggacaagccaggccttcgcagagcagcccaggggggtggttctaccttcaccagccaaggagggacaccagatgccacagcagcctcaggtgcccctgtcagtccacaagctgccccagtgccttctcagcgcccccaccacggtgacccacaggatggccccagccatagtgactcttggcttactgttacccctggcaccagcagacctctgtctaccagctctggggtcttcacggctgccacggggcccaccccagctgccttcgataccagtgtctcagccccttcccaggggattcctcagggagcatccacaaccccacaagctccaacccatccctccagggtctcagaaagcactatttctggagccaaggaggagactgtggccaccctcaccatgaccgaccgggtgcccagtcctctctccacagtggtatccacagccacaggcaatttcctcaaccgcctggtccccgccgggacctggaagcctgggacagcagggaacatctcccatgtggccgagggggacaaaccgcagcacagagccaccatctgcctgagcaagatggatatcgcctgggtgatcctggccatcagcgtgcccatctcctcctgctcagatcctatcacctgaaagcatgcccttccacaaatgtgaatacagtactcagggctccatctgaaaatggagtgacccctcttcttcctgtcacacatctgacaagccatggatgactccccagtgacattcctgggaacccaagagagcttaattcccaactctgttttaaaactcaaggaaattgggactccatgacctcctccagagtcttgatggctactgcctcaggagaaacagagcagttgaagcttttcaactaaatgggaaagggaacagttaacatcttgtgtttgcatagagctgcgcagtttacaaaacgcttctgcatatgtcatctctataccctccggtgttcaggacaatacaggatagtggatatcaacttgaagatcatcaagacctggactcaagttgcagtaattagttgggtgatcaagatcaatactattagcttctatgaccttcagttacctgttctgaaaatgggaagagcaatagtgccttcctcaggcagttatcatgtgggctaaataagcttcaaagtgcctgggtcagtgctgggaatatagtagagaccctgtaagtctgacttgtacttttctttcttggatgaaaggtgagaccactgaaatagtgaatgttctaacccctaggtggagctttgtccttgagccacccaatagtcatataacacagtttttctttctagatctctcttgtagaggatgttgggagaacaagaagagaactgtcattaattaagcatccattgtgtgtcaggcattgtgtttggcattttgcatccatgatctctttaattctcattacaagcctatgaagttcatcttaagtgactttccaggtggaatacatggcagagtcacaatttgaacctaggtctttctgtagccaggctggctttcagtaagtaaatgaaatggtgtttgagaagcactggaaactccctgagagaaatataatcaggccaggagcatgaacatgtgaggggaagacagcgtggagcagaactttctgttctgactcccaggccttcccgcagggcaggatctctgcatctggcattctaacaacatgggctgttagagcactggactcgggggcggaggacttggattctgcaacctctaccagcccaggttagcagcatggccttgagcaagttcacctctctaggtttccatgccccaccttctagaataagaatgtaggctgggggaaggggctgatttgtttcagcacctactgtgcaccagggacaatttgaagtgctggcagatgtatgactgcatttaatcttcccaaggaagctgacgctgagagaggttaagtaacttactcaagtcatgcaagtaatagattgtcacctagattctaattctaaattcgatgtcccttttgccctattgactaggcctaagatggcatctgtcactttgattctgtttgcttataactgctcagtagatcagaggcacaaatatctttctaccttagagaggcgtgcaaactatacaaatctgactcacagatacacttttcccctgccagcctgtgttctgtgtctatggcagtgttttgtggggcatgatgggatgtgcccctacaggctgataactgaagagctgttctgtttgtcctgattgctcccctccctctagctctaactctaccaaaactgagctggagctgaggaaacagcacttttcccacttcccagatggttccctctttatggcttctgtcacaccagctagaactcctccaggtgtttcaccatgccagctgcaggagcagagtgaaaggtagtgacaatgaagaacagagacaccagagaaggggacaggggacccgggatcttgtcccagctctgccactcacatacctgtgacctgtggcaaggcggccagcactttaggccacagtttttcctctagaataaggaggcggcctgaattagcaagtttcaggctgagcaccacagccccctccttgcccctttcctcttcaaccatctgaagaaagggttttttggaaggaagggagggaaagaggaaagagatccacaatatttgaaaagttctgtaccagctaatctctcaaatccccgttagccctaacactcagaaattccttctatgttttaaagattttttaaaaaggatctagaagactgaaaagcaaattagaagtctttttgatcaaagcagataagataaagtagaaacttaccctatctcctaaccttgtacagagacctttccaggttgagaggccagcaaggctggcagctggaaagaaagctacagaattccccaggcagcctacagggccctgggctctgggctgtgaggtctcagcctatacaggtgccagcttgtgcaactgccccacaccctggcatgaacccacccctgatgctggccagaccctcaggctgctgcgaacagagctggccctctgccaacccccggtgctggcctctctggacagcccagcctgggaccccgactccccagcacagagatggttggcaccaccaggatgtcagatgtggctcttggcttcagctctcctcatccccagaggctctggtgatgatgaacctggggcaggatatactcagtcctcacttcatggcttctccccaagaggcctctgtcacccttgtccttgtgttacccttctgcagtgtgaatctggacaggccaccccacctctctgacctcagaagccttccctgctcacaagccactcaattcacacatggttaatcaacaatatcgagacataattcttcctcctgggccctgggagtctcagggatgaacagacagggtcacatgtcacactgtgctcagtcaagctgtgtggagcccacctcaggccatctgtgcaggtgggcttttgcatcaatctaaggcaggaatcagctggtaagagcatagactggccaggtgcagtggctcacacctgtaatcaatcccagcactttaggaggctgaggcaggcggattacctgaggtcaggagttcgagaccagcctaaccaacatggcaaaaccctgtctctactaaaaatacaaaaattagccagacatggtggcaggcacctgtaatatcccagcttcttgggaggctgaggcaggagaatcgcttgatcccaggaggcagaggttgcagtgagccaagattgcgccactgcactccagcctgggcaacggagctagactccatc

SEQ ID NO: 7185 - DNA, 2413 bp, Homo sapiens
gtagctctagaactacatgacccaaaatgccgagtggtggcaagaggaggattagcttccactccgatttcaaagatccagtttacccactctacagcccagatatagtcacttatttcccctttccagccagagacttccgttccctgctggaacttccgatcccattcttctctcggtgggaatgcttgtggggggaaaaagaaacgcaatagataaagcggggcgcatgcgctcccggcacaggcttcgattgtgaggaaggccggctagtctccgagctcatcccgccttgcgcatgcggagaaggtaaaccagcgccccgagttgaggcgcgggtttggtggcgcgtttcagcgaagtcgcacgtgaaggatagcagtggcctgagaaagacccagtcatggcagcctccagcatcagttcaccatggggaaagcatgtgttcaaagccattctgatggtcctagtggcccttatcctcctccactcagcattggcccagtcccgtcgagactttgcaccaccaggccaacagaagagagaagccccagttgatgtcttgacccagataggtcgatctgtgcgagggacactggatgcctggattgggccagagaccatgcacctggtgtcagagtcttcgtcccaagtgttgtgggccatctcatcagccatttctgtggccttctttgctctgtctgggatcgccgcacagctgctgaatgccttgggactagctggtgattacctcgcccagggcctgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcctgacccttccacccgggccctgctactcctggccttgctgatcctctacgccctgctgagccggctcactggctcccgagcctctggggcccaactcgaggccaaggtgcgagggctggaacgccaggtggaggagctgcgctggcgccagaggcgagcggccaagggggcccgcagtgtggaggaggagtgagccggatgccccacacaccgccagtgtcataccaaagagctgagctgcttcggggccatgcagccctcctgccagccccctgcccttttcttgccctgtctctgaaccttcagaacattgatccttgccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccagcaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgcttggttggttttaaataaagtgcacgctattttattatcttgttctgaataaaatgtatttactccaa

SEQ ID NO: 7186 - DNA, 777 bp, Homo sapiens
ggcgcgggtttggtggcgcgtttcagcgaagtcgcacgtgaaggatagcagtggcctgagaaagacccagtcatggcagcctccagcatcagttcaccatggggaaagcatgtgttcaaagccattctgatggtcctagtggcccttatcctcctccactcagcattggcccagtcccgtcgagactttgcaccaccaggccaacagaagagagaagccccagttgatgtcttgacccagataggtcgatctgtgcgagggacactggatgcctggattgggccagagaccatgcacctggtgtcagagtcttcgtcccaagtgttgtgggccatctcatcagccatttctgtggccttctttgctctgtctgggatcgccgcacagctgctgaatgccttgggactagctggtgattacctcgcccagggcctgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcctgacccttccacccgggccctgctactcctggccttgctgaccccctgcccttttcttgccctgtctctgaaccttcagaacattgatccttgccgcagccccactagccaagagaaacagagaaagaccattccccctgcctgtccttgcggccctgtcttctga

SEQ ID NO: 7187 - DNA, 1959 bp, Homo sapiens
cctggcagacccagtcatggcagcctccagcatcagttcaccatggggaaagcatgtgttcaaagccattctgatggtcctagtggcccttatcctcctccactcagcattggcccagtcccgtcgagactttgcaccaccaggccaacagaagagagaagccccagttgatgtcttgacccagataggtcgatctgtgcgagggacactggatgcctggattgggccagagaccatgcacctggtgtcagagtcttcgtcccaagtgttgtgggccatctcatcagccatttctgtggccttctttgctctgtctgggatcgccgcacagctgctgaatgccttgggactagctggtgattacctcgcccagggcctgaagctcagccctggccaggtccagaccttcctgctgtggggagcaggggccctggtcgtctactggctgctgtctctgctcctcggcttggtcttggccttgctggggcggatcctgtggggcctgaagcttgtcatcttcctggccggcttcgtggccctgatgaggtcggtgcctgacccttccacccgggccctgctactcctggccttgctgatcctctacgccctgctgagccggctcactggctcccgagcctctggggcccaactcgaggccaaggtgcgagggctggaacgccaggtggaggagctgcgctggcgccagaggcgagcggccaagggggcccgcagtgtggaggaggagtgagccggatgccccacacaccgccagtgtcataccaaagagctgagctgcttcggggccatgcagccctcctgccagccccctgcccttttcttgccctgtctctgaaccttcagaacattgatccttgccgcagccccactagccaagagaaacagagaaagaccattccccctgcctgtccttgcggccctgtcttctgaggttctctgtctggggttggctctcttaaccctttctctgctcccagcctgcctcaccagggaaggttggaggggcctccctctggcttctgcatctgcgccagcaaacatcactgccgttggtctctcatgacttaactggcttccctctgctgctgccttggcttcctcctaatgctcgtgctctcctgtccttctgaagttgctccttggccaaatctccagctcccttcttgttttcctcatcctcctaccctgtactcccaccaaaccatggtcctttaaggcacgctcctgtcctcctcattgcccagcagtagggaggggcaggggtaaggggacctgaggataaagggtggggaaacagggtcccctgaggcctgtgggggctgcaggggaggaggatgtaccttgtgtctctttcaagtgccttaatccgagccagcagggccttctgcttgcctgctgccatactgtatgtaggaaagtgttctgtggctgctttgtgtcaagaaaagagcagtcactctcagaatcttgattccccatcagccaaagcaaaagatggctgctgctttgtaggcatgtgcctgcaagtgggaccttgctgggcattatatgccctgtgggggtttcagagaccctgaaagaggagggaggacccgcctccttgtctgcacaactgcatgcacttctctccccatcgctccacaacctgaaaccgagaaggagttgctgaccagtgcccaccccggcagcccgggaggaacacaggcagctcctttcccttcacgtggtctgcagagagcagggtgagctgccagctgcccctctccaccagggtaccctgtcttggtggttaggggccacttttcctttgaggctctagtggaggtggatgtccttctctgccaggcttggcacatgatgtgaagaataaatgcccaattcttactgttcaggtttgatgtggaatcacagctgcagtgatatatattttttatcagtgct

SEQ ID NO: 7188 - DNA, 1396 bp, Homo sapiens
agacagcgcggcggcccccagcgggagaggcagcctggcggccaggacagcgcggccgggcgcctccgcgcagtgctctgggagttgtaggcacttgcctctcctctctccttcagctactggctctcgaaactcaaggacctaccggtgggtgggcgcctgtgactcccaggctgcgaacgccgggaactcagtttcttcagaaatgctcgaaccaggacggctcctggagtcctcgcgccctcgcagaaggactacgggccccggcgaccccgggggcggggcttccggcgcgctgccttgtgggcacggtagttccgccgggtctggcttccgcctgccgagcggccccggaccgcaggccggactacacttcccgtcggcccgcctgctctcccgatgccgccttggcgcgagacgttggcaagcagagtgtctccaagatggccgcttggggaaggaggcgtcttggcccgggcagcagtggcggcagcgcccgagagagggtgagcttgtcggccacagactgctacattgtgcatgagatctacaatggggagaatgcccaagaccagtttgagtacgagctggagcaggccctggaagcccagtacaagtacattgtgattgagcccactcgcattggcgacgagacagcccgctggatcaccgtgggcaactgcctgcacaagacggccgtgctggcgggcaccgcctgcctcttcaccccgttggcgctgcccttagattattcccactacatttccctgcccgctggtgtgctgagcctggcctgctgcaccctctatgggatctcctggcagtttgacccttgctgcaagtaccaagtggagtacgacgcctataaactgtcgcgcctgcctctgcacacactcacctcctccaccccggtggtgctggtccggaaggacgacctgcacagaaagagactgcacaacacgatagcactggccgccctggtgtactgtgtaaagaagatttacgaactctatgccgtatgatttcagtagaacagggagcgaagcaaaaccacccggcccacaagagacaacagagtattcagatcgccacactctgtgaggcagcagagcctgggcaggtgtttggcttagtatttgttatttttaaaaaataacagatcacgggtgtacccagggtttttcagctcattacactaagatgtggatttccataacccaagaggggggtctgaggctgtggaagtccgactgggcagtggaatgctgatggaggcagacgctgccgagggggtgtggacgtgctttgggggaggtctttaagtctattgtttaactgtaccatccagagcccaccagaagctattgatcattaaaattatgagaatttcaactcc

SEQ ID NO: 7189 - DNA, 4769 bp, Homo sapiens
cgggttacgcgcggcgcggagtcggcggccgggcggaggtaccggctcaggcttgggatcccggctgcgggtttggcggcgctgcgccggcaggcagcgaggccgggcgggccctgggccctcgcgcccctcccgcgaggcctgtcatgcagggccccgccgggaacgcgagccggggactgccaggcgggccgccctccacagtcgcgtccggggcgggccgctgcgagagcggcgcgctcatgcacagcttcggcatcttcctgcaggggctgctcggcgtcgtggccttcagcacgttaatgctcaaacgcttcagagaaccaaagcatgaaagacgtccgtggaggatatggtttttagacacttccaaacaagccataggaatgctgttcatccactttgcaaatgtatacctagcagatctcactgaagaggacccttgttcactgtacctcatcaacttcctcctggacgccactgtgggcatgctgctcatctacgtgggggtgcgcgccgtcagcgtcctggtagagtggcagcagtgggagtccctgcgcttcggcgaatatggagaccctctgcagtgtggagcctgggtcgggcagtgcgctctttacatcgtgatcatgatttttgaaaagtctgtcgtcttcatcgtcctcctaatacttcagtggaaaaaggtggccctgttgaatcccattgaaaacccagacttgaagctggccatcgtcatgctgatcgtccccttctttgtcaacgctttgatgttttgggtagtggacaatttcctcatgagaaaggggaagacgaaagctaagctagaagaaaggggagccaaccaggactcgaggaatgggagcaaggtccgctaccggagggccgcatcccacgaggagtctgagtctgagatcctgatctcagcggatgatgagatggaggagtccgacgtggaggaggacctccgcagactgacccccctcaagcctgtgaagaaaaagaagcaccgctttgggctacccgtatgacacattcccatgctgggggtgacgggagggccccgccagccgctggtgtgcagaggtcatcccgcagcatcgttccttaccctctctctgcccttcctttctacctctgctcctcttgctgtctctgcccgctctcgcctgcccccagactactgtgacttaaaaagagggaagaggagccagcgcccgagggggccactggcggctggaggtccccattcagttgcactacaaacactgaccaaatatgcaaggaaggagctgtgtttgtttgttgtcgtcccagacagtgttgtgagggacctgaggccctgccccgtgtccgaccaccgagtggcaaggtggaaggaagcacaggcacacagaccgtgggtgggtctcctcaccgtggctgtgggcagtgcgaacacataacaccctcgggctaaaagtgactcgttgaccaagttggaaccggaatgctttcttactcaaaatggcttttgtaactattgatttctgaagctggttttatgagttgtgacagtgttaccaggttgggggtatgtgtttatttcctacaaagtacttacgggactaatgggcaaaacagagatttttaagtcttccgtatgctgtttgacttttatatttttaagttatattttcatactattgtatttaaaaactctttttagtccccaaagaaatgggtttatttgcctttcatggggtgtgggctggcaggaggaaaaatcgggagttttttatttggaatattattagatgatgccctatgataagatgagacaaatgatggggagggaaggaggatggcccttctctagaatcagcaaacccaatggttctgtgaaggtcagacccaagcttggagcagctggtctggatgcagatccaggagctgcagagtgtggaacaggaaaggctctgcccagggcccatgagctctagcattcctgctggcagattagagatcttagttaaatttgaccaagaaaggagcttagctaagaggtctttgtttccagaggacccaagactaccagactcctgtgcagtctgcctgtctgcagagcctccaatcacggtttaaagtggtcttggcctcccagcccccactgctgcagccttcagagccagcctctggactcagcgccaggagcctcctctcctgctgccctggtacctgtcatcctagtgtcacctatttgttttgcacagcattctggagaacatgtgcctcacaaagtgatcctgtttttctcaccctccaaagctgaggtggctaagggaggcaggggtgagagagctcactctctaaaccacaggcagggcaaggtgcttctaggccgtgtcccctccctggggaatggtcactactcctcagcatggccacaggcccctgtggttttgggagtttgctgagtgactgtggaatgggctgaccccagccgtttccctgctgtggaaacagcaaggtaggggcactgcttggtggtttgtcaagctcagaggcagccacggatggttaggaacaggaagccacactgctaaggtgtgatgagctagaagggagacatcctggacttcaagtgagacaagtgcagaggaggccactccacttaggaccttccttttagacctgcatgagcacgtgtttcacttaagcacattgggtccgaattgggcgcatgaacccagctgttaaaccaggtaccctgggactgccctctgcctctcagagccctacctgtcctggacttgaaggcgagcatcaggcaggccttctcagcccatcttccaccaggagtgcagagccagggtgctgagaggagcagggactgtaactacagtaggaggcaactttgctggtgtcattcctgctcggattgactttgtgctccctcccatccacagctatggtagccagtatttccccagcagctctctagtggggaagagtggctagaaccaggccattctcagtcgaatttaggaagaccaagactcatgttcctgacaggacggtcattccctcatggcatcactgactcagttctaattcctcccctcctgtttcattttggtttgaacaacctgtgcctgcagctgtttcttccaccttcctggagctcacaattggagcttcatgttcagtcttgagctcctaatgtttccagacagggcaggggataggagagccataatctatgaaagctgtgaaacaaaccctgggttatatagatctcagatggtctcatctgaaggctttgcccacttcccagtgagcagagggtttggggaacaaagaggtagctgaagagtggtggtttttccctgtatcctgattttcagaaagggctttagtctctgagctgtggctagtagctggctggctgaccaggggacgggggtctaatagggtgtctgaccataggacacctctcgtgtttggccttccctttcttgtgtgtttgtgtgtgtgtgtgcacgtgcacgtgcacacacatgtacacacacaaatctgtatccccaggagtgcctcctgcagtcactgggggctcttccgtggtgcaccatcccatgagagcagatcagagggctgtggtcaggacttcctcccgagctgccctccctccctgggatgagtttcctctccacctgctccaaggtgccttacgaggtgcagctcttcacctggccacatggcatccatcaccgtgttgagaaatggtgggacgttggctggatattgtgtgctatgaatctgatttgtccaaatctggacctcagccaagccacctgtggtggaaccttgcaagtcaaggtcatgaacaaatttcttgtaactattggaaataaactaatgaggtagaactgtcatatccaaatggaagaggtggttggtactgttacttccttttgctgtcagagggttgttgacaatggcaaggggggatgttagtgagatccaggtggtggtggcttcttggtccactcagcttgcacacatgcaagaggagggtctgtggcccctcagccgtgctggtggcctccttcctcaagctttaacttgtgccctccctggcaacagggagtcatgggttaatgtcacctgtcatgcctctttcttcagggaaaatattaaaaggctcaaatccaagctgtgacttcccttagacagtgtaagcctgtagggtgcagccccaagtttatgtccaaaggctgcctcagaaccctggagggagcagcgcccagctggcagctcactctgcccttgcagttcactggccttttcgcagccaggctaagataggcagtgcaaggagcttcccactggccagagcagctgccttgtagaatgtggggctggcttttagaagtttcacacgcttgcagctaagagtgcagagctctctgttttacttcgtgaaacattagcagctctgaggggcttggcttttggtaagggacttatggtctgacttgccacaagcaccttgagctcctgggttggttggtggttggttggttgggttgttttaaatttgatttttcttttcctgaagtttgttagaagtcagacctatgcaaggaaaaccatggcccacttcagcagccatccagtgggggtgcttaatcggtggtggtaggattcatggaaacgtttttttgaaatgaaagagaagatgatgtacttacattgtaaaatggtttacaataaagtttggcatctta

SEQ ID NO: 7190 - DNA, 2777 bp, Homo sapiens
tgcctcagcctcccgagtagctgcgactacaggcgcctccaccacgcctggctaatttttttgtatttttagtagagacagggtttcacctgttagccaggatggtctcgatcccctgacctcgtgatccccccaccttggcctcccaaagtgctgggattccaggagtgagccaccgagcctgggccaccgccgatagttttccactttcccgccaggcccgacgccgctctgacgccactgaggtgcgccacgacgtgacgtcaacgttcgcgccggaagtggaagaccaggcagcccagctgaaggcagtaagctcggctcacagtcgcaggagagttctggggtacacgggcaaaggggcttgagaaggcccggaggcgaagccgaagagaagcaactgtgccccggagaagagaagctcgcccattccagactgggaaccagctttcagtgaagatggcagggccagaactgttgctcgactccaacatccgcctctgggtggtcctacccatcgttatcatcactttcttcgtaggcatgatccgccactacgtgtccatcctgctgcagagcgacaagaagctcacccaggaacaagtatctgacagtcaagtcctaattcgaagcagagtcctcagggaaaatggaaaatacattcccaaacagtctttcttgacacgaaaatattatttcaacaacccagaggatggatttttcaaaaaaactaaacggaaggtagtgccaccttctcctatgactgatcctactatgttgacagacatgatgaaagggaatgtaacaaatgtcctccctatgattcttattggtggatggatcaacatgacattctcaggctttgtcacaaccaaggtcccatttccactgaccctccgttttaagcctatgttacagcaaggaatcgagctactcacattagatgcatcctgggtgagttctgcatcctggtacttcctcaatgtatttgggcttcggagcatttactctctgattctgggccaagataatgccgctgaccaatcacgaatgatgcaggagcagatgacgggagcagccatggccatgcccgcagacacaaacaaagctttcaagacagagtgggaagctttggagctgacggatcaccagtgggcactagatgatgtcgaagaagagctcatggccaaagacctccacttcgaaggcatgttcaaaaaggaattacagacctctattttttgaagaccgagcagggattagctgtgtcaggaacttggagttgcacttaaccttgtaactttgtttggagctggcacctcttgaaataaaaaggaggatgcacgagctggcaggcatgcagcaaggcttgttcttgtctgggctgggttcccctttatgtttgaaactagaggaaataggagtatgctgggcaacttgttatttttaaaatgttgtaaatgttccttctggtgactctagtaatgaaagtcagagaaagggggaaacctcaggctactgataatatataaaatcttggccaggcgcagtggctcacgcctgtaatcccaggattttgggaggctgaggcgggtgggtcacgagatcaggagttcaagatcagcctggccaagatggtgaaaccccatctctactaaaaatacaaaaaaaaattagccgggcgtggtggtgggcacctgtaatcccagctacttgggaggctgaggcagagaactgcttaaacctaggaggcggaggatgcagtgagctgacatcgtgccactgcgctccagcctgggcgacagagcaaaactccatctgaaaaaaaaaaaaaaatatatatatatatatatatatatctatcttagcagaagcccagtcttcgaaggaagcattgttaattatagctaatgattatgtgcagtcagcctgacatctagccacagtaaactcctgttttcttgggatccaaacaccctgtgttttaccattagttttgttagtattgttaactttctttacacaagtaaaccatttccactaccaaaggtttagaaactatggatgaacaaaatgaatctccctgttcattttgagcctacatagacatagagaccaaatatgtcaaaaccttattcaaataaactctcttcagagtgaatacccagggtcaggacagactcagcaaaccttctatatcacttaattctgcccagtgaaaatcagtgaccctgaggcactgccagattctaaagtgcctttgggatcatcagagactgtctataaataatgcaaaatcttgatctggatgtcagtgtatcaaatcttatcaaatccattgacaaatcagtggtgctatactggaaatggctactcctttggatgaaggacctcatttcccagttgcttggaacaaaagagaatttacatattgctgtaagaagggagagacggcagttgttggtagacacacagataagggtgcccaagaataattctgtctggattaaaggtcccagggaagtgacggtgccatttctgtaccaagaggtgaatataatttgcatgttgagtgcagtaattaagaacaaacgactcgactccacaaattaaaccgtcctgttttctcttctttgcctgtgaaagtgttgcctctgtaagtcactaacaaccttctgccagcagttgactgtctatcttggatcagtgcggggagtctaagacgaaagagatgtgaaccttgccctcaactcacaagagagagacacctaagagct

SEQ ID NO: 7191 - DNA, 751 bp, Homo sapiens
gggaaccagctttcagtgaagatggcagggccagaactgttgctcgactccaacatccgcctctgggtggtcctacccatcgttatcatcactttcttcgtaggcatgatccgccactacgtgtccatcctgctgcagagcgacaagaagctcacccaggaacaagtatctgacagaaaatatctttcaggcctggtgcaatggctcacacctataatcccagcactttggggggctgagatgggaggatcccttgagcccaggaatttgagaccaaccttggcagcatgtcaagtcctaattcgaagcagagtcctcagggaaaatggaaaatacattcccaaacagtctttcttgacacgaaaatattatttcaacaacccagaggatggatttttcaaaaaaactaaacggaaggtagtgccaccttctcctatgactgatcctactatgttgacagacatgatgaaagggaatgtaacaaatgtcctccctatgattcttattggtggatggatcaacatgacattctcaggctttgtcacaaccaaggtcccatttccactgaccctccgttttaagcctatgttacagcaaggaatcgagctactcacattagatgcatcctggtaagaactttcttttgtttaataaaaacacaaaccacactttgggaagccaaggcgggaggatcacttgagcccatgagtttgagaccagcctgggcaacagagtaagaccctgtctcaag

SEQ ID NO: 7192 - DNA, 2197 bp, Homo sapiens
ccaaggactccgtatcccagcatgcagaggagccggaagacaggcgcttagaggacagcccgctgccgccggggacgcgcaggcgcagcacccctgtttgtcggccccccgagagaagaggtacggtcgaagccaggagccaggccgagcgggagctgaccaggcttgactcgggtacagaacgaggcaccagtccccttgcgaaccgaagggcctcgcagtggatggaggaggcccagccctgaggtcaacgccaaccaggctagcctggcacggggcctacagggtgggtaggcgggcgtgccgcagccgtccagggccttccctcaggtcccgggcgaggggcctacgctgcggcccggcaacaaggcccgactcggcccctcgggaccagagccccacccgatcggaagcggatcctttaccagggccataggccagtgactaggccgggcctgggcctcccatcggggccggactaggacgaggccccggggaggcccctggcctaccagacccttttctcaggccgacagccgccaggaagatgcaacgtgccctgccaggcgcccgccagcacttgggggccattctggccagcgccagcgtggtggtgaaggctctgtgtgcggcggtactattcctctacctgctctccttcgccgtggacacaggctgcctggcggtcaccccgggctacctctttcctcccaacttctggatctggaccctggccacccatgggctgatggagcagcatgtgtgggacgtggccatcagcctgacaacggtggtggtggccgggcgtttgctggagcccctctggggggccttggagctgctcatcttcttctcagtggtgaatgtgtctgtagggctgctgggggccttcgcctacctcctcacctacatggcttccttcaacctggtctacctgttcactgtccgtatccacggcgccttgggcttcctaggtggcgtcctggtggcactcaagcaaaccatgggggactgtgtggtcctgcgagtgccccaggtgcgcgtcagtgtgatgcccatgctgctgctggcgctgctgctcctgctgcggctcgccacgctgctccagagcccggcgctggcttcctatggcttcgggctgctctccagttgggtatatcttcgcttctaccagcgccatagccggggccgaggggacatggctgaccactttgctttcgccactttcttccctgagatcctgcagcctgtggtgggtttgctggcgaacttggtgcacagcctcctggtgaaggtaaagatatgccagaagacggtgaagcgctacgatgtgggtgccccatcctccatcaccatcagcctgccaggcacagaccctcaagacgccgagcggagaaggcaactggccctgaaggcactcaatgagcggctgaagagagtggaagaccagtccatctggcccagcatggatgatgatgaagaggagtctggggccaaggtggacagccccctgccctcagacaaagctcccacacccccagggaagggggctgccccagaatccagtctaatcaccttcgaggcagctcccccgacgctgtaactccagaccaccttgagtgtggcacctcccctcccaagccccccttgacatcctctcagctactccagggcacctgactgctctgaggagagggaagaaggcctgctggggctttccatggccttctgctgtttctcgccaacactacccaggactcttgctacctggttccaactccagacaaccactatgccaggcccggagcctctgaggcatcggccagtccaggccctcatctgaggtaagaatgtacatcagctggcagccccaagcaagtggctgcagggacactgatgccacagctcctgggccggccctcacatctgaaactggttgccgagagccctgagccaaggcaaggatttgccaaaaatgttctgggggcccagcaaatgcaggagccgacctggggctgcacatccctgcccatccccagaaagactgttcctgtcaggatttgtttccctctgctgtggcggtgactgcttctggaccagaacagctccagctcccaggtattttctacaggaccacttgagtgggcagccaagcccaggctcgcagtatcaataaagcagttctctgaggaatgac

SEQ ID NO: 7193 - DNA, 1716 bp, Homo sapiens
aagtgcgcatggggacgctatagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacagttctggaggctggaaggtccaagattaagataatcagcagatctggtgtctggggagacggggtttcgccatgtttgccaggctggtcctgaatgcctgacctcaagtgattcaccgcttgggcctcccaaagtgctgggattacaggtgtgagccactgcacctggcctccttaaatgtatctttatggcctaattttcacctttgcacccagttgatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatggtcttacttatccgagcccagacattgtataagaagtttgtgaagtcaactggctttctggggagtgaacagtgggcagtgattcacattgtggaccaacgggtgcgcttctacccagtggccttcttttgctgctggggcccagctgtcattctaatgatcataaagctgactaagccacaggacaccaagcttcacatggccctttatgttctccaggctctaacggcaacatctcagggtctactcaactgtggagtatatggctggacgcagcacaaattccaccaactaaagcaggaggctcggcgtgatgcagatacccagacaccattattatgctcacagaagagattctatagcaggggcttaaattcactggaatccaccctgacttttcctgccagtacttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagactcgtgttaccttgatggatattggatttgtctaagtctcttctagaaaaaataaattctagattattattt

SEQ ID NO: 7194 - DNA, 1475 bp, Homo sapiens
tagcaattcgtttgctgtccttcctctccttcgaagatgacaaggcctaccatcgtttcttcctgcctttgggccgtcaggcagttggttgggacccgctccaaccctcggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatggtcttacttatccgagcccagacattgtataagaagtttgtgaagtcaactggctttctggggagtgaacagtgggcagtgattcacattgtggaccaacgggtgcgcttctacccagtggccttcttttgctgctggggcccagctgtcattctaatgatcataaagctgactaagccacaggacaccaagcttcacatggccctttatgttctccaggctctaacggcaacatctcagggtctactcaactgtggagtatatggctggacgcagcacaaattccaccaactaaagcaggaggctcggcgtgatgcagatacccagacaccattattatgctcacagaagagattctatagcaggggcttaaattcactggaatccaccctgacttttcctgccagtacttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagactcgtgttaccttgatggatattggatttgtctaagtctcttctagaaaaaataaattctagattatt

SEQ ID NO: 7195 - DNA, 319 bp, Homo sapiens
gaagtccctatgacctttccactagacgctagcattctggaggacagttgggacttggtaaggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacaggtgagtgctacaag

SEQ ID NO: 7196 - DNA, 615 bp, Homo sapiens
gtacagagcaggattcagtataggaggagcccagctgggataggggtggagccacctgttcactgcttcaggattcagaacctgactaggaaggatcggctgctcaagggtagctgggactgaagtccctatgacctttccactagacgctagcattctggaggacagttgggacttgttttctctcccaggtttcttttttcttaaactcctggcctcaagtgatcgtcttacctcagcctctcaaagtgtcgggattacaggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtaa

SEQ ID NO: 7197 - DNA, 640 bp, Homo sapiens
cggctgctcaagggtagctgggactgaagtccctatgacctttccactagacgctagcattctggaggacagttgggacttggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcaca

SEQ ID NO: 7198 - DNA, 571 bp, Homo sapiens
actagacgctagcattctggaggacagttgggacttggtaaggtcagaagctctccctgtcttcctttgtattttccctttcttctttcctgttctgcatttttcactcacaatctcttttcatactactaacttttcttcagtttctctgttttactagtctatctttcctctttctacctatcagtgaactctagtatttgtctcttctgttacctattctttccacacatctctgtattctctctcaacatttaactttttctacccactctacattttgttcttccttttattagttttctctcccaggtttcttttttcttaaactcctggcctcaagtgatcgtcttacctcagcctctcaaagtgtcgggattacaggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatg

SEQ ID NO: 7199 - DNA, 1303 bp, Homo sapiens
ggttcttcctgcaatacagtggatacaatttgtcatggctactctgagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatggtcttacttatccgagcccagacattgtataagaagtttgtgaagtcaactggctttctggggagtgaacagtgggcagtgattcacattgtggaccaacgggtgcgcttctacccagtggccttcttttgctgctggggcccagctgtcattctaatgatcataaagctgactaagccacaggacaccaagcttcacatggccctttatgttctccaggctctaacggcaacatctcagggtctactcaactgtggagtatatggctggacgcagcacaaattccaccaactaaagcaggaggctcggcgtgatgcagatacccagacaccattattatgctcacagaagagattctatagcaggggcttaaattcactggaatccaccctgacttttcctgccagtacttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagactcgtgttaccttgatggatattggatttgtctaagtctcttctagaaaaaataaattctagattatta

SEQ ID NO: 7200 - DNA, 1300 bp, Homo sapiens
aggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacagatattctacatttcctcatttctctacaccgtcaattacatctggtatttgtacacagagctgaggatgaaacacacccagagtggacagagcacatctccactggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatggtcttacttatccgagcccagacattgtataagaagtttgtgaagtcaactggctttctggggagtgaacagtgggcagtgattcacattgtggaccaacgggtgcgcttctacccagtggccttcttttgctgctggggcccagctgtcattctaatgatcataaagctgactaagccacaggacaccaagcttcacatggccctttatgttctccaggctctaacggcaacatctcagggtctactcaactgtggagtatatggctggacgcagcacaaattccaccaactaaagcaggaggctcggcgtgatgcagatacccagacaccattattatgctcacagaagagattctatagcaggggcttaaattcactggaatccaccctgacttttcctgccagtacttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagac

SEQ ID NO: 7201 - DNA, 1266 bp, Homo sapiens
ggttcttcctgcaatacagtggatacaatttgtcatggctactctgagtgttataggttcaagttcacttattgcctatgctgtattccataatatacagaaatctccagagataagaccacttttttatctgagcttctgtgacctgctcctgggactttgctggctcacggagacacttctctatggagcttcagtagcaaataaggacatcatctgctataacctacaagcagttggacaggtgatagattatacttgtcgagtttgtcaaatggcctttgttttctcaagcctgatacctctgctattgatgacacctgtattctgtctgggaaatactagtgaatgtttccaaaacttcagtcagagccacaagtgtatcttgatgcactcaccaccatcagccatggctgaacttccaccttctgccaacacatctgtctgtagcacactttatttttatggtatcgccattttcctgggcagctttgtactcagcctccttaccattatggtcttacttatccgagcccagacattgtataagaagtttgtgaagtcaactggctttctggggagtgaacagtgggcagtgattcacattgtggaccaacgggtgcgcttctacccagtggccttcttttgctgctggggcccagctgtcattctaatgatcataaagctgactaagccacaggacaccaagcttcacatggccctttatgttctccaggctctaacggcaacatctcagggtctactcaactgtggagtatatggctggacgcagcacaaattccaccaactaaagcaggaggctcggcgtgatgcagatacccagacaccattattatgctcacagaagagattctatagcaggggcttaaattcactggaatccaccctgacttttcctgccagtacttctaccattttttgaaactacaatactggaacatccaggaactggagttattctacgctaatggattggaaagaatgttgggaaaggacatcttaaatcttttctaactatgccctaaactgcagaactcaaaggaaatatagtgccattgttagtagtcattctagatgaattgggagtatctctccagttattcccagattcactagtgatccttaaagtctctattcagggagaggaagacactttccatctcagagatagactcgtgttaccttgatggatattggatttgtctaagtctcttctagaaaaaataaattctagattattattta

SEQ ID NO: 7202 - DNA, 2758 bp, Homo sapiens
gtctcgccgcgcttcccagcgaggccgccggcgcgccgagggctgtgctcgaccgcgaatcccgtgtgcagtcgccccgcgccccgcgcgacccttcgggtaaactacgaactgggagttctgaagaatgggtaaagactttcgttactatttccagcatccctggtctcgcatgattgtggcttacttggtgatcttctttaacttcttaatatttgcggaggacccagtttctcatagccaaacagaagccaatgttattgttgttggaaactgtttttcatttgttacaaataaataccctagaggagttggctggaggattttgaaggtgcttctatggctacttgccattctcacaggactaatagctggcaaatttctgttccatcagcgtttgtttggtcagttgctccgattaaaaatgtttcgagaagatcatgggtcgtggatgacaatgttcttcagcacaattctctttctcttcatattttctcacatatacaacacgattcttctaatggatgggaacatgggagcatatatcattacagactatatgggcatccgaaatgaaagtttcatgaaattagctgcagtagggacctggatgggggactttgtcacagcttggatggtcactgatatgatgcttcaggacaaaccctatcctgactggggaaaatcagcaagagctttctggaagaaaggaaatgttaggatcactttattctggacagttctttttactctgacgtctgtggttgtacttgtgattacaacggactggatcagctgggacaagctgaatcggggatttttgcccagtgatgaagtttccagagcattccttgcttcttttatcttggtctttgaccttcttattgtgatgcaggactgggaattcccacatttcatgggagatgttgatgtaaatctccctggtttgcacacccctcacatgcagttcaagattcctttcttccagaaaatcttcaaggaggaatatcgtattcacataacaggcaaatggtttaactatggaattatcttcctcgtcttgattttggatcttaatatgtggaagaaccaaatattttataaacctcatgaatatgggcaatatatcggcccggggcagaagatatatacagtgaaagactcagaaagtttaaaagatttgaacagaaccaagctatcctgggaatggaggtccaatcacactaaccctcggactaataaaacatatgttgagggagacatgttcttacacagcaggttcataggagccagtcttgatgtcaagtgtctggcctttgttccaagcctgatagcctttgtgtggtttggattctttatttggttctttggacgatttttgaaaaatgagccacgcatggagaatcaagacaaaacttacactcgcatgaaaagaaaatctccatcagaacatagcaaagacatgggaatcactcgagaaaacacccaggcttcagtagaagaccccttgaatgacccttctttggtttgcatcaggtctgacttcaatgagatcgtctacaagtcttcccacctaacctcggaaaacttgagctcacagttgaacgaatctactagtgcaacagaagctgatcaagacccaacgacttctaaaagtacacctacgaactagactcggagatagacttggagataacacaaaaagcaaccttgagtgtaactttaaaaatttagtctttccttttgtatatgtaaggtttacgtagtgttaggtaaaaatatgaacaatgccacaacggtgctcaacatgctttttctaggattcattgttttctatttgtattataatacacgtgcctactgtatactcaacagtcctctagagattgcttttcacaattgcacaagctattactgactttacagcatagtggaagattagctgatgacccatgtatctgatgttcaaccatagtggtgccttgagacattaaactgtttttaactgtaccagaaatgaagtgtggaacagttacctaacctatttcacatgggcgttttgtatacaactattttgatctacacttgatgtctgagcagaaaacagaaatagctaaatgtgactcaggaagtatctcttggtttcttattcagcagcagagttggtgactttgacaactggactgcagagaaacatggtgatcaccttttaatttttattggctgtctgccaaatataaatacagatgcaaaattcagtaataggagatccataacccaacatgggtcactactcgtgaaatgtgactttctcccaccagtaattgaaatgaggtgatgatacctaattatgttttcctaattaaagataaattgctacttgattaaaaatcctgcccttcacctttgggaacaaaggttaagagacacagttgggcgaactctcaaatttattggcatttacacaaagtcccagacaaccaaggaactgaagttttcatcatatgagagcagcacatcccaccatttacaatattcgtatatctttctgcaaatatggctctggatagtgaaaattgaaaaacatatgccaaccctgagcaagggaactcctcaaaaaatcatgcagcggaaccttgtcaggtagagaagccgtgcatgaaagaatttgtttaatgtcttgttttgcgtatgtgttttttgtttttgttttttaagaactaaatattgcacattaataaataagaattatacagca

SEQ ID NO: 7203 - DNA, 1874 bp, Homo sapiens
atgtacataaaagactgggaattcccacatttcatgggagatgttgatgtaaatctccctggtttgcacacccctcacatgcagttcaagattcctttcttccagaaaatcttcaaggaggaatatcgtattcacataacaggcaaatggtttaactatggaattatcttcctcgtcttgattttggatcttaatatgtggaagaaccaaatattttataaacctcatgaatatgggcaatatatcggcccggggcagaagatatatacagtgaaagactcagaaagtttaaaagatttgaacagaaccaagctatcctgggaatggaggtccaatcacactaaccctcggactaataaaacatatgttgagggagacatgttcttacacagcaggttcataggagccagtcttgatgtcaagtgtctggcctttgttccaagcctgatagcctttgtgtggtttggattctttatttggttctttggacgatttttgaaaaatgagccacgcatggagaatcaagacaaaacttacactcgcatgaaaagaaaatctccatcagaacatagcaaagacatgggaatcactcgagaaaacacccaggcttcagtagaagaccccttgaatgacccttctttggtttgcatcaggtctgacttcaatgagatcgtctacaagtcttcccacctaacctcggaaaacttgagctcacagttgaacgaatctactagtgcaacagaagctgatcaagacccaacgacttctaaaagtacacctacgaactagactcggagatagacttggagataacacaaaaagcaaccttgagtgtaactttaaaaatttagtctttccttttgtatatgtaaggtttacgtagtgttaggtaaaaatatgaacaatgccacaacggtgctcaacatgctttttctaggattcattgttttctatttgtattataatacacgtgcctactgtatactcaacagtcctctagagattgcttttcacaattgcacaagctattactgactttacagcatagtggaagattagctgatgacccatgtatctgatgttcaaccatagtggtgccttgagacattaaactgtttttaactgtaccagaaatgaagtgtggaacagttacctaacctatttcacatgggcgttttgtatacaactattttgatctacacttgatgtctgagcagaaaacagaaatagctaaatgtgactcaggaagtatctcttggtttcttattcagcagcagagttggtgactttgacaactggactgcagagaaacatggtgatcaccttttaatttttattggctgtctgccaaatataaatacagatgcaaaattcagtaataggagatccataacccaacatgggtcactactcgtgaaatgtgactttctcccaccagtaattgaaatgaggtgatgatacctaattatgttttcctaattaaagataaattgctacttgattaaaaatcctgcccttcacctttgggaacaaaggttaagagacacagttgggcgaactctcaaatttattggcatttacacaaagtcccagacaaccaaggaactgaagttttcatcatatgagagcagcacatcccaccatttacaatattcgtatatctttctgcaaatatggctctggatagtgaaaattgaaaaacatatgccaaccctgagcaagggaactcctcaaaaaatcatgcagcggaaccttgtcaggtagagaagccgtgcatgaaagaatttgtttaatgtcttgttttgcgtatgtgttttttgtttttgttttttaagaactaaatattgcacattaataaataagaattatacagc

SEQ ID NO: 7204 - DNA, 1233 bp, Homo sapiens
atggctacttgccattctcacaggactaatagctggcaaatttctgttccatcagcgtttgtttggtcagttgctccgattaaaaatgtttcgagaagatcatgggtcgtggatgacaatgttcttcagcacaattctctttctcttcatattttctcacatatacaacacgattcttctaatggatgggaacatggggtcactgatatgatgcttcaggacaaaccctatcctgactggggaaaatcagcaagagctttctggaagaaaggaaatgttaggatcactttattctggacagttctttttactctgacgtctgtggttgtacttgtgattacaacggactggatcagctgggacaagctgaatcggggatttttgcccagtgatgaagtttccagagcattccttgcttcttttatcttggtctttgaccttcttattgtgatgcaggactgggaattcccacatttcatgggagatgttgatgtaaatctccctggtttgcacacccctcacatgcagttcaagattcctttcttccagaaaatcttcaaggaggaatatcgtattcacataacaggcaaatggtttaactatggaattatcttcctcgtcttgattttggatcttaatatgtggaagaaccaaatattttataaacctcatgaatatgggcaatatatcggcccggggcagaagatatatacagtgaaagactcagaaagtttaaaagatttgaacagaaccaagctatcctgggaatggaggtccaatcacactaaccctcggactaataaaacatatgttgagggagacatgttcttacacagcaggttcataggagccagtcttgatgtcaagtgtctggcctttgttccaagcctgatagcctttgtgtggtttggattctttatttggttctttggacgatttttgaaaaatgagccacgcatggagaatcaagacaaaacttacactcgcatgaaaagaaaatctccatcagaacatagcaaagacatgggaatcactcgagaaaacacccaggcttcagtagaagaccccttgaatgacccttctttggtttgcatcaggtctgacttcaatgagatcgtctacaagtcttcccacctaacctcggaaaacttgagctcacagttgaacgaatctactagtgcaacagaagctgatcaagacccaacgacttctaaaagtacacctacgaactag

SEQ ID NO: 7205 - DNA, 2707 bp, Homo sapiens
aggagggacgggaggagggacgggaggagggagggcgggcaggcgccagcccagagcagccccgggcaccagcacggactctctcttccagcccaggtgccccccactctcgctccattcggcgggagcacccagtcctgtacgccaaggaactggtcctgggggcaccatggtttcggcggcagcccccagcctcctcatccttctgttgctgctcctggggtctgtgcctgctaccgacgcccgctctgtgcccctgaaggccacgttcctggaggatgtggcgggtagtggggaggccgagggctcgtcggcctcctccccgagcctcccgccaccctggaccccggccctcagccccacatcgatggggccccagcccataaccctggggggcccatcaccccccaccaacttcctggatgggatagtggacttcttccgccagtacgtgatgctgattgctgtggtgggctccctggcctttctgctgatgttcatcgtctgtgccgcggtcatcacccggcagaagcagaaggcctcggcctattacccatcgtccttccccaagaagaagtacgtggaccagagtgaccgggccgggggcccccgggccttcagtgaggtccccgacagagcccccgacagcaggcccgaggaagccctggattcctcccggcagctccaggccgacatcttggccgccacccagaacctcaagtcccccaccagggctgcactgggcggtggggacggagccaggatggtggagggcaggggcgcagaggaagaggagaagggcagccaggagggggaccaggaagtccagggacatggggtcccagtggagacaccagaggcgcaggaggagccgtgctcaggggtccttgagggggctgtggtggccggtgagggccaaggggagctggaagggtctctcttgttagcccaggaagcccagggaccagtgggtccccccgaaagcccctgtgcttgcagcagtgtccaccccagtgtctaacagtcctcccgggctgccagccctgactgtcgggcccccaagtggtcacctccccgtgtatgaaaaggccttcagccctgactgcttcctgacactccctccttggcctccctgtggtgccaatcccagcatgtgctgattctacagcaggcagaaatgctggtccccggtgccccggaggaatcttaccaagtgccatcatccttcacctcagcagccccaaagggctacatcctacagcacagctcccctgacaaagtgagggagggcacgtgtccctgtgacagccaggataaaacatccctcaaggctgggtgtggaggctcacacctgtaatctcagcattttgggaggccaagtgcggacatcacttgagaccaggagttccaaaccagccctggcaacattgtgagacccatctctataaaaacaaaaaacagtccactaaatcagccacattaattgggaatcatatgtcacaggtcatttgtggggcaaacatcactgcttttccatcaagggagcaaagaataagtgggagttttggaagagtttggatgagagacgccaaggtgcccagcgttcgtaaggcaacatgcagcctggcgtgaagcagtattttgaaactgcaaatggttcccttcttgtgtcctttcaatgctgaatattttagtgtcattctgcctgtgctcagagctccagcagcagaagtgtgtgtggttaattaggacacttctgtgagaggacccctgcacacattacgacaggtccctaaatgagcatttcccaaactaggttccccgaggcactctacggaaacaagatttttttttttgagacggagtctcggtctgtcacccaggctggagtgcagtggtgcaatcttggtgcaatcttggctcagtgcaatccgcctcccaggttcaagcgattctcccgcctcagtagctgggattacaggtgcccaccactgcgcccagctaaattttgtatttttagtagagatggggcttcaccatgttggccaggctggtctggaactcctgaccttcaggtgatccacctgcctctgcctcccaaagtgctgggattacaggcgtgagccaccgtgcccggcccaaactactttttaaaacagctacagggtaaaatcctgcagcacccactctggaaaatactgctcttaattttcctgaaggtggccccctgtttctagttggtccaggattagggatgtggggtatagggcatttaaatcctctcaagcgctctccaagcacccccggcctgggggtgagtttctcatcccgctactgctgctgggatcaggttgaatgaatggaactcttcctgtctggcctccaaagcagcctagaagctgaggggctgtgtttgaggggacctccaccctggggaagtccgaggggctggggaagggtttctgacgcccagcctggagcaggggggccctggccaccccctgttgctcacacattgtctggcagcctgtgtccacaatattcgtcagtcctcgacagggagcctgggctccgtcctgctttagggaggctctggcaggaggtcctctcccccatccctccatctggggctcccccaacctctgcacagctctccaggtgctgagatataatgcaccagcacaataaacctttattccggcctgaa

SEQ ID NO: 7206 - DNA, 1084 bp, Homo sapiens
accagcacggactctctcttccagcccaggtgccccccactctcgctccattcggcgggagcacccagtcctgtacgccaaggaactggtcctgggggcaccatggtttcggcggcagcccccagcctcctcatccttctgccaccctggaccccggccctcagccccacatcgatggggccccagcccataaccctggggggcccatcaccccccaccaacttcctggatgggatagtggacttcttccgccagtacgtgatgctgattgctgtggtgggctccctggcctttctgctgatgttcatcgtctgtgccgcggtcatcacccggcagaagcagaaggcctcggcctattacccatcgtccttccccaagaagaagtacgtggaccagagtgaccgggccgggggcccccgggccttcagtgaggtccccgacagagcccccgacagcaggcccgaggaagccctggattcctcccggcagctccaggccgacatcttggccgccacccagaacctcaagtcccccaccagggctgcactgggcggtggggacggagccaggatggtggagggcaggggcgcagaggaagaggagaagggcagccaggagggggaccaggaagtccagggacatggggtcccagtggagacaccagaggcgcaggaggagccgtgctcaggggtccttgagggggctgtggtggccggtgagggccaaggggagctggaagggtctctcttgttagcccaggaagcccagggaccagtgggtccccccgaaagcccctgtgcttgcagcagtgtccaccccagtgtctaacagtcctcccgggctgccagccctgactgtcgggcccccaagtggtcacctccccgtgtatgaaaaggccttcagccctgactgcttcctgacactccctccttggcctccctgtggtgccaatcccagcatgtgctgattctacagcaggcagaaatgctggtccccggtgccccggaggaatcttaccaagtgccatcatccttcacctcagcagccccaaagggctacatcctacagcacagctcccctgaca

SEQ ID NO: 7207 - DNA, 486 bp, Homo sapiens
ggcccagccggggagggaggaaggaggagggacgggaggagggacgggaggagggagggcgggcaggcgccagcccagagcagccccgggcaccagcacggactctctcttccagcccaggtgccccccactctcgctccattcggcgggagcacccagtcctgtacgccaaggaactggttcttgctctgtcacccaggctggagtgcagtgccaactccgctcactgcagcctcaacttcccgggctcaggcgattctcccacctcggtctcctcggtacctgggaccacaagtgtgcgccactaggcctggctaatttttggtgtttttagtagagacagaattttgccgtgttgaccaggctggtcttgaactcctgagctcaggtcctgggggcaccatggtttcggcggcagcccccagcctcctcatccttctgttgctgctcctggggtctgtgcctgctaccgacgcccgctctgtg

SEQ ID NO: 7208 - DNA, 575 bp, Homo sapiens
ctgtctgtctcagcctgccctggggacccgaggtcagggaggaagtgccgcatctggtcttccccagagcgagagtcccaggtgccccccactctcgctccattcggcgggagcacccagtcctgtacgccaaggaactggtcctgggggcaccatggtttcggcggcagcccccagcctcctcatccttctgttgctgctcctggggtctgtgcctgctaccgacgcccgctctgtgcccctgaaggccacgttcctggaggatgtggcgggtagtggggaggccgagggctcgtcggcctcctccccgagcctcccgccaccctggaccccggccctcagccccacatcgatggggccccagcccataaccctggggggcccatcaccccccaccaacttcctggatgggatagtggacttcttccgccagtacgtgatgctgattgctgtggtgggctccctggcctttctgctgatgttcatcgtctgtgccgcggtcatcacccggcagaagcagaaggcctcggcctattacccatcgtccttccccaagaagaagtacgtggaccaga

SEQ ID NO: 7209 - DNA, 567 bp, Homo sapiens
attcggcgggagcacccagtcctgtacgccaaggaactggttcttgctctgtcacccaggctggagtgcagtgccaactccgctcactgcagcctcaacttcccgggctcaggcgattctcccacctcggtctcctcggtacctgggaccacaagtgtgcgccactaggcctggctaatttttggtgtttttagtagagacagaattttgccgtgttgaccaggctggtcttgaactcctgagctcaggtgatcctcccaccttggcctcccaaagtgctgggattacaggcatgagccaccgcacccagctgatgcgatccatttcaatgaaagctgtgtcacagagaagcctcaggtcacctggaacaagcccctcaatggcccaacctggttcctacctcacctccagaatcctcacggtcctgggggcaccatggtttcggcggcagcccccagcctcctcatccttctgttgctgctcctggggtctgtgcctgctaccgacgcccgctctgtgcccctgaaggccacgttcctggaggatgtggcgggtagtggggaggcc

SEQ ID NO: 7210 - DNA, 2766 bp, Homo sapiens
agttgcgcgcgtggctctggctgcgcaggaacagctggtgcctccgagggcggtcggcgagcgcgcgggcgtggggcgctggggggccggtcgggcagcgctgcgggagcagccgccggcaccgccgccttgcaccatcgcatcatgtccgggcagctggagcgttgcgagcgcgaatggcacgagctggagggagaatttcaagaactgcaggagacgcacaggatctacaagcagaagctggaggagctggctgcgctgcagacgctgtgtagcagttccatcagtaagcagaagaagcacctcaaggacttgaagcttacactccagaggtgcaaacgccatgccagtcgggaggaggcggagctcgttcagcagatggcagcgaacatcaaggagcggcaggacgtcttcttcgacatggaggcctacctgcccaagaagaacgggctctacttgaacctggtcctcggcaatgtgaacgtgaccctcctcagcaaccaggccaagttcgcctacaaggacgaatatgagaagttcaagctctacctgaccatcatcctgctcctgggtgccgtggcatgtcgatttgtccttcactacagggtgactgacgaagtcttcaacttcctgctggtgtggtattactgcaccctgaccattcgggagagcattctcatcagcaacggctcaagaattaaaggctggtgggtgtctcaccactacgtctccacattcctgtccggagtgatgctgacctggcctaatggacccatttatcagaagtttcgcaaccagttcttagcattttccatttttcagagctgcgtccagttcctgcaatattattaccagaggggctgcctctaccggctgcgggccctgggggagaggaaccacctggatctcacagtggaagggttccagtcctggatgtggcggggcctcacctttctcctgcccttcctcttctgtggccatttctggcagctctacaatgccgtcacgctgtttgagctctccagccacgaggaatgcagagaatggcaggtgttcgtactggcgttcaccttcctcatcctcttcctcggcaacttcctgaccacgctcaaagtcgtgcatgccaagctccagaagaacagaggcaagacaaagcagccgtgagcctcgggctcctgtgccctcggcccggacttcagactgcagggggctcccgggctccttcccagcagccctctcaggcccgtggcatcgctgggagagggcccaggccctggtcccccagtggaccccagtggtctagaggaatgtgagccccgcctgtccgcacagtgtccgcccacctatttatgacatatttaatgctgggtcccccatcgtccctggaacccgaggcctcactcctgtgcttgaaggtggctgaggccgggccagtcttcctggggatggggcctgaagcctcagggagcccctctgttcccactcctgtcatttgaacccctctgggtggggtttggatgtgcctcgcggggttggatttatgctgacctgctacttaccaggcccaggctggggtggtgtgaaccctcagtgtcctgtggcgcccccaccccggggccactctgcttctgctgtgagccccctcctcgcccaccccgccacgtggtgagggttattttaagttctcagagacccaccgcgtctgcctcgtgctcttcttgcccctggagcgctgggggcatcctgagtcaggctgtgagaagattcgccaccagagggcgccccgggccctgggtcgtccaaggggacaaggacgttcccgtctgtgcttcggggttccctgacccccccatcctgcagcccaccttcctgcagtgtcgtggcaggcgacaccgactcctaggcgccctccagagccaagcagcttgcgacttctggtaggcaccggaatcccctgggatgcttgttttaaaagtcctgggccgggcacggtggctcacgcctgtaatcccagcactttgggaggctaaggcgggtggatcacgaggtcaggagttcaagaccagcctggccaacatggtgaaaccctgtctctactaaaaatacaaaaattagccggacgtggtggtgtgcgcatgtagtcccagctactcaggaggctgaggcaagagaatcgcttgaacccaggaggtggagcttgcagtgagccaagatcatgccactgcactctagcctgagtgacagaatgagactctgtcccaaaaaaaaaaaaaaaaaaaaattcccagaccctcggccccagaccttcccaaaggaggctcagggattaggtatctggctgttggtgacacaggtggtctatgaaccagttctgagaaactgtcccgcgtggacagggggtagatcccatcagttctcaaaggaggccaggatgtctcgcctcctgaactccacaggctggtagaagcggggcttgagggacagcaggttgggagcttgaggactaagtgggccagtcctgtcctaccacagtggggggaacagtccacagaaaacttgctcatgaccacactgggagccgactgttcttcccatcccaagtctctgacactgggggctttgggtgaaaccttaaggagatggtcagatgggtggtccagggtatacttttaacaactgagaagccattttttctgccccctgggcacatgtgcccagctctgcaaagacagtggccaagttgaagacaagtcttccatgtggggt

SEQ ID NO: 7211 - DNA, 7461 bp, Homo sapiens
ccgagggcggtcggcgagcgcgcgggcgtggggcgctggggggccggtcgggcagcgctgcgggagcagccgccggcaccgccgccttgcaccatcgcatcatgtccgggcagctggagcgttgcgagcgcgaatggcacgagctggagggagaatttcaagaactgcaggagacgcacaggatctacaagcagaagctggaggagctggctgcgctgcagacgctgtgtagcagttccatcagtaagcagaagaagcacctcaaggacttgaagcttacactccagaggtgcaaacgccatgccagtcgggaggaggcggagctcgttcagcagatggcagcgaacatcaaggagcggcaggacgtcttcttcgacatggaggcctacctgcccaagaagaacgggctctacttgaacctggtcctcggcaatgtgaacgtgaccctcctcagcaaccaggccaagttcgcctacaaggacgaatatgagaagttcaagctctacctgaccatcatcctgctcctgggtgccgtggcatgtcgatttgtccttcactacagggtgactgacgaagtcttcaacttcctgctggtgtggtattactgcaccctgaccattcgggagagcattctcatcagcaacggctcaagaattaaaggctggtgggtgtctcaccactacgtctccacattcctgtccggagtgatgctgacctggcctaatggacccatttatcagaagtttcgcaaccagttcttagcattttccatttttcagagctgcgtccagttcctgcaatattattaccagaggggctgcctctaccggctgcgggccctgggggagaggaaccacctggatctcacagtggaagggttccagtcctggatgtggcggggcctcacctttctcctgcccttcctcttctgtggccatttctggcagctctacaatgccgtcacgctgtttgagctctccagccacgaggaatgcagagaatggcaggtgttcgtactggcgttcaccttcctcatcctcttcctcggcaacttcctgaccacgctcaaagtcgtgcatgccaagctccagaagaacagaggcaagacaaagcagccgtgagcctcgggctcctgtgccctcggcccggacttcagactgcagggggctcccgggctccttcccagcagccctctcaggcccgtggcatcgctgggagagggcccaggccctggtcccccagtggaccccagtggtctagaggaatgtgagccccgcctgtccgcacagtgtccgcccacctatttatgacatatttaatgctgggtcccccatcgtccctggaacccgaggcctcactcctgtgcttgaaggtggctgaggccgggccagtcttcctggggatggggcctgaagcctcagggagcccctctgttcccactcctgtcatttgaacccctctgggtggggtttggatgtgcctcgcggggttggatttatgctgacctgctacttaccaggcccaggctggggtggtgtgaaccctcagtgtcctgtggcgcccccaccccggggccactctgcttctgctgtgagccccctcctcgcccaccccgccacgtggtgagggttattttaagttctcagagacccaccgcgtctgcctcgtgctcttcttgcccctggagcgctgggggcatcctgagtcaggctgtgagaagattcgccaccagagggcgccccgggccctgggtcgtccaaggggacaaggacgttcccgtctgtgcttcggggttccctgacccccccatcctgcagcccaccttcctgcagtgtcgtggcaggtacttggagagtgggaccaagacccttggcccctgtggaggggaaccacctcccccctccttcccagagcttctggatgttgtgggagggaggtgggggtgcctggcaggctcacccccaggggccgcaccctgaggcggggtcagagccactgggcatcgcttgggtgagattctgcattcgacgggaggcagagaggccaccaggtttggctgagtgctctgccccaccattcatatatgggcctcagctccccctaactgtggccctacaaatccctaggccagacctcacagcagtgcccacaggcatgccttgtttagccctcctcaaggaattttaaaatttttaattactttttttttttttgagacagggtctgttgcctaggcgggagtgcagtggcatcataggtcactgtagcctccgcctccagggctcaagggatcctcccacctcagcctctggagtagctgggaccacaatcacacaccaccatgccctgctccttttttttttttttttttgagatgggagtctcgatctgttacccaggctggagtgcagtgacacaatctcagctcactgcaacctctgcctcccaggttcaagtgattctcctgcctcagcctcccgagtaactgggactacaggcgcgtgccaccatgcctggcttttgttttgttttgttttgttttgtatttttagtagagacagggtttcaccatgtttgccaggatagtctcgatctcttgaccttgtgatctgcctgcctcagcctcccaaagtgctgggattacaggtgtgagccaccatgcctggtcaccctgctactttttaatactttttagtagagatggggtctcactatgttgcccaggctggtctccaactcatgggctcaactcatcctcctatcttggcctcccaaagcgctgggattacaggtgtgagccactgtgcctggcctgattacatttttaaaatgagatttccccacccctacagtgagattccacataaaaatccagatttctgctttccctagaaaaacggacctggcaacattcccgtggcacaggacgcctactctccagttgccacaggccctgccacccccctgcccttcattctggtctcctttctggtcctttttaggcacctgcgtttgccctagattaggagtcagctagctgtctgtaaagggccagatggcaactattttgagctttatgggccaggtggtttgtggcagctactcttcacctgcagccccagagcacaaggcaatgcagaaaggaatgggtgttgctgtgttccaataaaactttatttacaaatcaggctgtggccagatgtggcccacaggctgtagttgttggacctctaccgtagaccatcatgaggcctggggttcttcgagaacaagaactccttggttgattccccagggtacggcagggccttgggaacctgggtgggttggggagggtctcagaaggctccttcctttggcaacctgacttcttggaagctcaggtttagctgacgccccagcactgggccaggggggctgaggcaggagatatggggaaggctaggagttgcctgaagccattatcccatcttaggcgacaccgactcctaggcgccctccagagccaagcagcttgcgacttctggtaggcaccggaatcccctgggatgcttgttttaaaagtcctgggccgggcacggtggctcacgcctgtaatcccagcactttgggaggctaaggcgggtggatcacgaggtcaggagttcaagaccagcctggccaacatggtgaaaccctgtctctactaaaaatacaaaaattagccggacgtggtggtgtgcgcatgtagtcccagctactcaggaggctgaggcaagagaatcgcttgaacccaggaggtggagcttgcagtgagccaagatcatgccactgcactctagcctgagtgacagaatgagactctgtcccaaaaaaaaaaaaaaaaaaaaattcccagaccctcggccccagaccttcccaaaggaggctcagggattaggtatctggctgttggtgacacaggtggtctatgaaccagttctgagaaactgtcccgcgtggacagggggtagatcccatcagttctcaaaggaggccaggatgtctcgcctcctgaactccacaggctggtagaagcggggcttgagggacagcaggttgggagcttgaggactaagtgggccagtcctgtcctaccacagtggggggaacagtccacagaaaacttgctcatgaccacactgggagccgactgttcttcccatcccaagtctctgacactgggggctttgggtgaaaccttaaggagatggtcagatgggtggtccagggtatacttttaacaactgagaagccattttttctgccccctgggcacatgtgcccagctctgcaaagacagtggccaagttgaagacaagtcttccatgtggggtggagatgggaggggtgggtgccaggctgcagcctgtgtcctcctgataggcccagccccctcggtggcctccgtgttcctgggggaaggaaggaaggagctggaggatacagtggtgcctatctcgggagcccagggaggcagggacacaggagtggcaggcttggggcgcccgcgtggaacagtgccaggtctacgtttacccactaccagatagactttttcatttcaagcataacttgagtctgcactggggagacactcgtggtgggggtggctgtgatgagggcacttgcgagtcccgacaacagacactggctcctgcacccacatcaccaccatgtcccaggggcagcctggaggggagtttgtggtcagagccccagccaggaaaggagagagttccagaatgttccaagagtctagccgcaggccccagacaccatgagctggagggtcgggatggggcagcctccctggtgcaatcggcacctgggcccccgggccctgtcagtgctgtcgtgaggtctgtctgccctgggtcagagcagcaggcagagccggcgcttcttctgccgttgcgccttcttcagagcgctgagagccaccttggcggcctcccggaagacgtcctccacattctcccgaaacttggcggaacattccaggtagagagcagctcggatctgttcgcaggcgctcaggccctgggtggggggaggagccagcattaggtgaggggcccctggaggtctcctagcaccacctggtgggtttgggactggctctgaggactctgcagggatggaggccttggtttgggcctgtctgtctcctccatcctggctgcccctcacagtgtgtgggtggaatggagggccagggcagtgcagcccgcaggttggaagaagccctgtccaggcccccaccctggcctctctccagctccgggcagggaggggctgaatcctgagacccggggttggttcccccaggtgtctcccaggcctgtgagaagagttggaggcctcaagacagaaaggacttccagccacctctctcccttctctgaaagtaccatttaggcaaattaatttgcccttttatttatttatttttgagatggagttttgctcttgttacccaggctggagtgcaatggcgcgatcttggttcatcacaacctctgccacccaggttcaagcgattctcctgcctcagcctcccgagtagctgggattacaggcatgcgccaccatgcccggctaatgttgtatttttagtagagatggggtttctctcatgttggtcaggctggtctcaaactcccaacctcaggtgattcgcccgcctcggcctcccaaagtgctgggattacaggcgtgagccactatgcccggccggatttgcccttattaatggttatttcttgtgaaagtttctttttgcctttgcattccttttattctgtttattcccccatgcctcacccaaagagttgcacggtcaattggcccgtgaaggggacgcctactttcaaacaaggcagacaggacacgacaggacggcggctcatagcacagactttggattgcagtggatgggaccagatcctggctccacttctcgctagctgtgtggccctgggcaagctgcttaacctctctgggcctcagtttctccccctgtaaactgggggatgtgaacagcgcctgcctccgagtcctaaggattgggagtagtcgtgtaaagtgctcaggtccacaggccatcaatactaatagttaaaaattattcttagaatcttgcttccctcagctccctgaaaggccactaaggcaccccagttgcagaggccaaaggtccgggaggcttcacagccacggctgtgccccagggtcttggccccggcccacctgcatgtaggtgatgggctccagctgggcggcccggagcttccgcagctgctccttgtccttcctcaggtctgtcttgcagccgatgagcaccatggggatcccgcggcagaaatgcgtgacctcagggaaccactgtggagggaggaggcgggatcaggggtgcggccgggcccagatgtggggccaccacccaggaggccggcctcaccttgatgaggacgttgtcgtagctggtgggattcatgacgtcatagcagatgagcacgaggtgggtgttctggtaggacaggggccgcagccggtcatagtcttcttgccctgaaagcacagagcagcgggggtcaggggacgtcccctccctgtctggactctgacgggtgaaggggaaggggccaggcaagtgaccctgccttagggcctcaatttcctcatctatacaatgggcagcaagccaggagtgctggcacaggcctgtggtcgcagctactcgggaggctgaggccggaggatcgcttgagcccaggaggtcaaggctacagtgagccgtgatcatgccactgcactccagcctgggtgacagagcgagaccctgtctcttaacaacaaaacccatgagcggcagccccccagtcctggatggtggtaaagaatcctcaagatcaaacccacgcagtgctgagagcttggcctgattctagggctggggctggagaaactgctagagatgatgccgatagccagtgtgatccccctgccctgatggtcaagggcagagtgcagactggaaccctcccctccccaaagattcagacctgtggggctgagtgggctcatagtgtccccaagtcctgagaggctggtgtctggcttcagcctccagcttctcaggttctgatgcagtcagctgagttccctgcctattcttgcaagcactaggaggagggtggtgggttgctgggaacagcaccgagcgccctccccacccagattcacagagcacactccctggggggatactttaatccggaggccgtgacgcctggctccgccccgagacgagctgaatccaaatacggatctaggcttgagcttggttgggtttgcttttttcttcttcttctttataaacaattctttgtaactttttgtattgacagtttcaaacttacagtaaaattgcaacacgag

SEQ ID NO: 7212 - DNA, 1532 bp, Homo sapiens
agaggctgggcgggcgggcccgggagcggcgcagcatctgcgggcggcggggtttcgagctcgccgggccgtgtcgcgccatgcccgctggctgagcgccgcagggcctcgtcccgccaggcgtgggggccgcgcgcgcccaggccggggcccggcggccgaccatggtgctgccgcccccggaccggcgccacgtgtgcctgaccacgctggtgatcatgggcagcatggccgtcatggacgcgtacctggtggagcagaaccagggcccgcgcaagatcggcgtgtgcatcatcgtgctggtgggcgacgtgtgcttcctgctggtgctgcgctacgtggccgtgtgggtgggcgccgaggtgcgcacggccaagcgcggctacgccatgatcctgtggttcctttacatcttcgtgctggagatcaagctctacttcatcttccagaactacaaggcggcgcggcgcggcgcggcggaccccgtggcgcgcaaggcgctgacgctgctgctgtctgtgtgtgtgcccggcctgttcctgctgctcgtggcgctggaccgcatggagtacgtgcgcaccttccgcaagcgcgaggacctgcgcggccgcctgttttgggtggcgctggacctgctggacctgctggacatgcaggccagcctgtgggagccgccgcgctccgggctgccgctgtgggccgagggcctcaccttcttctactgctacatgctgctgctggtgctgccgtgcgtggcgctcagcgaggtcagcatgcagggcgagcacatagcgccgcagaagatgatgctgtacccggtgctcagcctcgccaccgtcaatgtggtggccgtgctggcgcgcgccgccaacatggcgctgttccgggacagccgtgtctcggccatcttcgtcggcaaaaacgtggtggcgctcgccaccaaggcctgcaccttcctggagtaccgccgccaggtgcgcgacttcccgccgcctgcgctatcactggagctgcagccgccacccccgcagcgcaactcggtgccgccgccgccgccgccgctgcacggcccgcctgggcgcccccacatgtcctcgcccacgcgtgaccccctggacacgtgacagggcccgcgcggcccccgacacgcccctggggcgcagagacaccgggttggcttggggcgcgcggtttgcatgggatggggtgggggcgggctcccctagggacaggtgcctcgagtgcccgtgcctggggtcccgcggccgcttcttcatctcaggaatctctcggaccgcggatcctcagcccccgctccaccagcccgccccagcgcgtgggtctgtttgggaggcctgggccggagcagagcagaggtgatccggcccctgcctgctgggccgcccgggttggaagggagggcagtgtgggcggagatctgctccttcggtgggggcctctggctcagatttggggccaaggaggcctctgtcattttaaagactcgtgtttacagttttgtatccaaggcc

SEQ ID NO: 7213 - DNA, 1519 bp, Homo sapiens
cgcgcctggtgggaagcacgcggggtgcggggggcggggtttcgagctcgccgggccgtgtcgcgccatgcccgctggctgagcgccgcagggcctcgtcccgccaggcgtgggggccgcgcgcgcccaggccggggcccggcggccgaccatggtgctgccgcccccggaccggcgccacgtgtgcctgaccacgctggtgatcatgggcagcatggccgtcatggacgcgtacctggtggagcagaaccagggcccgcgcaagatcggcgtgtgcatcatcgtgctggtgggcgacgtgtgcttcctgctggtgctgcgctacgtggccgtgtgggtgggcgccgaggtgcgcacggccaagcgcggctacgccatgatcctgtggttcctttacatcttcgtgctggagatcaagctctacttcatcttccagaactacaaggcggcgcggcgcggcgcggcggaccccgtggcgcgcaaggcgctgacgctgctgctgtctgtgtgtgtgcccggcctgttcctgctgctcgtggcgctggaccgcatggagtacgtgcgcaccttccgcaagcgcgaggacctgcgcggccgcctgttttgggtggcgctggacctgctggacctgctggacatgcaggccagcctgtgggagccgccgcgctccgggctgccgctgtgggccgagggcctcaccttcttctactgctacatgctgctgctggtgctgccgtgcgtggcgctcagcgaggtcagcatgcagggcgagcacatagcgccgcagaagatgatgctgtacccggtgctcagcctcgccaccgtcaatgtggtggccgtgctggcgcgcgccgccaacatggcgctgttccgggacagccgtgtctcggccatcttcgtcggcaaaaacgtggtggcgctcgccaccaaggcctgcaccttcctggagtaccgccgccaggtgcgcgacttcccgccgcctgcgctatcactggagctgcagccgccacccccgcagcgcaactcggtgccgccgccgccgccgccgctgcacggcccgcctgggcgcccccacatgtcctcgcccacgcgtgaccccctggacacgtgacagggcccgcgcggcccccgacacgcccctggggcgcagagacaccgggttggcttggggcgcgcggtttgcatgggatggggtgggggcgggctcccctagggacaggtgcctcgagtgcccgtgcctggggtcccgcggccgcttcttcatctcaggaatctctcggaccgcggatcctcagcccccgctccaccagcccgccccagcgcgtgggtctgtttgggaggcctgggccggagcagagcagaggtgatccggcccctgcctgctgggccgcccgggttggaagggagggcagtgtgggcggagatctgctccttcggtgggggcctctggctcagatttggggccaaggaggcctctgtcattttaaagactcgtgtttacagttttgtatccaaggcc

SEQ ID NO: 7214 - DNA, 1850 bp, Homo sapiens
catttgagggagaatgagcacggggcttttggaggctgcagcctagggccaagggatggaggaatgcctcagcccagcagaaggagcagtgccacgtcagccaatcggctcaggccctgccctggaaacgacacctgttcatcctcctcccggcaggctcacctgagtgcaggttaggcaggtgaagtgtctccccggaaaccaagctagagtgccccacctgctcggccctgccttctcggatcggatccagcacatccaggcttctcctcctcccgaggaaccagtggtgacagctgaggccatgtgagtaggatcctgaatgaggctttatctctggctgttcgtcccatcgtccaccgtggcaccagctccctcagccagccgggatgggaccagcgactgagagagccagaggcagagaggtgagggtgaccatatcctggactgtgagaggaatgggactctgggcctgtagctgccaagcaggtggcaggtgctccaggctgtgatctgaaccctctgacccctgacattgacctcctaccctgacccctgcctgaccaagccatgtctgaacaggaggctcaagccccagggggccgggggctgcccccggacatgctggcagagcaggtggagctgtggtggtcccagcagccgcggcgctcggcgctctgcttcgtcgtggccgtgggcctcgtggcaggctgtggcgcgggcggcgtggcactgctgtcaaccaccagcagccgctcaggtgaatggcggctagcaacgggcactgtgctctgtttgctggctctgctggttctggtgaaacagctgatgagctcggctgtgcaggacatgaactgcatccgccaggcccaccatgtggccctgctgcgcagtggtggaggggccgacgccctcgtggtgctgctcagtggcctcgtgctgctggtcaccggcctgaccctggccgggctggccgccgcccctgcccctgctcggccgctggccgccatgctgtctgtgggcattgctctggctgccttgggctcgcttttgctgctgggcctgctgctgtatcaagtgggtgtgagcggacactgcccctccatctgtatggccactccctccacccacagtggccatggcggccatggcagcatcttcagcatctcaggacagttgtctgctggccggcgtcacgagaccacatccagcattgccagcctcatctgacggagccagagccgtccttcttctcacagcggcctcagcgtccccagagccgagccagggtgtgagtgcatgtgaacgttgagtacacatgagtgcgtgtatgcccccaggctgggtcagctcttctgtggattgcatggcgtgtgattaaaagcccatgtgttcccacacatccacatcatgggaaggttaatgtgtgcctccttggaactgggtgttggtgtccatggaacttcctctctgtatctcaggtcagtaggcgcagaaacgcctcatgatgaagattcttgagccccatttccaagacccctcacatccaatcctgtcctgtaacatccatcaaggatttccataggggtgactggtgcccacccaagactgcaccagtgcctgctcattgaggagagtaactgctggccaggcagaaagaatatgggctctgcaatgagacagacctggaggggactctcccgttgagcactagcagctggaggagttgggagttcatggctatcatggttgtgttaatcgattgtggggatgaaatgtcattgtgtatggaaggcggggctcatggctgattggcaataaaatggcggctgccgttgtcattgtctcca

SEQ ID NO: 7215 - DNA, 1786 bp, Homo sapiens
gcttccccagtaggatccagtctgtggggctcatttgagggagaatgagcacggggcttttggaggctgcagcctagggccaagggatggaggctcacctgagtgcaggttaggcaggtgaagtgtctccccggaaaccaagctagagtgccccacctgctcggccctgccttctcggatcggatccagcacatccaggcttctcctcctcccgaggaaccagtggtgacagctgaggccatgtgagtaggatcctgaatgaggctttatctctggctgttcgtcccatcgtccaccgtggcaccagctccctcagccagccgggatgggaccagcgactgagagagccagaggcagagaggtgagggtgaccatatcctggactgtgagaggaatgggactctgggcctgtagctgccaagcaggtggcaggtgctccaggctgtgatctgaaccctctgacccctgacattgacctcctaccctgacccctgcctgaccaagccatgtctgaacaggaggctcaagccccagggggccgggggctgcccccggacatgctggcagagcaggtggagctgtggtggtcccagcagccgcggcgctcggcgctctgcttcgtcgtggccgtgggcctcgtggcaggctgtggcgcgggcggcgtggcactgctgtcaaccaccagcagccgctcaggtgaatggcggctagcaacgggcactgtgctctgtttgctggctctgctggttctggtgaaacagctgatgagctcggctgtgcaggacatgaactgcatccgccaggcccaccatgtggccctgctgcgcagtggtggaggggccgacgccctcgtggtgctgctcagtggcctcgtgctgctggtcaccggcctgaccctggccgggctggccgccgcccctgcccctgctcggccgctggccgccatgctgtctgtgggcattgctctggctgccttgggctcgcttttgctgctgggcctgctgctgtatcaagtgggtgtgagcggacactgcccctccatctgtatggccactccctccacccacagtggccatggcggccatggcagcatcttcagcatctcaggacagttgtctgctggccggcgtcacgagaccacatccagcattgccagcctcatctgacggagccagagccgtccttcttctcacagcggcctcagcgtccccagagccgagccagggtgtgagtgcatgtgaacgttgagtacacatgagtgcgtgtatgcccccaggctgggtcagctcttctgtggattgcatggcgtgtgattaaaagcccatgtgttcccacacatccacatcatgggaaggttaatgtgtgcctccttggaactgggtgttggtgtccatggaacttcctctctgtatctcaggtcagtaggcgcagaaacgcctcatgatgaagattcttgagccccatttccaagacccctcacatccaatcctgtcctgtaacatccatcaaggatttccataggggtgactggtgcccacccaagactgcaccagtgcctgctcattgaggagagtaactgctggccaggcagaaagaatatgggctctgcaatgagacagacctggaggggactctcccgttgagcactagcagctggaggagttgggagttcatggctatcatggttgtgttaatcgattgtggggatgaaatgtcattgtgtatggaaggcggggctcatggctgattggcaataaaatggcggctgccgttgtcattgtctcca

SEQ ID NO: 7216 - DNA, 567 bp, Homo sapiens
ggaatgctgggactgactccacggccacgcccacctcccccacttccttgagagcatcggcaccagcccccgcccacctcgggggtaggggtcagcctctgcagaggagtctccgggaggacagatacctcgtcaggatgtaacctgtgcacggccacatagtaatattcccagaatgacccaggacctacgtcttctgccctgtcctgccttggagggctcctcccgaggaaccagtggtgacagctgaggccatgtgagtaggatcctgaatgaggctttatctctggctgttcgtcccatcgtccaccgtggcaccagctccctcagccagccgggatgggaccagcgactgagagagccagaggcagagaggtgagggtgaccatatcctggactgtgagaggaatgggactctgggcctgtagctgccaagcaggtggcaggtgctccaggctgtgatctgaaccctctgacccctgacattgacctcctaccctgacccctgcctgaccaagccatgtctgaacaggaggctcaagccccagggggccgggggctgccccc

SEQ ID NO: 7217 - DNA, 989 bp, Homo sapiens
ggcaagtcacatgagccaccaaaatggtggtgttcgggtatgaggctgggactaagccaagggattcaggtgtggtgccggtgggaactgaggaagcgcccaaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaa

SEQ ID NO: 7218 - DNA, 1114 bp, Homo sapiens
tcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacagcaacagtatcagttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtc

SEQ ID NO: 7219 - DNA, 1273 bp, Homo sapiens
accaaaatggtggtgttcgggtatgaggctgggactaagccaagggattcaggtgtggtgccggtgggaactgaggaagcgcccaaggttttcaagatggcagcatctatgcatggtcagcccagtccttctctagaagatgcaaaactcagaagaccaatggtcatagaaatcatagaaaaaaattttgactatcttagaaaagaaatgacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtaagttcttccttttccttcttttttcttttcttttcttttcttttttttttttttttttaggttaataaactctctttcttctttagctgtctatgatatatttgaatcaaaatgtggtagtttggtatttcagatagctaacttttaacttttttgctctctacattatagatctagaaaggcaattatcaatttaggagaagtcaacaaacttctaatagcattcatatccaggagaggtgattaactcttttttctttttaggtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaataaaagtttcatctttcctctttgtatgtggaaa

SEQ ID NO: 7220 - DNA, 853 bp, Homo sapiens
caaaatggtggtgttcgggtatgaggctgggactaagccaagggattcaggtgtggtgccggtgggaactgaggaagcgcccaaggacacaaaatatatatcaaatggcgacatttggaacaacagctggtttctctggaatattctcaaacttcctgttcagacgctgcttcaaggttaaacatgatgctttgaagacatatgcatcattggctacacttccatttttgtctactgttgttactgacaagctttttgtaattgatgctttgtattcagataatataagcaaggaaaactgtgttttcagaagctcactgattggcatagtttgtggtgttttctatcccagttctttggcttttactaaaaatggacgcctggcaaccaagtatcataccgttccactgccaccaaaaggaagggttttaatccattggatgacgctttgtcaaacacaaatgaaattaatggcgattcctctagtctttcagattatgtttggaatattaaatggtctataccattatgcagtatttgaagagacacttgagaaaactatacatgaagagtaaccaaaaaaatgaatggttgctaacttagcaaaatgaagtttctataaagaggactcaggcattgctgaaagagttaaaagtaactgtgaacaaataatttgttctgtgccttttgcctggtatatagcaaatactcaaaaagtattcaataattcaatcaataaatataagtttcatcttacacgtaagatacaggtcttatctcctgatggtgtgtccattttgcctggtatataacagataataaatatccagtgtcaataaatgtaacaataaaa

SEQ ID NO: 7221 - DNA, 1737 bp, Homo sapiens
cggtaccaagatggactcctcgcgggcccggcagcagctccggcggcgattcctcctcctgccggacgccgaggcccagctggaccgcgagggtgacgccgggccgggtgaggcgcgcaccaagccgccccgaggttctcagaggcgaggcgtcggaaaacggccggcctccggcagccctggcccagtctggaaggactgagtttcggctttgcaagtcgaatatttaatgtcagggaagatccttagaatcgcggagtgctgtgcatcgtcatttcagctgcgcttcagaattctctggagagctgatttgacacctatttggaaatagcgattaaaattaaaaatacccaccagttttaagtcttaaggatttaccagaaacatgcgtgtaccgcagtgtacaatgatgtgcgcagtgtttcacttcaggattgcttgtaatagcgaattactggaaatatctgccttgcccgtcagcagaaagctgtttaagtaaatttgggtatatgtatacctgacacatcaggtcgactcgtatgtaccaatggggatgattttcaaagggaagtgtggaacactatggtatgccgccatttgggtacaaaacagaaacctccacagctgttgagaaaaaggagaaacctcttccaagacttaatatccattctggattctggattttggcatccattgttgtgacctattatgttgacttctttaaaacccttaaagaaaacttccacactagcagctggtttctctgtggcagtgccttgttgcttgtcagtttatcaattgcattttactgcatagtctacctggaatggtattgtggaattggagaatatgatgtcaagtatccagccttgatacccattaccactgcctcctttattgcagcaggaatttgcttcaacattgctttatggcatgtgtggtcgtttttcactccattgttgttgtttacccagtttatgggggttgtcatgtttatcacactccttggatgatttccgaagagacagggtcttctatgttgcccaggctgtctttgaactcctgggatcaagtgatcctcctgcctcagccttcgaagtagttgggactacaggcccacgccaccgtgcctggctggacatgtaaatttgaagtgaatggttaaacatccagctagctgaaagcatggcagaccctaacagaaaagctacagtgtgtttttgcagctatgaagtgaatggtttcctggggaaaattgtgactttgtataactgttgttgaaaccagaataaattatatttcacttgcatatgcataaattattaaaattttcagaagtcagtgatacagaagtactattttgcaatgttaatctgtttgagtctttggagaaagtggtttcattgtaggtacatagtgcactgttaatattttaaacaagtagttcactcttccatttaagggatagcagttccttgtataaaatgactggatgtgtataaaggaattatgttgtcatgtgcctttaaccagctttagtaattactataatctcatatttatgatagttttgttaggtgacaggaccaaatgaaaatattttatgttttctcatcactttagattttatcattatgtacattactgggtttttagcatttcctaatgtgaagttttaatcacttttaagtatacatttttttctgtatcatttaaataaaatatttttataacttt

SEQ ID NO: 7222 - DNA, 1221 bp, Homo sapiens
cggtaccaagatggactcctcgcgggcccggcagcagctccggcggcgattcctcctcctgccggacgccgaggcccagctggaccgcgagggtgacgccgggccggaaacctccacagctgttgagaaaaaggagaaacctcttccaagacttaatatccattctggattctggattttggcatccattgttgtgacctattatgttgacttctttaaaacccttaaagaaaacttccacactagcagctggtttctctgtggcagtgccttgttgcttgtcagtttatcaattgcattttactgcatagtctacctggaatggtattgtggaattggagaatatgatgtcaagtatccagccttgatacccattaccactgcctcctttattgcagcaggaatttgcttcaacattgctttatggcatgtgtggtcgtttttcactccattgttgttgtttacccagtttatgggggttgtcatgtttatcacactccttggatgatttccgaagagacagggtcttctatgttgcccaggctgtctttgaactcctgggatcaagtgatcctcctgcctcagccttcgaagtagttgggactacaggcccacgccaccgtgcctggctggacatgtaaatttgaagtgaatggttaaacatccagctagctgaaagcatggcagaccctaacagaaaagctacagtgtgtttttgcagctatgaagtgaatggtttcctggggaaaattgtgactttgtataactgttgttgaaaccagaataaattatatttcacttgcatatgcataaattattaaaattttcagaagtcagtgatacagaagtactattttgcaatgttaatctgtttgagtctttggagaaagtggtttcattgtaggtacatagtgcactgttaatattttaaacaagtagttcactcttccatttaagggatagcagttccttgtataaaatgactggatgtgtataaaggaattatgttgtcatgtgcctttaaccagctttagtaattactataatctcatatttatgatagttttgttaggtgacaggaccaaatgaaaatattttatgttttctcatcactttagattttatcattatgtacattactgggtttttagcatttcctaatgtgaagttttaatcacttttaagtatacatttttttctgtatcatttaaataaaatatt

SEQ ID NO: 7223 - DNA, 1079 bp, Homo sapiens
gcatttcggggcggtaccaagatggactcctcgcgggcccggcagcagctccggcggcgattcctcctcctgccggacgccgaggcccagctggaccgcgagggtgacgccgggccggaaacctccacagctgttgagaaaaaggagaaacctcttccaagacttaatatccattctggattctggattttggcatccattgttgtgacctattatgttgacttctttaaaacccttaaagaaaacttccacactagcagctggtttctctgtggcagtgccttgttgcttgtcagtttatcaattgcattttactgcatagtctacctggaatggtattgtggaattggagaatatgatgtcaagtatccagccttgatacccattaccactgcctcctttattgcagcaggaatttgatcaccccatcctgagatctgctgccttacacagtggaggctgttttctgagtgtcggataactctgttattaaataagtgtatattgagaatactcactccagatgcttaggggcatggtgagaaggacaaagatagtgcctcctgtcaggtcacttacatcagaacttgcaggaaacctgctttatacagcagttgacaggtgtggaaactgaagctcatggaaataaaagttaatacgctaaattttcaaggagttaatgaaaactgacatttctgctaaaaacagcatgttctccctgtgggattttaaaggaaggtcagtggtaactgtgtaaagaagaaatggacatactctcattgttagcagtctgaaaatagttgctagcacctccatgcccacgccaatgtctccagcctccttcaggcaccttgctgtgtcttgggaccactgggaaccctcacaggaggcccttcattcctgtacacctgtggtgccacaagcggctttgggcccggaggaatcctacacatctcagaacacttcctcacctgaccctgtcacccatctccccttctcgtgttctcagccccttctttgactcttgaattttgagtttttacagatgtttgggagctcttactctgacatgaagttat

SEQ ID NO: 7224 - DNA, 948 bp, Homo sapiens
cggggcggtaccaagatggactcctcgcgggcccggcagcagctccggcggcgattcctcctcctgccggacgccgaggcccagctggaccgcgagggtgacgccgggccggaaacctccacagctgttgagaaaaaggagaaacctcttccaagacttaatatccattctggattctggattttggcatccattgttgtgacctattatgttgacttctttaaaacccttaaagaaaacttccacactagcagctggtttctctgtggcagtgccttgttgcttgtcagtttatcaattgcattttactgcatagtctacctggaatggtattgtggaattggagaatatgatgtcaagtatccagccttgatacccattaccactgcctcctttattgcagcaggaatttgcttcaacattgctttatggcatgtgtggtcgtttttcactccattgttgttgtttacccagtttatgggggttgtcatgtttatcacactccttggatgatttccgaagatcaccccatcctgagatctgctgccttacacagtggaggctgttttctgagtgtcggataactctgttattaaataagtgtatattgagaatactcactccagatgcttaggggcatggtgagaaggacaaagatagtgcctcctgtcaggtcacttacatcagaacttgcaggaaacctgctttatacagcagttgacaggtgtggaaactgaagctcatggaaataaaagttaatacgctaaattttcaaggagttaatgaaaactgacatttctgctaaaaacagcatgttctccctgtgggattttaaaggaaggtcagtggtaactgtgtaaagaagaaatggacatactctcattgttagcagtctgaaaatagttgctagcacctccatgcccacgccaatgtctccagcctccttca

SEQ ID NO: 7225 - DNA, 2810 bp, Homo sapiens
gccagggtgtctgaagctgagaccccgggctcgcagtcgccccatgaatttcgagttccgcaactgacgctactgggcggggcttcatggccagggcctcgctcaggcctaagtttccccacctgtgctcaatgcacaggtgcggtgccgcctccagggccggccgagaagagaggccgcacccgcacggggactgcatctcccagagcgccccgcgagcggccgagcggcgggactccatgccctagagtgccccgcgggcggccgggcggcgggactccatgtcctagagtgccccgcgggcggccgggcggcgggactccatgtcctagagtgccccgcgggcggccgggcggcgggactccatgtcctagagtgccccgcgggcggccgggcggcggccgccgcaaccgacaggtccgggactgggcgctgcggcctcgtccgcgcgccggggcgggggcctagctcgacagcttcccggcggctgcgcgatggacagccccgaggtgaccttcactctcgcctatctggtgttcgccgtgtgcttcgtgttcacgcccaacgagttccacgcggcggggctcacggtgcagaacctgctgtcgggctggctgggcagcgaggacgccgccttcgtgcccttccacttgcgccgcacggccgccacgctgttgtgccactcgctgctgccgctcggctactatgtgggcatgtgccttgcggcttcagaaaagcggctccacgccctcagccaggcccctgaggcctggcggctcttcctgctgctggccgtgaccctcccctccatcgcctgcatcctgatctactactggtcccgtgaccggtgggcctgccacccactggcgcgcaccctggccctctacgccctcccacagtctggctggcaggctgttgcctcctctgtcaacactgagttccggcggattgacaagtttgccaccggtgcaccaggtgcccgtgtgattgtgacagacacgtgggtgatgaaggtaaccacctaccgagtgcacgtggcccagcagcaggacgtgcacctgactgtgacggagtctcggcagcatgagctctcgccagactcgaacttgcccgtgcagctcctcaccatccgtgtggccagcaccaaccctgctgtgcaggcctttgacatctggctgaactccactgagtacggggagctctgcgagaagctccgggcacccatccgcagggcagcccatgtggtcatccaccagagcctgggcgacctgttcctggagacatttgcctccctggtagaggtcaacccggcctactcagtgcccagcagccaggagctggaggcctgcataggctgcatgcagacacgtgccagcgtgaagctggtgaagacctgccaggaggcagccacaggcgagtgccagcagtgttactgccgccccatgtggtgcctcacctgcatgggcaagtggttcgccagccgccaggaccccctgcgccctgacacctggctggccagccgcgtgccctgccccacctgccgcgcacgcttctgcatcctggatgtgtgcaccgtgcgctgagtgggctggggccttgaggtgactctgtgtctccccccaaagccacagggcagggaagggggtggctgggcctcctggctggcaaagggctctacttaaagcacatgatgtagagcaactcgcctctgccctgggtctgcagaaggctgaggacttttggttaaaagcaatcctcatgaaaacaccccaccctgcttggcagccagggtacaagtcctgggcacctcctctttgcctccctcctgcccctttcctgctggtgggggcagatcctgcacacacagacacagcgtctgcccccgagccattccctggagaccctgggtctaccccaggtggtcgtcatctgggccatttgccttacttctctggagcatacccaccctcagttacgtgccagacctggaccgcattctcctgccctgtcctggagctggcccctggctgcctggaggaccctgggtaggtcctgagggtgggatggagaagagggcactgctgtggtgtgggagcagtcctggggcttcctggtggctgtgaccagttgaggggctgttcctgggtggggtggcaatgggaggacaggtcagagcgccctcatttgtggggctgcccctccgggtttctcatcctgtccttggtgcctttttctgcccaacaagtccagggaaggccgaggtctcagactcctgggtaggggtgggggtttgagttgaggaccaaagtgccatagcgacatccagaacacaagcccaccaggggtccagcccaggctacccactcccctagggtctcccaggctcagaaggggatgcacgccccctgtggtcaagcctctggtgggcgtcttgcccagttcctgatggttcaaggggaggggggatgttggccaggccccagggcacagccctgacacaggtgtggctactggaggggccttcatacctgcggccccaaagcccctgggcttggctgtttgaggcagaggtgatggactccgggggcctgacacttgggatttgggaggcttcctagagcgctcagcaggtgaaggcagcaggggccatggccgggagccaggcctagctttgaactgagtttcaagggctgccaaagaggggcagtgggttggggttgtttttactacaaaataagttacttagttttataaagacaaaccgattgtagccaaatgacaccatatttaataaaatttagtctgaagtg

SEQ ID NO: 7226 - DNA, 2172 bp, Homo sapiens
gccagggtgtctgaagctgagaccccgggctcgcagtcgccccatgaatttcgagttccgcaactgacgctactgggcggggcttcatggccagggcctcgctcaggcctaagtttccccacctgtgctcaatgcacaggtgcggtgccgcctccagggccggccgagaagagaggccgcacccgcacggggactgcatctcccagagcgccccgcgagcggccgagcggcgggactccatgccctagagtgccccgcgggcggccgggcggcgggactccatgtcctagagtgccccgcgggcggccgggcggcggccgccgcaaccgacaggtccgggactgggcgctgcggcctcgtccgcgcgccggggcgggggcctagctcgacagcttcccggcggctgcgcgatggacagccccgaggtgaccttcactctcgcctatctggtgttcgccgtgtgcttcgtgttcacgcccaacgagttccacgcggcggggctcacggtgcagaacctgctgtcgggctggctgggcagcgaggacgccgccttcgtgcccttccacttgcgccgcacggccgccacgctgttgtgccactcgctgctgccgctcggctactatgtgggcatgtgccttgcggcttcagaaaagcggctccacgccctcagccaggcccctgaggcctggcggctcttcctgctgctggccgtgaccctcccctccatcgcctgcatcctgatctactactggtcccgtgaccggtgggcctgccacccactggcgcgcaccctggccctctacgccctcccacagtctggctggcaggctgttgcctcctctgtcaacactgagttccggcggattgacaagtttgccaccggtgcaccaggtgcccgtgtgattgtgacagacacgtgggtgatgaaggtaaccacctaccgagtgcacgtggcccagcagcaggacgtgcacctgactgtgacggagtctcggcagcatgagctctcgccagactcgaacttgcccgtgcagctcctcaccatccgtgtggccagcaccaaccctgctgtgcaggcctttgacatctggctgaactccactgagtacggggagctctgcgagaagctccgggcacccatccgcagggcagcccatgtggtcatccaccagagcctgggcgacctgttcctggagacatttgcctccctggtagaggtcaacccggcctactcagtgcccagcagccaggagctggaggcctgcataggctgcatgcagacacgtgccagcgtgaagctggtgaagacctgccaggaggcagccacaggcgagtgccagcagtgttactgccgccccatgtggtgcctcacctgcatgggcaagtggttcgccagccgccaggaccccctgcgccctgacacctggctggccagccgcgtgccctgccccacctgccgcgcacgcttctgcatcctggatgtgtgcaccgtgcgctgagtgggctggggccttgaggtgactctgtgtctccccccaaagccacagggcagggaagggggtggctgggcctcctggctggcaaagggctctacttaaagcacatgatgtagagcaactcgcctctgccctgggtctgcagaaggctgaggacttttggttaaaagcaatcctcatgaaaacaccccaccctgcttggcagccagggtacaagtcctgggcacctcctctttgcctccctcctgcccctttcctgctggtgggggcagatcctgcacacacagacacagcgtctgcccccgagccattccctggagaccctgggtctaccccaggtggtcgtcatctgggccatttgccttacttctctggagcatacccaccctcagttacgtgccagacctggaccgcattctcctgccctgtcctggagctggcccctggctgcctggaggaccctgggtaggtcctgagggtgggatggagaagagggcactgctgtggtgtgggagcagtcctggggcttcctggtggctgtgaccagttgaggggctgttcctgggtggggtggcaatgggaggacaggtcagagcgccctcatttgtggggctgcccctccgggtttctcatcctgtccttggtgcctttttctgcccaacaagtccagggaagg

SEQ ID NO: 7227 - DNA, 2678 bp, Homo sapiens
cggttccgtttccggagtggagggcacgccagggtgtctgaagctgagaccccgggctcgcagtcgccccatgaatttcgagttccgcaactgacgctactgggcggggcttcatggccagggcctcgctcaggcctaagtttccccacctgtgctcaatgcacaggtgcggtgccgcctccagggccggccgagaagagaggccgcacccgcacggggactgcatctcccagagcgccccgcgagcggccgagcggcgggactccatgccctagagtgccccgcgggcggccgggcggcgggactccatgtcctagagtgccccgcgggcggccgggcggcgggactccatgtcctagagtgccccgcgggcggccgggcggcgggactccatgtcctagagtgccccgcgggcggccgggcggcggccgccgcaaccgacaggtccgggactgggcgctgcggcctcgtccgcgcgccggggcgggggcctagctcgacagcttcccggcggctgcgcgatggacagccccgaggtgaccttcactctcgcctatctggtgttcgccgtgtgcttcgtgttcacgcccaacgagttccacgcggcggggctcacggtgcagaacctgctgtcgggctggctgggcagcgaggacgccgccttcgtgcccttccacttgcgccgcacggccgccacgctgttgtgccactcgctgctgccgctcggctactatgtgggcatgtgccttgcggcttcagaaaagcggctccacgccctcagccaggcccctgaggcctggcggctcttcctgctgctggccgtgaccctcccctccatcgcctgcatcctgatctactactggtcccgtgaccggtgggcctgccacccactggcgcgcaccctggccctctacgccctcccacagtctggctggcaggctgttgcctcctctgtcaacactgagttccggcggattgacaagtttgccaccggtgcaccaggtgcccgtgtgattgtgacagacacgtgggtgatgaaggtaaccacctaccgagtgcacgtggcccagcagcaggacgtgcacctgactgtgacggagtctcggcagcatgagctctcgccagactcgaacttgcccgtgcagctcctcaccatccgtgtggccagcaccaaccctgctgtgcaggcctttgacatctggagctggaggcctgcataggctgcatgcagacacgtgccagcgtgaagctggtgaagacctgccaggaggcagccacaggcgagtgccagcagtgttactgccgccccatgtggtgcctcacctgcatgggcaagtggttcgccagccgccaggaccccctgcgccctgacacctggctggccagccgcgtgccctgccccacctgccgcgcacgcttctgcatcctggatgtgtgcaccgtgcgctgagtgggctggggccttgaggtgactctgtgtctccccccaaagccacagggcagggaagggggtggctgggcctcctggctggcaaagggctctacttaaagcacatgatgtagagcaactcgcctctgccctgggtctgcagaaggctgaggacttttggttaaaagcaatcctcatgaaaacaccccaccctgcttggcagccagggtacaagtcctgggcacctcctctttgcctccctcctgcccctttcctgctggtgggggcagatcctgcacacacagacacagcgtctgcccccgagccattccctggagaccctgggtctaccccaggtggtcgtcatctgggccatttgccttacttctctggagcatacccaccctcagttacgtgccagacctggaccgcattctcctgccctgtcctggagctggcccctggctgcctggaggaccctgggtaggtcctgagggtgggatggagaagagggcactgctgtggtgtgggagcagtcctggggcttcctggtggctgtgaccagttgaggggctgttcctgggtggggtggcaatgggaggacaggtcagagcgccctcatttgtggggctgcccctccgggtttctcatcctgtccttggtgcctttttctgcccaacaagtccagggaaggccgaggtctcagactcctgggtaggggtgggggtttgagttgaggaccaaagtgccatagcgacatccagaacacaagcccaccaggggtccagcccaggctacccactcccctagggtctcccaggctcagaaggggatgcacgccccctgtggtcaagcctctggtgggcgtcttgcccagttcctgatggttcaaggggaggggggatgttggccaggccccagggcacagccctgacacaggtgtggctactggaggggccttcatacctgcggccccaaagcccctgggcttggctgtttgaggcagaggtgatggactccgggggcctgacacttgggatttgggaggcttcctagagcgctcagcaggtgaaggcagcaggggccatggccgggagccaggcctagctttgaactgagtttcaagggctgccaaagaggggcagtgggttggggttgtttttactacaaaataagttacttagttttataaagacaaaccgattgtagccaaatgacaccatatttaataaaatttagtctgaagtga

SEQ ID NO: 7228 - DNA, 3015 bp, Homo sapiens
ggcggcggcggcgcgcagcgacagagcgtcccccggcgaggacgagcgagcacggcgcccgcacctccccgcaccgcccgcgctgcgcgcccggaggagcgaccgccgcagttctcgagctccagctgcattccctccgcgtccgccccacgcttctcccgctccgggccccgcaatggcccaggcagtgtggtcgcgcctcggccgcatcctctggcttgcctgcctcctgccctgggccccggcaggggtggccgcaggcctgtatgaactcaatctcaccaccgatagccctgccaccacgggagcggtggtgaccatctcggccagcctggtggccaaggacaacggcagcctggccctgcccgctgacgcccacctctaccgcttccactggatccacaccccgctggtgcttactggcaagatggagaagggtctcagctccaccatccgtgtggtcggccacgtgcccggggaattcccggtctctgtctgggtcactgccgctgactgctggatgtgccagcctgtggccaggggctttgtggtcctccccatcacagagttcctcgtgggggaccttgttgtcacccagaacacttccctaccctggcccagctcctatctcactaagaccgtcctgaaagtctccttcctcctccacgacccgagcaacttcctcaagaccgccttgtttctctacagctgggacttcggggacgggacccagatggtgactgaagactccgtggtctattataactattccatcatcgggaccttcaccgtgaagctcaaagtggtggcggagtgggaagaggtggagccggatgccacgagggctgtgaagcagaagaccggggacttctccgcctcgctgaagctgcaggaaacccttcgaggcatccaagtgttggggcccaccctaattcagaccttccaaaagatgaccgtgaccttgaacttcctggggagccctcctctgactgtgtgctggcgtctcaagcctgagtgcctcccgctggaggaaggggagtgccaccctgtgtccgtggccagcacagcgtacaacctgacccacaccttcagggaccctggggactactgcttcagcatccgggccgagaatatcatcagcaagacacatcagtaccacaagatccaggtgtggccctccagaatccagccggctgtctttgctttcccatgtgctacacttatcactgtgatgttggccttcatcatgtacatgaccctgcggaatgccactcagcaaaaggacatggtggagaacccggagccaccctctggggtcaggtgctgctgccagatgtgctgtgggcctttcttgctggagactccatctgagtacctggaaattgttcgtgagaaccacgggctgctcccgcccctctataagtctgtcaaaacttacaccgtgtgagcactccccctccccaccccatctcagtgttaactgactgctgacttggagtttccagcagggtggtgtgcaccactgaccaggaggggttcatttgcgtggggctgttggcctggatcatccatccatctgtacagttcagccactgccacaagcccctccctctctgtcacccctgaccccagccattcacccatctgtacagtccagccactgacataagccccactcggttaccacccccttgaccccctacctttgaagaggcttcgtgcaggactttgatgcttggggtgttccgtgttgactcccaggtgggcctggctgcccactgcccattcctctcatattggcacatctgctgtccattgggggttctcagtttcctcccccagacagccctacctgtgccagagagctagaaagaaggtcataaagggttaaaaatccataactaaaggttgtacacatagatgggcacactcacagagagaagtgtgcatgtacacacaccacacacacacacacacacacacacacacacacacacagaaatataaacacatgcgtcacatgggcatttcagatgatcagctctgtatctggttaagtcggttgctgggatgcaccctgcactagagctgaaaggaaatttgacctccaagcagccctgacaggttctgggcccgggccctccctttgtgctttgtctctgcagttcttgcgccctttataaggccatcctagtccctgctggctggcagggggctggatggggggcaggactaatactgagtgattgcagagtgctttataaatatcaccttattttatcgaaacccatctgtgaaactttcactgaggaaaaggccttgcagcggtagaagaggttgagtcaaggccgggcgcggtggctcacgcctgtaatcccagcactttgggaggccgaggcgggtggatcacgagatcaggagatcgagaccaccctggctaacacggtgaaaccccgtctctactaaaaaaatacaaaaagttagccgggcgtggtggtgggtgcctgtagtcccagctactcgggaggctgaggcaggagaatggtgcgaacccgggaggcggagcttgcagtgagcccagatggcgccactgcactccagcctgagtgacagagcgagactctgtctccaaaaaaaaaaaaagaagaggttgagtcagcagggacttgggttccctgtgtgtgaggggggcattcttgcctgccagctgctcccgaggtggccttgagaaggaagaagcaggatgacagagcctgagcagcggaaccagcctgcaccctcccttctggcccagcgacctgggctgtggctgagacaataatgaggccagaagtagccggagcctgtcaggaagggcaggggaggactgtggggtctgggctctgtcgctgtaaccatctgctcccaggctgtgtgcagaaaatggcatttacactattgtgcagctcattctcatgaaatactgccattgttgctaaataaagcttgtgtgctctgaatatagccaagcataga

SEQ ID NO: 7229 - DNA, 2261 bp, Homo sapiens
gcgctgcgcgcccggaggagcgaccgccgcagttctcgagctccagctgcattccctccgcgtccgccccacgcttctcccgctccgggccccgcaatggcccaggcagtgtggtcgcgcctcggccgcatcctctggcttgcctgcctcctgccctgggccccggcaggggtggccgcagagttcctcgtgggggaccttgttgtcacccagaacacttccctaccctggcccagctcctatctcactaagaccgtcctgaaagtctccttcctcctccacgacccgagcaacttcctcaagaccgccttgtttctctacagctgggacttcggggacgggacccagatggtgactgaagactccgtggtctattataactattccatcatcgggaccttcaccgtgaagctcaaagtggtggcggagtgggaagaggtggagccggatgccacgagggctgtgaagcagaagaccggggacttctccgcctcgctgaagctgcaggaaacccttcgaggcatccaagtgttggggcccaccctaattcagaccttccaaaagatgaccgtgaccttgaacttcctggggagccctcctctgactgtgtgctggcgtctcaagcctgagtgcctcccgctggaggaaggggagtgccaccctgtgtccgtggccagcacagcgtacaacctgacccacaccttcagggaccctggggactactgcttcagcatccgggccgagaatatcatcagcaagacacatcagtaccacaagatccaggtgtggccctccagaatccagccggctgtctttgctttcccatgtgctacacttatcactgtgatgttggccttcatcatgtacatgaccctgcggaatgccactcagcaaaaggacatggtggagaacccggagccaccctctggggtcaggtgctgctgccagatgtgctgtgggcctttcttgctggagactccatctgagtacctggaaattgttcgtgagaaccacgggctgctcccgcccctctataagtctgtcaaaacttacaccgtgtgagcactccccctccccaccccatctcagtgttaactgactgctgacttggagtttccagcagggtggtgtgcaccactgaccaggaggggttcatttgcgtggggctgttggcctggatcatccatccatctgtacagttcagccactgccacaagcccctccctctctgtcacccctgaccccagccattcacccatctgtacagtccagccactgacataagccccactcggttaccacccccttgaccccctacctttgaagaggcttcgtgcaggactttgatgcttggggtgttccgtgttgactcccaggtgggcctggctgcccactgcccattcctctcatattggcacatctgctgtccattgggggttctcagtttcctcccccagacagccctacctgtgccagagagctagaaagaaggtcataaagggttaaaaatccataactaaaggttgtacacatagatgggcacactcacagagagaagtgtgcatgtacacacaccacacacacacacacacacacacacacacacacacacagaaatataaacacatgcgtcacatgggcatttcagatgatcagctctgtatctggttaagtcggttgctgggatgcaccctgcactagagctgaaaggaaatttgacctccaagcagccctgacaggttctgggcccgggccctccctttgtgctttgtctctgcagttcttgcgccctttataaggccatcctagtccctgctggctggcagggggctggatggggggcaggactaatactgagtgattgcagagtgctttataaatatcaccttattttatcgaaacccatctgtgaaactttcactgaggaaaaggccttgcagcggtagaagaggttgagtcaaggccgggcgcggtggctcacgcctgtaatcccagcactttgggaggccgaggcgggtggatcacgagatcaggagatcgagaccaccctggctaacacggtgaaaccccgtctctactaaaaaaatacaaaaagttagccgggcgtggtggtgggtgcctgtagtcccagctactcgggaggctgaggcaggagaatggtgcgaacccgggaggcggagcttgcagtgagcccagatggcgccactgcactccagcctgagtgacagagcgagactctgtctccaaaaaaaaaaaaagaa

SEQ ID NO: 7230 - DNA, 2881 bp, Homo sapiens
ccgcaatggcccaggcagtgtggtcgcgcctcggccgcatcctctggcttgcctgcctcctgccctgggccccggcaggggtggccgcaggcctgtatgaactcaatctcaccaccgatagccctgccaccacgggagcggtggtgaccatctcggccagcctggtggccaaggacaacggcagcctggccctgcccgctgacgcccacctctaccgcttccactggatccacaccccgctggtgcttactggcaagatggagaagggtctcagctccaccatccgtgtggtcggccacgtgcccggggaattcccggtctctgtctgggtcactgccgctgactgctggatgtgccagcctgtggccaggggctttgtggtcctccccatcacagagttcctcgtgggggaccttgttgtcacccagaacacttccctaccctggcccagctcctatctcactaagaccgtcctgaaagtctccttcctcctccacgacccgagcaacttcctcaagaccgccttgtttctctacagctgggacttcggggacgggacccagatggtgactgaagactccgtggtctattataactattccatcatcgggaccttcaccgtgaagctcaaagtggtggcggagtgggaagaggtggagccggatgccacgagggctgtgaagcagaagaccggggacttctccgcctcgctgaagctgcaggaaacccttcgaggcatccaagtgttggggcccaccctaattcagaccttccaaaagatgaccgtgaccttgaacttcctggggagccctcctctgactgtgtgctggcgtctcaagcctgagtgcctcccgctggaggaaggggagtgccaccctgtgtccgtggccagcacagcgtacaacctgacccacaccttcagggaccctggggactactgcttcagcatccgggccgagaatatcatcagcaagacacatcagtaccacaagatccaggtgtggccctccagaatccagccggctgtctttgctttcccatgtgctacacttatcactgtgatgttggccttcatcatgtacatgaccctgcggaatgccactcagcaaaaggacatggtggaggtggctgattttgacttttcccccatgtctgacaagaacccggagccaccctctggggtcaggtgctgctgccagatgtgctgtgggcctttcttgctggagactccatctgagtacctggaaattgttcgtgagaaccacgggctgctcccgcccctctataagtctgtcaaaacttacaccgtgtgagcactccccctccccaccccatctcagtgttaactgactgctgacttggagtttccagcagggtggtgtgcaccactgaccaggaggggttcatttgcgtggggctgttggcctggatcatccatccatctgtacagttcagccactgccacaagcccctccctctctgtcacccctgaccccagccattcacccatctgtacagtccagccactgacataagccccactcggttaccacccccttgaccccctacctttgaagaggcttcgtgcaggactttgatgcttggggtgttccgtgttgactcccaggtgggcctggctgcccactgcccattcctctcatattggcacatctgctgtccattgggggttctcagtttcctcccccagacagccctacctgtgccagagagctagaaagaaggtcataaagggttaaaaatccataactaaaggttgtacacatagatgggcacactcacagagagaagtgtgcatgtacacacaccacacacacacacacacacacacacacacacacacacagaaatataaacacatgcgtcacatgggcatttcagatgatcagctctgtatctggttaagtcggttgctgggatgcaccctgcactagagctgaaaggaaatttgacctccaagcagccctgacaggttctgggcccgggccctccctttgtgctttgtctctgcagttcttgcgccctttataaggccatcctagtccctgctggctggcagggggctggatggggggcaggactaatactgagtgattgcagagtgctttataaatatcaccttattttatcgaaacccatctgtgaaactttcactgaggaaaaggccttgcagcggtagaagaggttgagtcaaggccgggcgcggtggctcacgcctgtaatcccagcactttgggaggccgaggcgggtggatcacgagatcaggagatcgagaccaccctggctaacacggtgaaaccccgtctctactaaaaaaatacaaaaagttagccgggcgtggtggtgggtgcctgtagtcccagctactcgggaggctgaggcaggagaatggtgcgaacccgggaggcggagcttgcagtgagcccagatggcgccactgcactccagcctgagtgacagagcgagactctgtctccaaaaaaaaaaaaagaagaggttgagtcagcagggacttgggttccctgtgtgtgaggggggcattcttgcctgccagctgctcccgaggtggccttgagaaggaagaagcaggatgacagagcctgagcagcggaaccagcctgcaccctcccttctggcccagcgacctgggctgtggctgagacaataatgaggccagaagtagccggagcctgtcaggaagggcaggggaggactgtggggtctgggctctgtcgctgtaaccatctgctcccaggctgtgtgcagaaaatggcatttacactattgtgcagctcattctcatgaaatactgccattgttgctaaataaagcttgtgtgctctgaatatagccaagcataga

SEQ ID NO: 7231 - DNA, 1553 bp, Homo sapiens
agatgcgaatttagagcccaggaggccaggctgccatttcctctctggtggtgatttccaaaatggacccggagctgacaggttcctggggcctgtatgaactcaatctcaccaccgatagccctgccaccacgggagcggtggtgaccatctcggccagcctggtggccaaggacaacggcagcctggccctgcccgctgacgcccacctctaccgcttccactggatccacaccccgctggtgcttactggcaagatggagaagggtctcagctccaccatccgtgtggtcggccacgtgcccggggaattcccggtctctgtctgggtcactgccgctgactgctggatgtgccagcctgtggccaggggctttgtggtcctccccatcacagagttcctcgtgggggaccttgttgtcacccagaacacttccctaccctggcccagctcctatctcactaagaccgtcctgaaagtctccttcctcctccacgacccgagcaacttcctcaagaccgccttgtttctctacagctgggacttcggggacgggacccagatggtgactgaagactccgtggtctattataactattccatcatcgggaccttcaccgtgaagctcaaagtggtggcggagtgggaagaggtggagccggatgccacgagggctgtgaagcagaagaccggggacttctccgcctcgctgaagctgcaggaaacccttcgaggcatccaagtgttggggcccaccctaattcagaccttccaaaagatgaccgtgaccttgaacttcctggggagccctcctctgactgtgtgctggcgtctcaagcctgagtgcctcccgctggaggaaggggagtgccaccctgtgtccgtggccagcacagcgtacaacctgacccacaccttcagggaccctggggactactgcttcagcatccgggccgagaatatcatcagcaagacacatcagtaccacaagatccaggtgtggccctccagaatccagccggctgtctttgctttcccatgtgctacacttatcactgtgatgttggccttcatcatgtacatgaccctgcggaatgccactcagcaaaaggacatggtggagaacccggagccaccctctggggtcaggtgctgctgccagatgtgctgtgggcctttcttgctggagactccatctgagtacctggaaattgttcgtgagaaccacgggctgctcccgcccctctataagtctgtcaaaacttacaccgtgtgagcactccccctccccaccccatctcagtgttaactgactgctgacttggagtttccagcagggtggtgtgcaccactgaccaggaggggttcatttgcgtggggctgttggcctggatcatccatccatctgtacagttcagccactgccacaagcccctccctctctgtcacccctgaccccagccattcacccatctgtacagtccagccactgacataagccccactcggttaccacccccttgaccccctacctttgaagaggcttcgtgca

SEQ ID NO: 7232 - DNA, 6640 bp, Homo sapiens
ctccgctccgactgcttgtaggcgatgcccaggcaaagaccgtgactgacactctcgctcacacgcacgcacggacccaggcccacgctcggagatcgagccccgggctcgcaaccgttgtcgctcccggcgccgcggccagagcccggaccacggcttccgcgccgccgccgcctcgccgagaagggccgcgccggacctcgagcgcggcggcccccggccggcagggatggggaagcgggcgggaggaggagcaaccggagccaccaccgccgccgtctccacgtccgccggggccgggctggaacctgcggccgcccgtagcgggggcccgcggagcgcggccgccggcctcctaggcgcgctgcacctggtgatgaccctcgtagtggctgcggcgcgggccgagaaggaagcattcgttcagtcagagagcataatagaagtactgcgttttgatgatggagggctactacagaccgagacaacacttggactcagttcatatcagcagaaaagtatatctctctaccgggggaattgcaggcccatacgatttgagccaccaatgctggatttccatgaacaaccagttggaatgccaaaaatggaaaaagtctacttacataatcctagttctgaagaaacgattactttagtatcaatatctgctacaacatcacattttcatgcatcattttttcaaaataggaaaattcttccaggaggaaatacatcatttgatgtagtttttcttgcaagagtagtaggaaatgtagaaaatactttatttattaatacatctaatcatggggtatttacttaccaggtatttggtgttggagttccaaatccatatcgattgaggccgttccttggggccagagtccctgtgaatagcagtttctcacctataataaacatccacaatcctcacagtgagcctttacaggttgtagaaatgtactctagtggaggagaccttcacctagaactcccaacgggtcaacaaggaggtaccagaaaactgtgggaaattcctccttatgaaaccaagggagtgatgagagccagtttttcatctagagaagcagataatcacacagccttcataagaataaagactaatgcttcagacagcacagagtttatcattcttcctgttgaggttgaagttacaacagctcctggaatttattcctcaactgaaatgttagattttggtacactaagaacacaagatctaccaaaagttttaaaccttcatttattaaattcaggaacaaaagatgtaccaataacaagtgttcgacctacaccacaaaatgatgctataacggtacactttaaaccaattacattaaaagcatcagaaagtaaatacaccaaggttgcaagcattagttttgatgcatcgaaggcaaaaaagccatctcagttttctgggaaaataacagttaaagcaaaggaaaagagttattctaaacttgaaataccatatcaagcagaagttttagatggttatttgggatttgatcatgctgcaacattatttcacatccgagacagccctgctgatcctgtggaaaggccaatttaccttactaacactttcagttttgcgatcctcattcacgatgtgttgctaccagaagaagccaaaacaatgtttaaagttcacaacttcagcaaaccagtcttaattcttcctaatgaatcaggatacatttttaccctgctttttatgccttccacatcatccatgcacattgataacaacattttacttattaccaatgcttctaaatttcatttacccgtgcgggtatacacaggctttttagattactttgtattgccccccaaaatagaggaacgtttcatagattttggagtactgagtgctacagaagcaagtaatattttatttgcaattataaacagcaatccaattgagttggctataaaaagttggcatatcataggagacggtttatcaatagaacttgtagctgtggaaagaggcaatagaactacaataatttcaagcctgccagagtttgaaaaatcctctttatcagatcaatcatcggtaacattagcttcaggctattttgcagtcttcagagtcaaacttactgcaaaaaaattagaggggattcatgatggagccatccagatcacaacagactatgagatcctgacaatccctgtgaaggctgtgattgcagtaggctcactgacctgcttccctaagcacgtggttcttccaccttcctttccagggaaaatagttcatcaaagtttaaatattatgaattccttctcacagaaggtaaaaatacagcaaatacgatctttgtcagaagatgtgcgattttactataaacgattacggggcaataaggaagacttggagccaggaaaaaaatcaaagattgcaaacatttattttgatcctggactacagtgtggggatcattgctatgttggcttgccttttctatccaaatctgaacccaaagtgcagcctggtgtagccatgcaggaagatatgtgggatgctgactgggatttgcatcaaagcctgttcaagggatggacaggaataaaggaaaattcaggtcatagattgagtgctatatttgaagtaaatacagaccttcaaaaaaatataatatcaaaaatcactgctgagctctcctggccttccatacttagctcaccccggcacttgaaatttccacttactaatacaaactgctcctcagaagaagagattactttagaaaatcctgcagatgttcctgtctatgttcagtttattcctctggctttatattccaacccttcagtgtttgtagataagttagtatcaaggtttaacttgagtaaggtggcaaagatagatttgagaacactagaatttcaagtcttcagaaacagtgctcatccactgcagagttcaacaggatttatggagggcctctctcgacatttaattttaaacctaattttaaaacctggagaaaagaaatctgtcaaagtaaagtttactccagttcacaacagaactgtttcttcacttatcatagtcagaaataacctgactgtgatggatgctgtgatggtccaaggacaaggaacaactgagaacttgagggtggcaggcaagcttccaggtccaggaagctccttacgctttaaaatcacggaagcattgttaaaagattgtacagatagtttaaaactaagagaaccaaatttcacattgaaaagaacatttaaggtagagaatacaggacaacttcaaattcacatagaaaccattgaaatcagtggatactcatgtgaaggatatggctttaaagttgttaattgtcaagagtttactctaagtgccaatgcttctagagatataatcatattgtttactcctgattttacagcttctagagttattcgggaactgaagtttataacaaccagtggctctgagtttgtatttatattgaatgcatcccttccttaccatatgttagcaacctgtgcagaagccctacccagacctaactgggaactggctctgtatatcatcatctcaggaataatgagtgcactgtttcttttggtcattggaacagcctatttggaagctcaaggaatatgggagccatttcgaaggcggctatcctttgaggcctcgaacccgcccttcgatgtgggaaggccatttgatctcaggagaatcgttggtatttcatctgaaggaaacttgaacacactcagctgtgaccccggtcacagtagggggttctgtggagcaggcggttcatcatcccgacccagtgccgggagtcataagcagtgtggcccatcggtccacccacacagcagtcacagcaatagaaactcagctgacgtggaaaacgtcagagccaaaaacagttcaagtacctctagtaggacttctgctcaagcagcttcttcacagtctgctaacaaaacaagcccccttgtcttagattcgaacacagtgactcaaggtcatacagcgggcagaaagtccaaaggggcaaagcagagccagcacggcagccagcaccatgcccacagcccgctggagcagcaccctcagcctcctctgccaccgccagtgcctcagccccaggagccgcagcctgaaaggctgtctcccgcccccctcgcacacccttcccacccagaacgtgccagcagcgcgaggcacagttccgaggactcggacatcaccagtctcatagaagccatggacaaagacttcgaccaccatgactccccagccctagaagtgtttacagagcagcctccatcgccattgccaaaaagcaaagggaaaggaaaacctcttcagcgcaaggtgaaaccacctaagaagcaagaggaaaaggagaagaagggaaagggaaagccacaggaagatgagctgaaggactctttggctgatgatgatagctcctccaccaccacagagacctccaaccctgacacagaaccgctcctcaaggaggatacagaaaagcaaaagggaaaacaagccatgcctgaaaaacatgaaagtgaaatgtctcaagtgaagcaaaaaagcaaaaaactcttaaatattaagaaagaaatcccaacagatgtgaaacccagttcattagaactaccatatactccccctttggaaagtaagcaacgtagaaatctcccaagcaagattcctcttccaactgcaatgacaagtggatccaaatcacgaaatgcccagaaaacaaaaggtacaagtaagttagtggataacagaccacctgccctagcaaaattcctcccgaatagtcaagaattaggcaacaccagtagctcagagggtgaaaaagactctcctccaccggagtgggattccgttccagttcacaaacctggcagctctactgatagtctttataaactttctctgcaaaccctcaacgcagacattttcttaaaacaacgccagacctcaccgacacctgcttccccgtctcccccagctgccccctgcccctttgtggcccggggcagctacagcagcatcgtcaacagcagctccagcagtgaccctaaaataaaacagccaaatggaagcaaacacaagttgacaaaggcagcctcgctcccgggcaagaacggcaaccccacttttgctgcagtcacggctggctacgacaagagcccaggtgggaatggctttgctaaagtttcttcaaacaaaacaggtttctccagcagccttggcatttcacacgctcctgttgacagcgatggctcagacagctcgggtttgtggagtcccgtcagcaacccaagcagccctgacttcactcccctcaattcgttctccgcctttggaaactcttttaatctaactggtgaagttttcagcaaactcggattatctcgatcgtgcaatcaggcctcacagaggagctggaacgagtttaatagtggcccttcatacctttgggagtcgccagcgacagatcccagtccttcctggccagccagttccggctccccgacccacacagccacatcggtcctcggtaacaccagcggcctgtggtccaccactccattcagcagctccatttggtccagcaaccttagcagcgcccttcccttcaccactccagcaaacacgctggcaagcatcggcctcatgggcacagaaaactcccctgctcctcacgctccctccacctccagtccagctgacgacttgggacagacctacaacccgtggcggatatggagccccacgattggaagaagaagctcggacccttggtctaattcgcactttcctcacgagaattaaattaagcaaaaaacaaacaaacatagtgggccctcgtctagatcatgatgtgccagtttctgagacatctttttaaggctcttactgcagctcccctccccaccctcctcttctttgcaaaacagacccaagcagggcaggctcagaccactcgcttctttcagatctttcttgcaattatgataacatgagatttgctgttgtgcttttagagaaaagtctggactcagccacaaactctaataagacctgtacatctgagaacctttcccgttactgcgttttcaccacctgtcttccccatgctttatttatctgtatgaacacagatttgacattacagctaaggaaataatttgagttgattcagaaatcctggcatgtgacaattttgttaaattaccaagtttggtttttaataatttctcaatattatgcgccaagatctaattttaaaactgtatgaggactttgtgctgaaaatagagtatttttttaaagtaaggctgtcttggtttaaaagcagattacagaaatgtaagtcaacttaagaacggtgaatgaatgtaaaaacattcagttgagaccatatgcattttctgtgctgtttgtacttgaggtatgtaacatttgtatacctgaacttattttaaagatgaactgaaatgcacatagccaagtcttgagatacaagattgaatgtgtatttcttaaaaatacaactttgtgttgtactttgaaataaatgatgcttttttc

SEQ ID NO: 7233 - DNA, 1105 bp, Homo sapiens
ccggcctcctaggcgcgctgcacctggtgatgaccctcgtagtggctgcggcgcgggccgagaaggaagcattcgttcagtcagagagcataatagaagtactgcgttttgatgatggagggctactacagaccgagacaacacttggactcagttcatatcagcagaaaagtatatctctctaccgggggaattgcaggcccatacgatttgagccaccaatgctggatttccatgaacaaccagttggaatgccaaaaatggaaaaagtctacttacataatcctagttctgaagaaacgattactttagtatcaatatctgctacaacatcacattttcatgcatcattttttcaaaataggaaaattcttccaggaggaaatacatcatttgatgtagtttttcttgcaagagtagtaggaaatgtagaaaatactttatttattaatacatctaatcatggggtatttacttaccaggtatttggtgttggagttccaaatccatatcgattgaggccgttccttggggccagagtccctgtgaatagcagtttctcacctataataaacatccacaatcctcacagtgagcctttacaggttgtagaaatgtactctagtggaggagaccttcacctagaactcccaacgggtcaacaaggaggtaccagaaaactgtgggaaattcctccttatgaaaccaagggagtgatgagagccagtttttcatctagagaagcagataatcacacagccttcataagaataaagactaatgcttcagacagcacagagtttatcattcttcctgttgaggttgaagttacaacagctcctggaatttattcctcaactgaaatgttagattttggtacactaagaacacaagatctaccaaaagttttaaaccttcatttattaaattcaggaacaaaagatgtaccaataacacatcgaaggcaaaaaagccatctcagttttctgggaaaataacagttaaagcaaaggaaaagagttattctaaacttgaaataccatatcaagcagaagttttagatggttatttgggatttgatcatgctgcaacattatttcacatc

SEQ ID NO: 7234 - DNA, 1102 bp, Homo sapiens
agtatggccgcgcgctgcacctggtgatgaccctcgtagtggctgcggcgcgggccgagaaggaagcattcgttcagtcagagagcataatagaagtactgcgttttgatgatggagggctactacagaccgagacaacacttggactcagttcatatcagcagaaaagtatatctctctaccgggggaattgcaggcccatacgatttgagccaccaatgctggatttccatgaacaaccagttggaatgccaaaaatggaaaaagtctacttacataatcctagttctgaagaaacgattactttagtatcaatatctgctacaacatcacattttcatgcatcattttttcaaaataggaaaattcttccaggaggaaatacatcatttgatgtagtttttcttgcaagagtagtaggaaatgtagaaaatactttatttattaatacatctaatcatggggtatttacttaccaggtatttggtgttggagttccaaatccatatcgattgaggccgttccttggggccagagtccctgtgaatagcagtttctcacctataataaacatccacaatcctcacagtgagcctttacaggttgtagaaatgtactctagtggaggagaccttcacctagaactcccaacgggtcaacaaggaggtaccagaaaactgtgggaaattcctccttatgaaaccaagggagtgatgagagccagtttttcatctagagaagcagataatcacacagccttcataagaataaagactaatgcttcagacagcacagagtttatcattcttcctgttgaggttgaagttacaacagctcctggaatttattcctcaactgaaatgttagattttggtacactaagaacacaagatctaccaaaagttttaaaccttcatttattaaattcaggaacaaaagatgtaccaataacacatcgaaggcaaaaaagccatctcagttttctgggaaaataacagttaaagcaaaggaaaagagttattctaaacttgaaataccatatcaagcagaagttttagatggttatttgggatttgatcatgctgcaacattatttcacatc

SEQ ID NO: 7235 - DNA, 10906 bp, Homo sapiens
tacgggaaatgtttggtgcagcatccagaatggacaccactgctgtctgcaccgggggagtgacagagagtcgagggattgtggatagcctgcagaagttttcctcgctccctgcttacctccccacgaacttgcacatctccaatgcagaggagtcctttttccttaaagaagccaaccaagacctcacaaggaactccagtctgcaggcccgggtggagccattcttcatctaccgagccaggacaccccctattatcaatgccagctatggcccattttcagtggagaagataatcccccaggagctcctgttgacatctacagcctttggaaacatggacaaatttcccttcaactggaaattgaaatcccacatccttgacagctccatctactccaacagacccaaagtgcagaccttgttttatgtcactggcatgggctgggatgacagtgaccttacggaagatctaccctgtgtcaagatgtttgctttccctgaggccagggaagtggcagccagctgtcggctgcaaggggccccagggctgtgtgtggctgagctggagctgctgcccgagtggttcagctcaggcctggacctggaaccagaggaggagatcccagccctgctcgggggcaccacgatggagctcttcttcacgctctacccagctgacaaggctggccagtgtcctctggaggaggaaggcaagtgggagaacaatatccactcgggcctggagagcccccagcaagcgtttccagcccgagagaggattgggagtgtggtggtctacccaacccaagatgatctgaagtggtccctggtgagcttggacgagaatgtggtcatctcggtacctctgaatctagtccgggaaggggacacggccacctttttggtctctctgaccagtagctctgtggcagaccagttcactcttagaattaaggcggcagcaggtgtgaagataacggcagtgagagtcagcagtgaggaccaatgggcagtccaggaggaaattgataatggcagcactcagacgtcggccaccctcacctgcatgggccatcgcccggacacgcagagcagggtaaatggatccttctatgagatcttgcaagtggactttggaattgataatagcagtgacctggctggggcccagcagattacctggcaggtggagtacccgattgaggactccatgagtgagctggtcgtctccgagatcttcgtcagccagacaaccttcgtgggcatcgtccctcttgccatggacaccgaggttttgaacactgccattctcactggaaagcctgtttcagttcctgtcaaagtcgtgggggtccaggaggatggttctgtggtcgatgtgtctgagtctgtggaatgcaagtctgccgatgaagatgtcattaaggtttccaacaactgtgattccatttttgtgaatgggaaggaaatgaagagcaaagtggacacgattgtgaacttcacccaccagcacttcacctcccagttcgaggtcactgtctgggcacccaggctccccctgcagattgagatctcagacaccgagctgagccagatcaagggctggaggatcccggttgctgccaacagaaggcctacccgggaaagcgatgacgaggacgatgaggagaagaagggacgaggctgctccctgcagtaccagcacgccacagtgcgtgtcctcacccagtttgtggccgagtcacctgacttagggcagctgacctacatgctgggccccgactggcagtttgacatcactgaccttgtgaccgagttcatgaaggtggaggagccgaaaatcgctcagttacaggacggcaggaccctggctggtcgggagccgggaataaccacggtgcaggtcctctcgccgttgtctgactccatcctggctgagaagacggtgattgtcctggatgaccgagtcaccatcgcggagctgggagtgcagctcgtagctggcatgtctctctccctgcagccacaccgagcagacaaaagggccatcgtctccacagctgctgccctggatgttcttcagtccccacagcaggaagcaatagtaagttcttggattttgttcagtgatggttcggtgacacctttagacatttacgatcctaaggattattctgttactgtctcatcattggatgaaatggtggtgtctgtccaggcaaaccttgagtccaaatggccaattgtggttgcagagggtgaaggacaagggcctttgattaagttagaaatgatgataagtgaaccttgtcagaagaccaagaggaagagtgttcttgccgtgggtaaaggaaatgtcaaggtcaaattcgaaccaagtagtgatgagcaccaaggaggcagcaatgatattgagggcataaatcgggaatataaagaccacctcagtaattccatagagcgcgaaggaaaccaggagagagcagtccaggaatggttccaccgtggcacacctgttggccaagaggaaagtaccaacaaaagcacaaccccccagtctcccatggaagggaagaataagttactcaaaagtggtggtccagatgcctttacaagcttccccactcaagggaagtcaccggaccccaataatcctagtgacctcacagtgacctcaagggggctaacggacttggagattggcatgtatgccttgctctgcgtcttctgtctggccattctggtcttcttgatcaactgcgtggcgtttgcctggaaatacagacacaaaaggtttgctgtgagtgagcagggcaacatcccccattcccacgactgggtctggcttgggaatgaagtggaacttttggagaaccctgttgacattacactcccatcagaggagtgcacaaccatgatagacaggggcctgcagttcgaggagaggaacttccttctgaatggcagttcccagaagacttttcatagtcaactactcagaccctctgactatgtctatgagaaagaaattaaaaatgaacctatgaattcttcgggcccaaagaggaagagagtcaagttcacttcctacaccaccatcctcccagaggacggcggcccatacaccaactccatcctgtttgacagcgatgataacatcaagtgggtctgccaagatatggggctgggggattcacaggactttagagactatatggaaagtctgcaagaccagatgtaaactcctttcttatgtttgtattcacctttatgccttctgttttttgaatgctggagcagtgagtttgatcagcaataggggatgatttaacaaagtttgatttgtggaggtctggtgggattcatttctaagcaggtaaaagaggtttggagagctatagaagctgggttttaagtttggaaatgcctctaaaacagccacatgtggggactggagaaattctaagacaacagttttatggactgcctggtacgagctcagtgcaaatgtattaaacctgaccccacagacattgttagtcatctcgtgacaaatggccatgtggaattagaaaagatttgggtgttgatttttctatttctagaccttttaaagcacagtggacacttattgccccttggcctgagtttagacatacatgaaagatgactgaatgtagctatcctgatttgtcatgagcgctgctcattatttttatatacatttgcacctgcacctgttcctttgacctctggaattctttttgaaacatgaagagaagaaatttcagtcttttccttgagctctgtttgatttacacatgagttttcttccctgggatttgccatgccatgttatttcctgggtctccatgcaggatgtcaggtttttccagttttctgcacttcatcatctagggatggtatccaagaagcttattctcactttgttttttccttccttttgttgttgaactttcttgtataacactgggacaaagggttttacttaaaatgttaatatacagtgagggagggccatctctttactgttttctatgtgaagtttcaaacatttggaaaaaagttgtcaatcacaaacatttatttttattctctgcttgttgaaaactcatggggaactcctggagtgcatttctgagggtaaaaaggccccaacatagctgtatttatacaagtgctttgtggccaacacaatttactatccaaactgaagtcttaaagtagaattgacctacacagaaaggaaattgcctaggcaatagatgcagattacactttccattttaccagaacaaaagtttttttttttttaaataagtagaatgacagttcaagttagcaatatatagaaatccatccatacaatgaccaaaataaataaataaataaaactcaatcatgactttggcagagataaaacattgacaagggtgtgcatttgtggagagaagcagtgggtttccccccaaaatccatacaaataaatgactattccagaactcaagaagcagctattatagaaaaaaaaattaaaaaccacagctattgaaaaattaaaacggcaagagaaaaaaagaaacaactcctgcataatgtttaaataaaaatgttattttaatagcatcatgaatggtcttaaggcaaaaatttcagattagcaaaatgtgatgacatatttattaagattgtattattggaaatgtagacactggactagtatgcctcattatgagctttactgagccatttgcatctctaagaaatatgattttaaaggcccaaagtaggaaggatctgcagggggtcacctgaagcagtgccctgactccaaatggctgataactgagctaatccaaggagaggcgttcagttgttctcttattatagatttccttgggtgggaacatgacaaccccgcctcctctagccatgacgtggcagccaaaaagttcttcctgtatctctggcccacaggactgtagtgtgtttgggaacagtgctgaaattgcaagtgatgtaggcctgacctccagagcccagcgttcagttagttgtataaaatggggcttaggaaccgaagctgatgaagttccaaaagtagttcagtttgatgggataaggaagcaaggagagccaggcattagctgcaaaaggagcttgcagagagatggctgacactttatgggaagattcctcagtcagccaaaagcttttcaaagagtttggtgcagaggtagctcagagccaaccatccaggaccgaagaaagctcatgtgctgattgacacatagctatccaggtgagtcggctccttctatgaggcttttcaatcgtctctccctttggatctctggcattccagaaagactgggaattcatttctgaaaatgatgaacctccgctgaaacggggaggaaatctcttacacacatacagcagggtcctgcccactggtaaagtgagacgttgggtagggggtgtaactggggaggaggtgaaggaaattatccctgccatggggagtgttattcaggaacataaaaattagagcattccctctgatggcagtgcttgacggggtgcagggaacaaactggggagcgttcaaacatgccagtggtttctcagcagggctggaaactggccacagtcctgaagatgcttcttgtgacaacttagagtcactgggagtcacacagctcctgtgtagccgcctttgctcctctgtgttaaaacccagtcagttcaaaataacaatcaaatggaaggccatgggggaagggttccttccaccatataacccacacccagatgtatataaacgcatatacatacatatacccgtgtgtgtgtgtgtgtgtgtgtgtgtgtgtgtgaatactgaagagccagacaacaaactatttagtaagaatcaacagtgactgtcaattgttctcagatttggcatggatactatttctcatgaaataatgtcattaaagtatttcctcctctaaatatttcctgaagatcataaaccatgggttatagcaccttgttttccagctagtcaatatacaactattaggtgctgtgccccaaaatatctaaaatgggggtaaagatataaactattaagccatgaaatctaattttctggggaccatgcatttgcctggattttccaggattttatggctgatagacccaaattattagtcttgataaacaacctgaaccaaacatttataaagtcccttcctctcccatgggaatggaatgctcagactcctgctgagggagacaccagcaagcctcttgagaaggcaccagacagtgaactctgtggtcacatgaagggaggttcagatgctagacgaccagcgtatgacctggaaccattgaggattgcaaccgctgcctccagggtccagatgtgctgcagtagagggcagagcacaggaatcaagaagcagctgccacaccaaagaactgatgcttaaacacacaggtgtgttgcatttgagagaaggcaagaagaaaagacaatagaaggttaccctggaaaaacaacacctagcaaacctcagaatactccatgtgtcccaagagaaggaataattgtctttctagctgttatatattgcacactggccaggataaattcccagactataataatcctgactatgtagacggaagtttctatttataaagtcatgcagggggaaagttgattaatttttgtcccattgccacatctgtagactaagtaatttttaacttgctaacttttagaatgtccacctttgtgcattttggtagcattcttgtttcattattttagaaaggggtcttcccattactgggatgtcggggccctgtcagagaactattattaaggctctgtgagggaactgttcagtctcacagcaaggaccacagagcgtggtttcatctgaaccctacaagtcagggacaccagtgtgttttctactcgagttacctaaaaatggtctcaattttccatttcattctctgtaaatgacacaatagatggtttatagactcagcagccctcaccttttattaaaattatatatgtgtgatgtaatgcatatcacctgtcatgtaaagggacggtatggatggtggaaaagttatgctaaaatatggattgcagatatttttgtatgtaatataggcaatataatgaaacaccgagttttttaaagtgaaagcatgcaaaatcgtagcttttaaatgtacagacatcccactcaaaaatatctaaactgatagtgggaaaaacatttgagacctagtaacatcatgaaatgcactgaatttggaattctggcctagaaaggctgtggcttatgttgggattgatgatggaatctgccagaacattttcatcttattcttcttgacttttggatttttttcttttctttttttctggaaatatttcggaaataaagtgacttcatttttcagcataaaagtatattctaaccacagggtaacacatcgtttttaacatgaaaataaacatttaaacattcttcagttgtttcattattttatctgcatgttccataaagcagctgtatggttggctataatatagatttattttttcttttcagccagagattttaatacccttgatgcagtaataaatggacatcaaaagaaaacatttcttaaaagttgccaacgtattttaccttgaaaacatttcttatttgttatcctagtaggctggggaaagcttctctccagatgtctcagaaaaagatctcctgtttctcatggccccgtccagggtcaaaccatgttgaaagtcagtgctgaaatgcatgatgctgcgggtgtttgagagcctttgacctctgtccaccctttggtctttgctcgtcaatggcttggtcttgtatatgtatctggggcaggggctttgtactgggcccagggtgctgagctttccagaacaggcagagctctagagacctaagaaaaccacaggacaggcggggattctttttgagaggctgaagtagatgtttcagctgaaagatgggtggtacacttgccaagtgcctagaggggctagaggctctctgttggtgtgtgtgtatttcttgaaactgcagagtcatttttggcatgctggcaaatgctactccttgcttttaggatgaatagggatgcctctttggcgataatttgacgtgtcataataaatgcccaataccaaacctagtctttctccaggcccttcagacatcattcaggtaactgggtgtaaacacaggagttggctttgtgaaactgaggcaggatttcctgcctctaaactattggcagcaaaagagccaaaaatgtgctcccaggtgcaaaaccccagccccatcagaattgcttctcagcactttgggtaactgttttgcactaacagcttcctccttgtcttttccctgggaacatgggagcactgacacagaactcaactggtccagccctttgggaggcccaggtgggcagatcacctgaagtcaggagtttgagaccagcctgggcaacatggtgaaaccctgtctctactaaaaatacaaaaattatccagtcgtggtggtgcatgcctgtagtcccagctactctggaggctgaggcaggagaatcacttgaacctgagaggtgaaggttgtagtgagccaagatcgtaccactgcactctggcctgggcaacaagagcgagactttgtctcaaacagaaacaaaacaagaaaaacaaaaagaacttaaccagttctccccagatctcagcgtgcatgcatatatagagtttagtaaaatgtgtttcaaaaaaagaaggataaaagaaagtttgaagtaagatttgtaaaagaatgaacactttaggttttgtgtgtgagtgcaaaatgtaaacacggcatttgaaattttttggtattgaaatccttaatgcctgttagtttctttatggttttatacaattgagataggttctgaagtttttttgttgtttgcttttagaaatttttaaaaatacaaaaaaaaagcgcagaaacattttcatctgggttactgtgtttatagactattctatgactcaagacaactaggacaccatcattttccagataagaaataacagttcaagttcattagggaaattatcttcccagtccaagcaagcaataatgttatcaacttacaatattggacaatcttcatattctatgagatgcctttaaaatttctttggatttaatgctgctcttggtcagttgttcaaatgaaacattgtaatttcatgttaacgacaagagtctcacgggagtctctttagatgctgcaggaactgagaggatagaagacctctctatacatctacattgcccattggagtaaagcactttacagagagatggatgccgctttgggatttggggtctatgtaatgctgatttttttcaaacctgtttggaaatattacttctttgggatggctgaaataacttttgacctgacacatctttctgtacttcctgtggccaaaaaagcaagtgagactttctgtttcccattgtaaggctggagctgaaatagtctgccacgttattgttatctcctttgtaagaatttgactttctgaatgaaataacagaatgccagtgtcaacactgaccatatgatatagttatttcacttagagatgcttcctcaaagagcgtgcctttttcctccatcataaccgctttaggatctctgttttatccatgtatttcccacatagtagaagcattttccatttccatgaatattacaggctgagaaggagcacacatctggcactgataagcacactggcccaggcactcagccttctcatttcattaatctggttggtgaccgtttccatcgggcacacctggaaatgtccatcggacatattgccatctcagttgctgcagtgcagtgaattaccccagagccaccagttcacatgcccaaagatgaactggcccatggagggacttgattgccaagtgacttcctttctgtagttatcctctgctgtgacccttattttggacttctagcaagggcattcagtgtggattccaagaacaaaaccaattgtccaacctccattacaggggtcttctaggtattccccacacattatttgtgggcataagcaaacaccataactatgaaaggctgagagtggagaattaagtcataaggaaatgatcaaacctagggaaaaataagtggctataaaacactgaaagatagtcacatccacatagcgtgtatcatgcaacagacccgtgctcttagagggaggtagtgtgtgtcttcccatggcaaataatttttacaatactgctcatgtttaatgtgtgtctacagggcatgctgttgtctcaaaattgaaatgtgcatcttaggtatcagttcccagcctcagactcttctcaggcaggtggaccggatctcagctgcagaacatagtgagtggccaaacctacacagcccagccagtagtgtgctttggggtgattgcaaggcagcaaacagtggggacaagttttgtctggcatttgaaaaggtgttatcccttactttccacatttctgaattggattcttgttccctggtaaacaccagatattataaacagagcatgctgttatgacattgtgcttctatatacctttttgtataatgtatctatctcattatattacctatggtttcagtatgatctgttgtgtatgttccaccgtatatttaatgtctctgtaaaggcacttccaaacattttgaaaacgaagaaataaaacatgttggatgatt

SEQ ID NO: 7236 - DNA, 4947 bp, Homo sapiens
atgcgctccgagggtgcggcccccgggccggcggcgccgctgtgcggggcgctgagcctgctgctgggcgcgctgctgggcaaagtgatagagggtcacggggtcacagacaacatacagagattctcctcactgccaccttacctacctgtgagctaccacatcctcagagcagagacctccttcttcctcaaggaagccaaccaggacctgctgcggaactccagcctgcaggcgagggtggagtccttctttacctacaaaaccaggcagcccccagtgctcaatgccagctatggacccttttctgtggagaaggttgtgcctctggacttgatgttgacttcaaactttttaggtccaaccaataagtttagttttgattggaaactaaaagcccacatcctgcgggacaaagtctacctgagccggcccaaagtgcaggttcttttccacatcatgggcagagactgggatgaccacggcgccggggagaagctgccatgcctgagggtctttgctttccgagaaaccagagaggtgcggggcagctgccggctgaagggggacctggggctgtgtgtggctgagctggagctcctgtccagctggttcagtgccccgacggtgggtgccgggaggaagaagtccatggaccagccggaggggacccctgtggagctctactacaccgtgcacccaggaaacgagcgaggggactgtgccgggggtgacttcaggaagggcaacgccatccgtccaggaaaggatgggctggaggaaaccacgtcccacctgcagaggatcggcaccgtcggcctttaccgggcccaggacagcgcccagctcagcgagctgcgtttggatggtaacgtggtcatctggctgccttccaggccagtcaagcagggagaggtggtcacggcctatgtcaccatctcgagcaattcctctgtggacctcttcatcttgagagccaaggtgaagaagggggtgaacatcctgagtgctcagacccgtgagccccggcagtggggcgtcaagcaggaggtgggcagcggcggaaagcacgtgacggccaccgtggcctgccagcgcctggggcccagcccacgcaacaggagcagcagtttattcaatgaggttgtgcagatgaactttgaaatagccagtttcagcagcctttcagggactcagcccatcacgtggcaggtggagtacccacggaaggggaccacagacatcgccgtgtccgagatctttgtcagccagaaggacctggtgggcatcgttcccttggctatggacactgaaattctgaacaccgccgtactcacaggaaagacagttgccatgcctatcaaggtggtctctgtggaggagaacagtgccgtgatggacatctcagagtcggtggagtgcaagtccacagacgaggacgttatcaaagtgtctgagcgctgtgactacatctttgtcaatggcaaagagatcaaaggaaagatggatgcggtggtgaacttcacataccagtacctgagcgcccccctgtgtgtcaccgtgtgggtgccccggctgcccctgcagatcgaggtctctgacacggagctcagccagataaagggctggagggtccccattgtgaccaataagaggcccactcgtgagagcgaggatgaggacgaggaggagcggcggggccggggctgcgcactgcaataccagcacgccaccgtgcgggtcctcacccagtttgtgtctgagggcgccggtccatggggccagccgaactacctgcttagtcctaactggcagttcgacatcactcacctggtggcagacttcatgaagctggaggaacctcacgtggccaccctccaggacagccgggtcctggttgggcgagaggttgggatgacgaccatccaggtgttgtctccactgtctgactccatcctggcagagaagacaataaccgtgctagatgacaaagtatcggtgacagacttggccatccagctcgtggctgggctgtctgtcgccctttaccccaacgcagaaaacagcaaggccgtaacagctgtggtcacagctgaggaggtgctgcggacccccaaacaggaggctgtattcagcacgtggctgcagttcagtgatggctctgtgacgcccctggacatctacgacaccaaggacttctccctggcagccacctcccaggacgaggctgtcgtgtcagtcccccagccccgctctcccaggtggcccgttgtggtggccgaaggggaaggccagggcccactgatccgagtggacatgacgatcgccgaggcctgccagaaatctaaacgcaagagcatcctggctgtgggcgtcggcaacgtcagggtcaagttcggacagaacgatgctgactccagccccggcggggactatgaggaagatgagatcaagaaccacgccagcgaccgccggcagaagggccagcaccatgagcgcacaggccaagatgggcacctctatggcagctctcccgtggagcgtgaggaaggggctctccgaagagccactaccacggccaggtccctgctggacaacaaagtggtgaagaacagtcgggcagacgggggcaggctggcaggagaggggcagctgcagaacatccccattgacttcaccaacttccctgcccacgtggacctccccaaggccgggagtgggctggaggaaaacgacctggtgcagactccgcggggcctgagtgatctggagatagggatgtacgccctcctgggggtgttctgcctggccatcctcgtcttcctgatcaactgcgccacctttgccctgaagtacaggcacaagcaagtgcccctggaaggtcaggcctccatgacccactctcacgactgggtgtggcttggcaatgaggccgaactcctggagagcatgggggatgcgccgccgccccaggacgagcacaccaccatcatagaccgcggaccgggggcctgcgaggagagcaaccatctcctgctcaatggtggctcccacaagcacgtgcagagccagattcacaggtcagccgactccggggggcggcagggcagagaacagaagcaggaccccctgcactcgcccacctccaagaggaagaaggtgaaatttaccacctttaccaccatccccccggacgacagctgccccacggtgaactccatcgtcagcagcaatgatgaggacatcaaatgggtgtgtcaagacgtggctgtgggtgcccccaaggaacttagaaactatctggagaaactcaaagataaggcttaggcccctctagccaaagggccctgcccagatgccttccttgtactggaaactggcccaagtggggcagaaggcgttgtcagtggggttaagaagggacggtcccagggtccatgctagaccagttggaaagttttgaagtcaggaaaagacgtttttgtatcaagggatttttagcagttaatggtggtggatttttaaaggtcaggggaataaagtctggggcatggggagtgcagaccaagttactgaactgcacaggcaaaattaggaaggttattttatgagtcaaaacatactacagacaagctaccaaaaattatttgttaaaaaatgcaacaagacaaataaaaagagaaataatcatctgtttatatttctaataaaggagcaaaatataaaaataggacctgctaagagacattttccattctaattcacgattcacttttccaaggacagccttcaactgtcaccacacagctgggggggagtcatttcttaacaagggatgcctcttgggatagaactagggagttttaaatctttacttgatcatcttttattttcttttccactttttccttttttctctctctctgtgtcctagacttccattgcatttatatttaatgtttatttctgagaatcaagcagtatatttttcctaaatgaaacataaattatattcctattcattagataggttcctaggaacaatgccaattaatccattgtttaagtagtaacttgaatgtttttctatatccctccagctttgttgatagtggcgggttttgtacaattggagggagccctcagagccttctgggggaggagaggaactgtccttaatccatcaccactaccatagggcaaagccagcaggtgtggccctgtgaggggctgtacagacgggatgtggccaggagaacagagccccacctggaccacctgacccctcgggattccacccctgtcatcgtggggatgttcctatatgggagaaagttgggttaaatcaaaaaagaggccacgcccaggtgtaatcagagccaacctggtgggcttggtctatcacaagacataactgatgctgaacatgaacaaagataaaaactgtttggagggtttttgagttgtttttcttatgttgttgggtggggtataccagcataaactctaaagataaaatctatgttagattgtcaatcaactgtgtttttgaacagcataattgtgtagcagcacattgcaaaaatgcattcatccaaagcgacacatgtggcaacgtagaccacgccagtgaaataagccccttcgtgatcacctgactccagttctccgtgtgctccattggctgcggctgcaggaggaagatgcctgacagccctcatgctctccgcaggggggcgctcacaaagatgccaggggtgtttattgtgtttatttttttaattactaaaatcagtagctaagaaagggtccttgaagcctcctaacctgggttggacctttgaaaaatatatttgtagcacatattatagatggaaagaagaagatatttatttatacctgtgatgccaattgtcattaaaaggcttttcatggcttgacaagtca

SEQ ID NO: 7237 - DNA, 5305 bp, Homo sapiens
cgtttatagataccaaggatgaggatgtggatacctttcggagctattatttagtctcccacactctcccgaagacatgtcccaattcttgtttaggatgaaaactaaaggactcattgccttcccccaggaaagctaggagacaagacaagagaacaaaatccttacattgaacttgcttcttcccatcagcgctggcatggaggagccctcttgcaccaggtagaagttggcagcctgagctctggagccagacttctggggctaaatcctggctctgcccttcctggtagaggaacataggcaggctcccccactcctgccggcttcctcatctggaatgtgggaatggcagtggtgcctagcgttgtggttgttctgaggatgaaaggaatccgcatgtttggattccctgaaaagcggagcctgtgacgtgcacttgagaacaggtgctttatttggggaatgatctctggaggcagaatgagggagtgagcagcaagacaggacacattttggaaaaccagcaggaggtgcatcattgagctagctcgcatggtgggcaacttctgtgaagtcccatcgagcccctctagggaattctgcaggacaggcctcagaatccacccctgtgcctcgtcgagcccctctagggaactctgcaggacgggcctcagaatccaccccgtgcctgcaggggaaagtggtctgcacatgccctgttgaggacgttctcaggatacacccgcatgggagtgaagacagtagaaggggaagaagaggggctaagcaaggtcaggtccaggtgcagcacagccagctccttgaggagctcttaagaatgagctgtgctgtgcatgggtccctccttgaggcaaacagcctgggcttctcaccccaccaggtagtcactgggcagagaagcggggtgagcaggacataactcccgggtaactctgagggacacagctccactcacctaagggcagtcttctacggaagatgtggcaggagctgtcggcaacacacgcagcccctggggaggagtccaccaacctagccacagggaccccaggaagcctgggtactcagagagcacctttcataacagcgtctgctattattactcaaaagcaacacccaatgtctgctccataccaggacctcctcccccatagtaaggggaggaaagggaagcacctccaccagccagggcacttccctttcctcctccttgggccatgcaacgggatgaaagctcacctttccctccccttttctctctcacctcttcacaggtttctgacagatgtgactacgtctttgtcaatgggaaagaaatgaaaggcaaggtcaacgtggtggtgaacttcacctaccagcacctgagcagccccctggagatgacggtgtgggtgccccggcttccgctgcagatcgaggtctccgacaccgagctcaatcagatcaagggttggagagtgcccatcgtctccagcaggaggcctgccggggacagtgaagaggaggaggatgatgagcggaggggccgcggctgcaccctgcagtaccagcacgccatggtgcgggtcctgacgcagtttgtggctgaggcggccggccctgggggacacctggcccacctgctgggctcagactggcaagtggacatcacggagctgataaatgacttcatgcaggtggaggagcccaggatcgccaagctgcaaggcggacagatcctgatggggcaggagcttgggatgaccaccattcagatcctgtctcctctgtcagacaccatcctcgctgaaaagaccatcactgtgctggacgagaaggtgaccatcacagacctcggggtgcagctggtgacagggctgtcactctccttgcagctcagcccaggaagcaacagggccatctttgccactgcagtggctcaggaacttctgcagaggccaaaacaggaagcagccatcagttgctgggtccagttcagtgatggctcagtcacgcccttggatatttacgatgggaaagacttctccttgatggccacatctttggatgagaaggtagtctccatccaccaagaccccaaattcaagtggcctatcattgctgcggaaacagaaggacaaggcaccctggtcaaggtggaaatggttattagtgaatcctgccagaaatccaagcggaagagtgtgttagctgttggaacggcaaacatcaaagttaaatttggccaaaacgatgctaaccccaacaccagtgacagcagacacacaggggcaggggttcacatggaaaacaatgtcagtgacagaaggcccaaaaaaccctcgcaggaatgggggagtcaggaaggacagtactatggcagttcttctatgggactcatggagggacggggcaccacgacagacaggtccatcctgcagaagaagaaaggccaggaaagccttttagatgacaacagccacttgcagaccatccccagcgacctcaccagcttcccagcccaggtggacctccccagaagcaatggggaaatggatgggaatgaccttatgcaggcatccaaagggctgagcgacttagaaattgggatgtatgctttgttgggagtcttctgtttggccattttggtcttcttgataaactgtgtgacctttgcattaaaatacagacacaaacaggttcccttcgaggagcaggaagggatgagtcactctcatgactgggttgggttaagcaaccggacagagctgttggagaatcacatcaactttgcctcctcgcaagatgagcaaatcactgccattgacaggggcatggatttcgaggaaagtaaatatctcctcagcacaaactcccaaaaaagcatcaatgggcagctgttcaaacctttgggacccatcatcattgatgggaaagatcagaaaagtgagcccccaacatcccctacctcaaaaaggaaaagggtaaaatttaccaccttcaccgccgtctcctcagacgacgagtaccccaccaggaactccatcgtgatgagtagcgaggatgacattaagtgggtctgccaggatctggaccctggggactgcaaagagctgcacaactacatggagaggttacatgaaaatgtgtaagccagacacacacagacattggttctcactcacctttcagcctttaattccaggatgtgtagcaacggtgcccccggaagagaaacaaagcagcaggacaaaataaggatgacactatccatacagcctcagccaatgaccccggctcggcggcgaggcctggagtccgcatcgacgcacacattccagagtacagtgtcttgcttaagaggtttatcatgcatggcaagatttttaagacttgaaacaaaaacgagttctgaatcactgagcgtctgagagcgtccaggaaagaacagcctctctctctcgaatcaaagcaatttggatattgtaaaatccacatggctccaatattcaatattgcagactatggaagaaaagtacaactcaggtggagcatccatggatcgcatccatggatcaatgggaggaagcgtgtcatcgaaactggagcagcacatcttgctgtgagcgcgatcacaggcagtccagtgccgccgtcagctgtgggaggcatgattgtgagtcattgtctctcaaaggctgggccagagctgtctcagatcatggacaggccaaggaagtggctgacaaggactgaaagggaacatgtgggctaacaggccacaaatacctttgtaactacatgccaaggacaaacacatggacgcaaatcctctgagcccttcagggtacttctttatttgtaaactaaggatactgggcatagaatttgaatcaggttcaaagaaccacgctcttttgattcatatcaagttcacaatgtatccatttctattcctccactgcattgccatcctccccaaagccgttggtcacctgtgggtgggggagggagagggcagtttgtagtatttgctgggtcttttttctccccctgggttttgtgtcaactcccaagtgacattctgtagagaagctccccccgcaacctgggcatatgtcccacgccgtccgtctttgaagaggctggtctctaggcatgggcggtagtcacggtgaattccataccaggggatatacattcccttgctttactagaaagaaaacagggccacttgggatgggtctttcactgttcatggcagatctcctgtccaaagatgtggcctcgaggctgttgagacaaatcggggtgcctgtgtggaacgtgcagggcgtgtggagttgggggggttctgggtgtgaaagtggtggatccagcaggaagcccagcctcacacacaccggacagcacagaaaccttcttcatcttggaggtgcgaagggataaggggcatcagtgcatgtggtgaagatgcaggtttgcaagcacttggtcctgcagtcagccccgaaaggttcagcattgcttaagaccagccatgactctggatatccctgaatcccttcacttatgaagcctatgaagatgggggcaaggatacatcagagaattcctgcctcatctcacgctcactccaaggtagagaatggtgtgttgggtgattgccagccagataggatcctgcaaaagatggtcgggggcagcgggtggtgggcagaagaggccgtgctgttgaattgatcttctatttttccctctggtcattttctctctctctctgctcttcagttgtctgttttccagtctctctgtgtgtctgtctctgtatctctctcctcctttgaacctatcttctccctgcttcctctccatctcatctctgtaattttgagtgtgtgtctttactccttcttcctctccatagaattgaattctctttagatcatgtgtgtgtaaatttcaccagtttaccctcccaaccttagccctctcccctgcaactgtggtgctcttgagactgaggtttctgcagccagtaagtcacctgctcctgtccgcaagcttacctaccttgtttggttgggtgattaagctgtcaccccttttcaatgagaatcctttgctttcagtaacgtcctcatatttctttccattcttacctgtgtcatgttctgttgaatactgcagccgctgcccgcttccaaatccatctgcgtgtagaatgtactgtagattgtaagaatgtaatatatatttataaacttactgactgtaaatataaagtttgcattcagtggct

SEQ ID NO: 7238 - DNA, 5776 bp, Homo sapiens
ccactcttcgctcgggtaaacaggaaaggaaataccccctgtggattaaaatttaaaaaaaattctgttggggtcgaaggagggaggtggggtttgcctgcgcgcgtgttggactccggagagcaactcaggagcccgcgcggtcgtcgcctcccggcctggccatggactggcgggaagagggagcagggcgcccgggctgctcgggcccctagccgggcgctccctcgccaccggccccgctgcgggcctctaggggactgagacggtctcttgttcgcctggacggcgccggggagcggaggatctgcgctccgggtctccaggatgtgcccgtctgagatggggacgctgtggcaccactggtcgccggtactcatcagcctggccgccctgttttccaaagtgacggaaggtcgagggatccttgagagcatccagaggttttccttgctgcccacctacctccccgtgacctaccacatcaacaacgcggacgtctccttcttcctgaaggaggccaaccaggatatcatgaggaactccagcctgcagtcccgggtggagtcatttctgatttacaaatccaggaggctgcctgtcctcaatgccagctacgggcctttctccatcgagcaagtggtgccccaggatttaatgctaccttccaacccatttggattcaccaacaaattttctcttaactggaaactaaaagcccacatcctgcgggacaaagtctacctgagccggcccaaagtgcaggttctgttccacatcatgggcagagactgggacgaccgcagcgccggggagaagctgccgtgcctgagggtctttgctttccgagagacccgagaggtgcggggcagctgccggctgcagggggacctggggctgtgcgtggccgagctggagctcctgtccagctggttcagcccccccacggtggttgccgggaggaggaagtccgtggaccagccggaggggacccccgtggagctctactacaccgtgcacccagggggtgagagaggggactgcgtcagggaagacgcgaggagaagcaatgggatccggacaggccacagtgacatcgatgagtccgggccccccttgcagaggatcgggagcatcttcctttatcagacacacaggaaaccctccctgagagaactgcgtctggacaacagcgtggccatccactatataccaaagaccgtgaggaaaggagacgtgctgacttttcctgtttccatctccagaaattccactgaagatcgcttcacgttgagggcaaaggtgaagaaaggcgtgaacatcatcggcgtgcgagccagcagcccttccatttgggatgtcaaggagcgcacggattatactggaaagtatgcaccagctgtcatcgtttgtcagaagaaagcagctggctcagaaaacagtgcggatggcgcctcctacgaggtcatgcagatcgatgtggaggtggaagagcctggtgacctgccagccacacagctggtcacgtggcaggtcgagtaccccggagagatcacgtctgacttgggagtgtccaagatctatgtgagcccaaaggacttgattggagttgtgccgctggctatggaggcagaaatcctgaacacagccatcctcacggggaagacggtggccgtcccggtgaaagtggtctccgtggaggacgacggcacagtgacagagctgctggagtctgtggagtgtagatcgtctgatgaagacgtgattaaggtttctgacagatgtgactacgtctttgtcaatgggaaagaaatgaaaggcaaggtcaacgtggtggtgaacttcacctaccagcacctgagcagccccctggagatgacggtgtgggtgccccggcttccgctgcagatcgaggtctccgacaccgagctcaatcagatcaagggttggagagtgcccatcgtctccagcaggaggcctgccggggacagtgaagaggaggaggatgatgagcggaggggccgcggctgcaccctgcagtaccagcacgccatggtgcgggtcctgacgcagtttgtggctgaggcggccggccctgggggacacctggcccacctgctgggctcagactggcaagtggacatcacggagctgataaatgacttcatgcaggtggaggagcccaggatcgccaagctgcaaggcggacagatcctgatggggcaggagcttgggatgaccaccattcagatcctgtctcctctgtcagacaccatcctcgctgaaaagaccatcactgtgctggacgagaaggtgaccatcacagacctcggggtgcagctggtgacagggctgtcactctccttgcagctcagcccaggaagcaacagggccatctttgccactgcagtggctcaggaacttctgcagaggccaaaacaggaagcagccatcagttgctgggtccagttcagtgatggctcagtcacgcccttggatatttacgatgggaaagacttctccttgatggccacatctttggatgagaaggtagtctccatccaccaagaccccaaattcaagtggcctatcattgctgcggaaacagaaggacaaggcaccctggtcaaggtggaaatggttattagtgaatcctgccagaaatccaagcggaagagtgtgttagctgttggaacggcaaacatcaaagttaaatttggccaaaacgatgctaaccccaacaccagtgacagcagacacacaggggcaggggttcacatggaaaacaatgtcagtgacagaaggcccaaaaaaccctcgcaggaatgggggagtcaggaaggacagtactatggcagttcttctatgggactcatggagggacggggcaccacgacagacaggtccatcctgcagaagaagaaaggccaggaaagccttttagatgacaacagccacttgcagaccatccccagcgacctcaccagcttcccagcccaggtggacctccccagaagcaatggggaaatggatgggaatgaccttatgcaggcatccaaagggctgagcgacttagaaattgggatgtatgctttgttgggagtcttctgtttggccattttggtcttcttgataaactgtgtgacctttgcattaaaatacagacacaaacaggttcccttcgaggagcaggaagggatgagtcactctcatgactgggttgggttaagcaaccggacagagctgttggagaatcacatcaactttgcctcctcgcaagatgagcaaatcactgccattgacaggggcatggatttcgaggaaagtaaatatctcctcagcacaaactcccaaaaaagcatcaatgggcagctgttcaaacctttgggacccatcatcattgatgggaaagatcagaaaagtgagcccccaacatcccctacctcaaaaaggaaaagggtaaaatttaccaccttcaccgccgtctcctcagacgacgagtaccccaccaggaactccatcgtgatgagtagcgaggatgacattaagtgggtctgccaggatctggaccctggggactgcaaagagctgcacaactacatggagaggttacatgaaaatgtgtaagccagacacacacagacattggttctcactcacctttcagcctttaattccaggatgtgtagcaacggtgcccccggaagagaaacaaagcagcaggacaaaataaggatgacactatccatacagcctcagccaatgaccccggctcggcggcgaggcctggagtccgcatcgacgcacacattccagagtacagtgtcttgcttaagaggtttatcatgcatggcaagatttttaagacttgaaacaaaaacgagttctgaatcactgagcgtctgagagcgtccaggaaagaacagcctctctctctcgaatcaaagcaatttggatattgtaaaatccacatggctccaatattcaatattgcagactatggaagaaaagtacaactcaggtggagcatccatggatcgcatccatggatcaatgggaggaagcgtgtcatcgaaactggagcagcacatcttgctgtgagcgcgatcacaggcagtccagtgccgccgtcagctgtgggaggcatgattgtgagtcattgtctctcaaaggctgggccagagctgtctcagatcatggacaggccaaggaagtggctgacaaggactgaaagggaacatgtgggctaacaggccacaaatacctttgtaactacatgccaaggacaaacacatggacgcaaatcctctgagcccttcagggtacttctttatttgtaaactaaggatactgggcatagaatttgaatcaggttcaaagaaccacgctcttttgattcatatcaagttcacaatgtatccatttctattcctccactgcattgccatcctccccaaagccgttggtcacctgtgggtgggggagggagagggcagtttgtagtatttgctgggtcttttttctccccctgggttttgtgtcaactcccaagtgacattctgtagagaagctccccccgcaacctgggcatatgtcccacgccgtccgtctttgaagaggctggtctctaggcatgggcggtagtcacggtgaattccataccaggggatatacattcccttgctttactagaaagaaaacagggccacttgggatgggtctttcactgttcatggcagatctcctgtccaaagatgtggcctcgaggctgttgagacaaatcggggtgcctgtgtggaacgtgcagggcgtgtggagttgggggggttctgggtgtgaaagtggtggatccagcaggaagcccagcctcacacacaccggacagcacagaaaccttcttcatcttggaggtgcgaagggataaggggcatcagtgcatgtggtgaagatgcaggtttgcaagcacttggtcctgcagtcagccccgaaaggttcagcattgcttaagaccagccatgactctggatatccctgaatcccttcacttatgaagcctatgaagatgggggcaaggatacatcagagaattcctgcctcatctcacgctcactccaaggtagagaatggtgtgttgggtgattgccagccagataggatcctgcaaaagatggtcgggggcagcgggtggtgggcagaagaggccgtgctgttgaattgatcttctatttttccctctggtcattttctctctctctctgctcttcagttgtctgttttccagtctctctgtgtgtctgtctctgtatctctctcctcctttgaacctatcttctccctgcttcctctccatctcatctctgtaattttgagtgtgtgtctttactccttcttcctctccatagaattgaattctctttagatcatgtgtgtgtaaatttcaccagtttaccctcccaaccttagccctctcccctgcaactgtggtgctcttgagactgaggtttctgcagccagtaagtcacctgctcctgtccgcaagcttacctaccttgtttggttgggtgattaagctgtcaccccttttcaatgagaatcctttgctttcagtaacgtcctcatatttctttccattcttacctgtgtcatgttctgttgaatactgcagccgctgcccgcttccaaatccatctgcgtgtagaatgtactgtagattgtaagaatgtaatatatatttataaacttactgactgtaaatataaagtttgcattcagtggc

SEQ ID NO: 7239 - DNA, 4195 bp, Homo sapiens
aaagtgtccccgaattgcactctctggtcccggagctgcatctgagacagccgggcgccacggcagccctgagttggatgtgaccaagcccagcctggggccaagtcgtcgtcgactgttgctctctcggacccctcccgcccccgcctcggccatggccccggggatgtcgggccgcggcggcgccgccctgctctgcctctcagcgctactcgcccacgcctctggccgctcccacccggccagccccagcccgccggggccgcaggccagcccggtgctgccagtcagctaccgcctgtcgcacacgcggctggccttcttcctgcgggaggcgcggcccccgtcacccgcggtcgccaacagctctctgcagcgctccgagcccttcgtggtgttccagaccaaggagctgccggtcctcaacgtctctctggggcccttcagcaccagccaggtggtggcgcgggagctcctgcagccgtccagcaccctggacatccccgagcgcctgacggtgaactggaaggtgcgggccttcatcgtccgctcgcacgtgcccgcctcgcagcccgtggtccaggtgctgttctacgtagccggccgggactgggacgacttcggcgtcaccgagcggctgccctgtgtccgcctgcatgccttccgggatgcccgggaacaccccctgctgcgcatcgggagcatcagcctgttccgcccgccccccaggaggaccctgcaggagcacaggctggacagcaacctgatgatccgcctgccagaccggcccctcaagcccggggaagtgctcagcatcctcctctatctggcccccaactcctcctcgccctccagccccagcgtggagcacttcacactcagggtgaaggccaagaagggtgtgacccttttaggtaccaagtcacggagtggccagtggcatgtgacctcggagctgctgactggggcaaagcactcaacagccaccgtggatgtggcctgggctcagagcacacccctgccccccagggagggccagggccccttggagatcttgcagctggactttgaaatggagaacttcaccagccagtcagtcaagcggaggatcatgtggcacattgactaccgtggccacggcgccctgcctgacctggagcgggcagtcactgagctgacggtcattcagcgggatgtgcaagccatcctgcccctggccatggacacagagatcatcaacacggccattctgactggccggacagtggccatccctgtcaaggtcattgccatcgaggtgaatggcctcgtcctggacatctccgccctagtggaatgcgagtctgacaatgaagacatcatcaaggtatccagcagctgtgactacgtgtttgtgagtggaaaagagtctcgagggtccatgaacgccagggtcaccttccgctacgacgtcctcaatgctcccctggaaatgacagtctgggtccccaagctgcccttgcacattgagctctcagatgcccgcctcagccaagtgaagggctggagggtacctatcctccccgaccggaggtcagtccgggaaagcgaggatgaggatgaggaggaggaggagcggcggcagagtgcaagccgtggctgcaccctgcagtaccagcatgccaccctgcaggtcttcacccagttccacacgacatcatccgagggcactgaccaggtggtcaccatgttaggcccggactggctggtggaggtcaccgacctagtcagtgacttcatgcgggtgggcgatccccgagtggcacacatggtggacagcagcacgctggcaggactggagccaggcaccaccccctttaaggtggtgtctccgctgacggaggctgtgctcggggagacgctgctgacggtgactgaggagaaggtcagcatcacacagcttcaggcccaggtggtggccagcctggccctctccctgcggcccagccctgggagcagccacaccatcctagccaccacagctgcccaacagaccttgagcttcctcaagcaggaagccctactgagcctctggctctcctacagtgatggcaccacagccccactctccctctacagcccacgagactatggactgctagtgagcagcctggatgagcatgtggccactgtgacccaggaccgggccttccctctggtagtggctgaggccgaggggtcaggggagctgcttcgcgcagagctaaccatcgctgagagctgccagaaaaccaaacgcaagagtgtgctcgccacgacccctgtgggcctgcgggtgcactttgggagggacgaggaggaccccacttatgactacccgggccccagccaaccagggcccggcgggggcgaggacgaggcccggggagctggcccgccgggctctgcgctacccgcaccggaggctccaggcccgggcaccgccagccccgtcgtgccacccacagaagacttcctgccgctgcccaccggcttcctgcaggtgccacggggtctgacagacctggagatcggcatgtacgcgctgctgggcgtcttctgcctcgccatcctcgtcttcctcatcaactgcatcgtttttgtgctgcgctaccggcacaagcgcatcccgcccgagggccagaccagcatggaccactctcaccactgggtgttcctgggcaacgggcagccgctgcgggtgcaaggagagctgtcgccgccagcaggcaacccgctggaaaccgtgcccgccttctgccacggcgaccaccacagcagcggcagctcgcagaccagcgtccagagccaggtgcacggcaggggcgacggctcctcgggcggctcagcccgagaccaagccgaggaccccgccagctcgcccacctccaagcgcaagcgggtcaagttcaccaccttcaccacgctgccgtcagaggagctggcctatgactcggtgcccgcgggcgaagaggacgaggaggaggaagaggacctgggttggggctgcccggatgtggcgggccccacgcggcccactgcacccccggacctgcacaattacatgcgcagaatcaaagagattgcatagaggcgccagccggagtagcagggacccccccccccaacggggtcagctcggggtaggacacagccgggaccccggttcacactgactctgggcggctgaattgattttgtactccctgcccctgcagcttggctccgtgcggagcgggccgcctcagtgtctgggccttccctcgcctcacgccattaccctcttctgccccctgcaggtggagggctcttcctccagtggctcgtaaggaggaaagcaaccccagcctctgttctgccctttccaaacctcctcccatcttaagcaaccccctgccccaagagtgaggcaaggaggtccagcttggggtcaggtgggcccacgctgtgtcccgggcccgcctcccgtcccccgtgtcgtccccctgtgcagggggttctgtgggggtcttgtgtcacaggctgcacaaagactttcctcaaactaatattcagggatttctgtcctgcagggtggggaggtggcagctgcctgccctgccaaggatcttgctgtggacgaaatatctgggggttagggggacagttgtagcatctgctggcattcgggtgcctcccaggacctgggagctgactctacagagaggtctggtgccaagccaggcaccttcctgagttctcaggactcccacctctgccccaagggctttgggcagggacctaaaggggaaagagtcctggatccatctctagccaaatcacaccccagagccagaggcctggggacctccttgccttccccgtcccccacagcaaggtcaacactactacgccttagccacccgtcaccctgctgactgcgacttccctctgcagcacagggcaggcagccacctatgccccacaagacggaacccgggaggggagtagagggcaccagggaatgctgtgagggacttcagggtgggcaaatgcagaagggagccagtgtcgcccctaccccatcccacagccatttttctctcgggttctacccaccactgtgtcggatttttcttaaataaatggaagcggtcagactggaggtgggggcagcagctcccatgaacagagagta

SEQ ID NO: 7240 - DNA, 1853 bp, Homo sapiens
ttgaaaagggtatcattcatgtggtttcagtttagaagagtccctcagagctttgcctcaagcaatttcaaattgtagtgataccttaaatcatgtattcaggatgccttctttagcatttagaaccccaactagacttatactttgactaaagtcagaggcagaccaatttagggaacagattttgttctttgcttttatgatacatttgtaactcacagctgttagcatgacctcacatcactgcgtaggacccggaaatcacatctcctggtcaggtcacgaaaaagaacacaggcttgactattgtccagaagttactttccccttgactaaaggtttccccttagggtacacattgctatttaactttgcctcctacccttttttgttaccttccaaaatcaagacacttttaagaaacaaagatagttttctgaacattctgtgtcctgcctgtctcctgttgattcgcagatgtaatatcgagtattcatcaactggtctcaatttcctgaacacattcactgtatccctcattgtcaccgttatccccctgcttcaaaatgtgccagttccacttggtaataacgttgggaaaatgcaggtttatgaatgatgtggacttttagaggatcaaatcaataaattggattttttattttttgagggcagctgccctcactgttttaaataaagaatcttacataagaatgttgacaacattcacagtaagccattggcagaaaattgatctgcatgtcctagaccaatgattacaaggtgtctgtggtttagggggcccagcccatcattccttttccccttggcactcatgagagagatgccaagttcagtgtggatttttcttggtgctctatggagaaatggagtctgtgtgcttactgaagagtcccaaaaaccagagaccattttcatttactgccatcataaatattctccaccattcaagatgcctgtgtacacggctatttgggaaacttaagtgttggaggaggcaggggctgaaggtgtcaaaacctcctcagtaggataacccctttctcccctttggaccatctgccatctttcatgagtgtttcccatggtgtttttgcatccagagttgacaacaactcaattttgccttgaatttactcagtcttataaattaaaaatgtgcattttatataaagatgcattttatataaaaatgcacacctttaatctctatatggcagcatatacatatatatatataaaatgcacacttttaatctctatatggcagcatttttgaggctttatatctgcccgtgtaccctcaactgcctcctttttgcagagaacgatccccacaggaactggtctaagaacactgtctgcacatgattgatgcttaaaatccaatataccaccacatatcaaaggttgggattttcagagtccttcttgatttctgagctgaaaccttaacaaatagggaatttggcagggaagacacctgggtttttaattcagaaccctatttatatactgttaaaatttgaggtactgtagtttatataaaagtcggatgttaagatattatatttcagtactaggagcttctttgcagtcattaacatgacaaattaagtaataaatataaaagtgattgtccataaattatcattgaattttttgtttattttgtagtgttctgtatttatctgcactttgtgtatatatacacacatacatatgccaacatgtaaataacctcatgtttattcctaatctaaattgccacaatatttttaatgtatggttacactgtgttttaaattactttaaaaataaactttgtaagc

SEQ ID NO: 7241 - DNA, 807 bp, Homo sapiens
cgcagatggcggcggcgcacggcgcctgagcgggccggggccatgagcgccgcccggccccagttcagcattgatgatgccttcgagctgtccctggaggacgggggccctgggcccgagtccagcggggtcgcgcgctttgggccgctgcacttcgagcgtcgggcccggttcgaggtggctgacgaggacaagcagtcccggctgcgctaccagaacctggagaacgatgaggatggagcccaggcctctccggagccggatgggggagtcggcaccagggattccagccgaacttccatccgcagctcccagtggtccttcagcaccatcagcagcagcacccagcgctcctacaacacctgctgcagctggacccaacaccctttgatccagaagaaccgccgagtggtgctggcctccttcctgctcctgctgctggggctggtgctgatcctggtcggcgtgggactggaggcgaccccctctccaggtgtctccagcgccatcttcttcgtgccgggcttcctgttgttggtgcctggagtctatcacgtgatcttcatctactgcgcggtcaagggccaccggggcttccagttcttctacctgccctacttcgagaagtgatcgcggcgcagcgtggaccccttgcgcccatgggggcgcccctcttgccctgttccgttcccctcatctcaagggaagaggccctccaggaccctcgaaaccccagcccctagggagtttgctcaggaagttcggggcatgcaggcctggccctgggaaagccgcccgtcgcctgct

SEQ ID NO: 7242 - DNA, 823 bp, Homo sapiens
acgctgggtgtgtgggcgcagatggcggcggcgcacggcgcctgagcgggccggggccatgagcgccgcccggccccagttcagcattgatgatgccttcgagctgtccctggaggacgggggccctgggcccgagtccagcggggtcgcgcgctttgggccgctgcacttcgagcgtcgggcccggttcgaggtggctgacgaggacaagcagtcccggctgcgctaccagaacctggagaacgatgaggatggagcccaggcctctccggagccggatgggggagtcggcaccagggattccagccgaacttccatccgcagctcccagtggtccttcagcaccatcagcagcagcacccagcgctcctacaacacctgctgcagctggacccaacaccctttgatccagaagaaccgccgagtggtgctggcctccttcctgctcctgctgctggggctgggtgtctccagcgccatcttcttcgtgccgggcttcctgttgttggtgcctggagtctatcacgtgatcttcatctactgcgcggtcaagggccaccggggcttccagttcttctacctgccctacttcgagaagtgatcgcggcgcagcgtggaccccttgcgcccatgggggcgcccctcttgccctgttccgttcccctcatctcaagggaagaggccctccaggaccctcgaaaccccagcccctagggagtttgctcaggaagttcggggcatgcaggcctggccctgggaaagccgcccgtcgcctgctctgtgccttaacttattctcgggccgtgcggctgctaggttgctg

SEQ ID NO: 7243 - DNA, 2433 bp, Homo sapiens
ggctctccccctcctgtcttctccgcgctgttcctcgtcatggcggccctcagcaagtccatccctcataactgctatgagatcggccacacttggcacccttcctgccgggtctccttcctgcagatcaccgggggcgccctggaggagtccctgaagatctatgctcctctgtacttgattgcagcaattctccggaaacggaaattagactattatttacacaaactactccctgagatcctacaatccgcttcatttctaactgctaatggggccttgtatatggctttcttttgcattttaaggaagatacttggaaaattctactcatggactcctggctttggtgccgctctgccagcatcttatgtggccattctcattgaaagaaaaagcaggagagggctgctcacaatttatatggccaacttggccacagaaacactattcagaatgggtgtagcaagaggaaccatcacaacattaagaaatggagaagtccttttgttttgcatcacagctgccatgtacatgttctttttcaggtgcaaggatggcttgaaaggatttacattttctgcacttaggttcattgtagggaaggaagaaattcccacacattctttttcaccagaggcagcatatgcaaaagtggaacaaaagagagagcaacatgaggaaaaacccggaagaatgaatatgattggtctagtcaggaaatttgtggattcaatatgcaaacatggaccaaggcatagatgttgcaaacattatgaagataattgcatctcttattgcattaaaggtttcatcagaatgtttagcgtggggtacttgatccagtgctgcctccgaatcccttctgcatttaggcatctgtttacacagccatctcggctactttctctcttctacaataaagaaaacttccagcttggagcttttcttggctcttttgttagtatatacaagggtactagttgcttcctgcgctggatcagaaacttagatgatgaactacatgctattatagctggatttttggcaggtatatcaatgatgttttataaaagcacaacaatttccatgtatttagcgtccaaattggtagagacaatgtatttcaaaggcattgaagcagggaaggttccctattttcctcatgcagatactatcatctattccatctctacagcaatttgcttccaggcagctgtcatggaagttcagactttgagaccatcttactggaagttccttttaagactcaccaagggcaaatttgctgtcatgaaccgaaaagtccttgatgtttttggtactggtgcatctaaacactttcaggatttcatccccaggttggatccaagatacacaactgtaacaccagagttgcccacagagttttcctgaagatgactgtaacttattaatgtgactaaatgtttcatcttgaagagttaattatgttgaacacaaaggagggggcccaagctcgaacttcagtgttatttcagttagagatactcttttcatttgttttgtttttcttatgaatcagaaattcagaagctttttaggaagatgttgcttaataattaagcttcctccatagccagaataagattctggatcactgtagtgactgacattatatattattgatcaaattatgtccacaagcaatattatataatctacgtagaagtgtaataacaaacaagagtacacttaaaattactttaaaagatgtctttagttcattccaatataattcttgattaaaattaggattatttctacattttaggatttacaaaggatcacgggtacatggatttggtctatatatttttttaaagttttgaattggtatctgtagtagtggaatgttatagatttgaagtaactctccacggacagtgctgctttcgtgtagagcaatttaattggagaagtggccattcttacttcagggatgcaaagatgggtctcataccatttggataaatgtcgtggtatccatgctttttttcaactaataacatcatctctcttcatgaccagttaattgggctatttggcagcccagtgaacctatgtactaatggcaagttaggggcaaatggaaatggacacatccgataaagttgaaatgtatgttttaatctttcacagaagtattacacttgaatatttaaaaacaaaacttttaaacttcctataggtttatgatgtttgttttcatttatatggacataatccttcatagctcagtttatatgccattgttgtattagaagggatcaaaatcctatggaacaaagtagtcttggcaagttggcagtttgtgtcctctcagctgtttaacttatgtaatggatgttttgcacctgaaaacactataaaaatccagtggttgtttaaaaa

SEQ ID NO: 7244 - DNA, 3894 bp, Homo sapiens
gtcccgcccccttgagctgcgatacgccgagcgctcaacatccgaggactttggcccagagtaaccccgctctcgtgacctttcccctccattccgcacctccgagtgctggccgggcgagaggctggcggctgggctctcgcgcccctccctgcagggctcaggctctccccctcctgtcttctccgcgctgttcctcgtcatggcggccctcagcaagtccatccctcataactgctatgagatcggccacacttggcacccttcctgccgggtctccttcctgcagatcaccgggggcgccctggaggagtccctgaagatctatgctcctctgtacttgattgcagcaattctccggaaacggaaattagactattatttacacaaactactccctgagatcctacaatccgcttcatttctaactgctaatggggccttgtatatggctttcttttgcattttaaggaagatacttggaaaattctactcatggactcctggctttggtgccgctctgccagcatcttatgtggccattctcattgaaagaaaaagcaggagagggctgctcacaatttatatggccaacttggtccttttgttttgcatcacagctgccatgtacatgttctttttcaggtgcaaggatggcttgaaaggatttacattttctgcacttaggttcattgtagggaaggaagaaattcccacacattctttttcaccagaggcagcatatgcaaaagtggaacaaaagagagagcaacatgaggaaaaacccggaagaatgaatatgattggtctagtcaggaaatttgtggattcaatatgcaaacatggaccaaggcatagatgttgcaaacattatgaagataattgcatctcttattgcattaaaggtttcatcagaatgtttagcgtggggtacttgatccagtgctgcctccgaatcccttctgcatttaggcatctgtttacacagccatctcggctactttctctcttctacaataaagaaaacttccagcttggagcttttcttggctcttttgttagtatatacaagggtactagttgcttcctgcgctggatcagaaacttagatgatgaactacatgctattatagctggatttttggcaggtatatcaatgatgttttataaaagcacaacaatttccatgtatttagcgtccaaattggtagagacaatgtatttcaaaggcattgaagcagggaaggttccctattttcctcatgcagatactatcatctattccatctctacagcaatttgcttccaggcagctgtcatggaagttcagactttgagaccatcttactggaagttccttttaagactcaccaagggcaaatttgctgtcatgaaccgaaaagtccttgatgtttttggtactggtgcatctaaacactttcaggatttcatccccaggttggatccaagatacacaactgtaacaccagagttgcccacagagttttcctgaagatgactgtaacttattaatgtgactaaatgtttcatcttgaagagttaattatgttgaacacaaaggagggggcccaagctcgaacttcagtgttatttcagttagagatactcttttcatttgttttgtttttcttatgaatcagaaattcagaagctttttaggaagatgttgcttaataattaagcttcctccatagccagaataagattctggatcactgtagtgactgacattatatattattgatcaaattatgtccacaagcaatattatataatctacgtagaagtgtaataacaaacaagagtacacttaaaattactttaaaagatgtctttagttcattccaatataattcttgattaaaattaggattatttctacattttaggatttacaaaggatcacgggtacatggatttggtctatatatttttttaaagttttgaattggtatctgtagtagtggaatgttatagatttgaagtaactctccacggacagtgctgctttcgtgtagagcaatttaattggagaagtggccattcttacttcagggatgcaaagatgggtctcataccatttggataaatgtcgtggtatccatgctttttttcaactaataacatcatctctcttcatgaccagttaattgggctatttggcagcccagtgaacctatgtactaatggcaagttaggggcaaatggaaatggacacatccgataaagttgaaatgtatgttttaatctttcacagaagtattacacttgaatatttaaaaacaaaacttttaaacttcctataggtttatgatgtttgttttcatttatatggacataatccttcatagctcagtttatatgccattgttgtattagaagggatcaaaatcctatggaacaaagtagtcttggcaagttggcagtttgtgtcctctcagctgtttaacttatgtaatggatgttttgcacctgaaaacactataaaaatccagtggttgtttaaaaagtccatttgtcactaattccattcaggttctccaaccttcttcttgaatatcattgtcaccatttttactgttagaataaagaggtgacaccataaagtcctgctgataatgagagtagttcaggacagctgtgattgaaatatggtcgctatttacagtttttcagggaaaagttatacttttctatgttaataaagagctgaagtggtctacagttaatgtgacatgtagggatgatgatatttttaaaatacattttgttgctaaaaagtttttaggccagtgcaaattatgcagtagaacttgtgttgcaaaaggaattataacccatactttaaaaatgcttaatccctcatattcaatttcatcaagccttgtatacttctgcttaaatgtaattcaatccttggttgttatggcaaacagaaacccaacaaaaagacagactctggtactatggtaacagagccactttatcatttggtcaaaatttggcattatgattagctttgtagaactgacctgtttatttggcaatgctgttaaaggatcatttcggtttcagacttcaaagttgattaataaatttaatcttaactttttattcactggaatcaaaacgatggttggtactgtgtttactgtttaaaatgaagtactaaagccctgagaactgcacctcattttctttatccagaaattgtgcttatatattttcctgtcaggtttaaaaagatgttttaattcataaattattgttttcattgacattaaaagactgtgatattgaaagatgaattacgaaatttgctgagattgtttagtaaaattttgctggtcaaaaaggtgtatttctacaatttaccttttcatttttataaattgcagtcatttttttaaattttatgtaaaatgtaaaatgaaatagctatcatgaagcagaatacaatgatgaatgtataggttgagtgaataaccaatttgcagtggtggattgagaagtccagtttgatttcattgggacagactgcaaagtgtagttgtttgagcaaacacaaagaaactttgtgtttttgaagacaatcagaatgattacctttctacctctaactaatcaggtattgattgacaactttttggcattataaataaagtaaaatagatctctgcattccaaaatatgttttttagtttatttatatcctgaagaaatggtaagttttcactggaactgattacagtaaacaataatatgtccccttagtctttctgacatttttatatagattgagattgaaaaaccgtgcatttggggcagtggtattatggtcatttcgttgctattttctgttttaataaaatc

SEQ ID NO: 7245 - DNA, 1325 bp, Homo sapiens
gcgcccctccctgcagggctcaggctctccccctcctgtcttctccgcgctgttcctcgtcatggcggccctcagcaagtccatccctcataactgctatgagatcggccacacttggcacccttcctgccgggtctccttcctgcagatcaccgggggcgccctggaggagtccctgaagatctatgctcctctgtacttgattgcagcaattctccggaaacggaaattagactattatttacacaaactactccctgagatcctacaatccgcttcatttctaactgctaatggggccttgtatatggctttcttttgcattttaaggaagatacttggaaaattctactcatggactcctggctttggtgccgctctgccagcatcttatgtggccattctcattgaaagaaaaagcaggagagggctgctcacaatttatatggccaacttgatggagtctcactgtcttccccaggctggagtgatttcagctccctgcagcctctgcctcccaggttcaagggattctcctgcctgagtctcctgagtagctgggactacaggggtgcaccattacacctggctaatttttgtatttttagtagagacgggatttcaccatgttggccaggtaagtcttgaactcctgacctcaagtgatctgcctgtctcggcctcccaaattgctgggattataggtgtgagccaccatgcctgtccaacataatgtttttgaggttcattcatatcagtactttttttttcccttttcatgactgaatagtattccattgtttggattacattttgtttatggacatattaattgaccatttggattatttccagttttcagttatgaaaattggagagaagtctttgggttgacatatgttttaatttctcttggcttgatacctaaatgtagaattgttaggtcataagaataatgcttaaaaaaaaagtagttccattttacattgccacttggcagtgtatgaggggtccagtttgtcagcatccttgccaacatttggtatgatcagactattttattatagccattctagaaatgtatggtaatttttatggtaattttcatttccctaatgactagtgatgttggacttcttttcatagtgcttattgggcatttgtatacattttgtgaaatgtctattaaattttcttgcccttttttcatggggtttattgtcttattactgaattgcaggaggtgactttgaaaagtttttcattttggatcaaatcttttattaaatataggatttgggaatatattttcccagatcgtggcc

SEQ ID NO: 7246 - DNA, 1502 bp, Homo sapiens
ctcgtcatggcggccctcagcaagtccatccctcataactgctatgagatcggccacacttggcacccttcctgccgggtctccttcctgcagatcaccgggggcgccctggaggagtccctgaagatctatgctcctctgtacttgattgcagcaattctccggaaacggaaattagactattatttacacaaactactccctgagatcctacaatccgcttcatttctaactgctaatggggccttgtatatggctttcttttgcattttaaggaagatacttggaaaattctactcatggactcctggctttggtgccgctctgccagcatcttatgtggccattctcattgaaagaaaaagcaggccacagaaacactattcagaatgggtgtagcaagaggaaccatcacaacattaagaaatggagaagtccttttgttttgcatcacagctgccatgtacatgttctttttcaggtgcaaggatggcttgaaaggatttacattttctgcacttaggttcattgtagggaaggaagaaattcccacacattctttttcaccagaggcagcatatgcaaaagtggaacaaaagagagagcaacatgaggaaaaacccggaagaatgaatatgattggtctagtcaggaaatttgtggattcaatatgcaaacatggaccaaggcatagatgttgcaaacattatgaagataattgcatctcttattgcattaaaggtttcatcagaatgtttagcgtggggtacttgatccagtgctgcctccgaatcccttctgcatttaggcatctgtttacacagccatctcggctactttctctcttctacaataaagaaaacttccagcttggagcttttcttggctcttttgttagtatatacaagggtactagttgcttcctgcgctggatcagaaacttagatgatgaactacatgctattatagctggatttttggcaggtatatcaatgatgttttataaaagcacaacaatttccatgtatttagcgtccaaattggtagagacaatgtatttcaaaggcattgaagcagggaaggttccctattttcctcatgcagatactatcatctattccatctctacagcaatttgcttccaggcagctgtcatggaagttcagactttgagaccatcttactggaagttccttttaagactcaccaagggcaaatttgctgtcatgaaccgaaaagtccttgatgtttttggtactggtgcatctaaacactttcaggatttcatccccaggttggatccaagatacacaactgtaacaccagagttgcccacagagttttcctgaagatgactgtaacttattaatgtgactaaatgtttcatcttgaagagttaattatgttgaacacaaaggagggggcccaagctcgaacttcagtgttatttcagttagagatactcttttcatttgttttgtttttcttatgaatcagaaatt

SEQ ID NO: 7247 - DNA, 1440 bp, Homo sapiens
cttgagctgcgatacgccgagcgctcaacatccgaggactttggcccagagtaaccccgctctcgtgacctttcccctccattccgcacctccgagtgctggccgggcgagaggctggcggctgggctctcgcgcccctccctgcagggctcaggctctccccctcctgtcttctccgcgctgttcctcgtcatggcggccctcagcaagtccatccctcacagctgccatgtacatgttctttttcaggtgcaaggatggcttgaaaggatttacattttctgcacttaggttcattgtagggaaggaagaaattcccacacattctttttcaccagaggcagcatatgcaaaagtggaacaaaagagagagcaacatgaggaaaaacccggaagaatgaatatgattggtctagtcaggaaatttgtggattcaatatgcaaacatggaccaaggcatagatgttgcaaacattatgaagataattgcatctcttattgcattaaaggtttcatcagaatgtttagcgtggggtacttgatccagtgctgcctccgaatcccttctgcatttaggcatctgtttacacagccatctcggctactttctctcttctacaataaagaaaacttccagcttggagcttttcttggctcttttgttagtatatacaagggtactagttgcttcctgcgctggatcagaaacttagatgatgaactacatgctattatagctggatttttggcaggtatatcaatgatgttttataaaagcacaacaatttccatgtatttagcgtccaaattggtagagacaatgtatttcaaaggcattgaagcagggaaggttccctattttcctcatgcagatactatcatctattccatctctacagcaatttgcttccaggcagctgtcatggaagttcagactttgagaccatcttactggaagttccttttaagactcaccaagggcaaatttgctgtcatgaaccgaaaagtccttgatgtttttggtactggtgcatctaaacactttcaggatttcatccccaggttggatccaagatacacaactgtaacaccagagttgcccacagagttttcctgaagatgactgtaacttattaatgtgactaaatgtttcatcttgaagagttaattatgttgaacacaaaggagggggcccaagctcgaacttcagtgttatttcagttagagatactcttttcatttgttttgtttttcttatgaatcagaaattcagaagctttttaggaagatgttgcttaataattaagcttcctccatagccagaataagattctggatcactgtagtgactgacattatatattattgatcaaattatgtccacaagcaatattatataatctacgtagaagtgtaataacaaacaagagtacacttaaa

SEQ ID NO: 7248 - DNA, 1434 bp, Homo sapiens
ttcctgttgccgcgatccgggccgggagctgcgggcgcccgggcgcccgaggcttcccggtgcgctccgccaggtcagtcatcgctagagggttattattgacatttactcatcataaaatgtgatgtcagcctaccagctcggagtgcagttcctggtttccagtttacaacattgaccagttgctaacatgttatctctgaggaacttggaatgataaatacagccatacttaaatagaagattcttggccgtgtagataaggaaaataagataaggcaatatttttgaactattctataatagaaatgaggatatatacacaaaatgacccagtgctgttttcttagggtgcatcctttgtttttctggttttggtcttttcatcacaggatggcattagctctgtgtctgcaggtgctgtgcagcctgtgtggctggctctcgctctatatttctttctgccacctgaataagcaccgaagctatgagtggagctgccgcctggtcaccttcacccatggagtcctctctataggcctctccgcttatattggcttcattgatggcccatggccttttacccacccaggctcacccaatacacctctccaagttcatgtcctgtgtctcaccttgggctacttcatcttcgacttgggctggtgcgtctactttcagtctgagggtgccttgatgctggctcatcacacattgagtatcttgggcattatcatggcccttgtgcttggggagtctggcacagaggtcaatgcagtcctctttggaagtgagcttaccaaccccttgctacagatgcgctggtttctccgggaaacagggcactatcacagtttcactggagatgtagtggacttcctctttgtggctctgttcacaggagtgaggattggtgtgggagcttgcctccttttctgtgaaatggtctcccccacgcctaagtggtttgtgaaggctgggggagtagcgatgtatgctgtgtcttggtgtttcatgtttagcatctggcgctttgcatggaggaagagcatcaagaagtaccatgcttggagaagcaggcggagtgaggaacggcagctgaaacacaacggacatctcaaaatacactagccaaggcttgctccagattatggattgggttaagtcagccatgggaaccaggttggaaatatgactgttacataattacacttataacaaacttaggtttcaataaagggctaaatgtattgatcaatttggtcagtcttcaagccgagcatataccagtattaaaacactaacttctacagtagcacagttgtagaaagtgagaatactccatggtagttgggaataagtgagaactgtgaagtgagtacaactggcatttgttttcatttgtggtgaccctgggtcctcctgtccctggga

SEQ ID NO: 7249 - DNA, 4143 bp, Homo sapiens
ctcttgacccccccgccagagaaggaggaccctcccgcgccctttcggagcgtcggtggcccggctccggctctgcgctccatcctcccagccagcaggtgcccccagacccccggctcctcctccgccgccgtcacagcctcgtcctccgcctctggctcctccgcttcctgttgccgcgatccgggccgggagctgcgggcgcccgggcgcccgaggcttcccggtgcgctccgccaggatggcattagctctgtgtctgcaggtgctgtgcagcctgtgtggctggctctcgctctatatttctttctgccacctgaataagcaccgaagctatgagtggagctgccgcctggtcaccttcacccatggagtcctctctataggcctctccgcttatattggcttcattgatggcccatggccttttacccacccaggctcacccaatacacctctccaagttcatgtcctgtgtctcaccttgggctacttcatcttcgacttgggctggtgcgtctactttcagtctgagggtgccttgatgctggctcatcacacattgagtatcttgggcattatcatggcccttgtgcttggggagtctggcacagaggtcaatgcagtcctctttggaagtgagcttaccaaccccttgctacagatgcgctggtttctccgggaaacagggcactatcacagtttcactggagatgtagtggacttcctctttgtggctctgttcacaggagtgaggattggtgtgggagcttgcctccttttctgtgaaatggtctcccccacgcctaagtggtttgtgaaggctgggggagtagcgatgtatgctgtgtcttggtgtttcatgtttagcatctggcgctttgcatggaggaagagcatcaagaagtaccatgcttggagaagcaggcggagtgaggaacggcagctgaaacacaacggacatctcaaaatacactagccaaggcttgctccagattatggattgggttaagtcagccatgggaaccaggttggaaatatgactgttacataattacacttataacaaacttaggtttcaataaagggctaaatgtattgatcaatttggtcagtcttcaagccgagcatataccagtattaaaacactaacttctacagtagcacagttgtagaaagtgagaatactccatggtagttgggaataagtgagaactgtgaagtgagtacaactggcatttgttttcatttgtggtgaccctgggtcctcctgtccctgggaggtttgatgttcaggcagtttagaaaggaactcgaaaaagattagtgctatttcttgttcctttgagaagtaactctttcaataaacacttatttctgctttccatatagcaatttatctaagtttaccccatttactataaagtgaggggcttacaggaagagacacgcctttgacattctgaacattagatcggggaattgggtcgcttaaacagaggggcataggagggtgagagtgaaactggcagtgagggggagggctacttactgaacctcctataccaactgtgccagaggtgcccaagaccactgccaggttctgtaattctctgggaagactcagtggactcagcatatagtcttacttatagttttgatttattatagtgaaaagatacaaagaaaaatcggtaaaaggaaaaggcacctgagacaaagtctagggtaaagcaagcacaagtttccagagtcctctcccaatggaatcacacaggatgcacttaattcccctagcagtgatttgttacgacatgtgaatgagttgtctactggacaaggtcactacagactcagtgcccaaagtttttactgaggacaggtcatctaggcaggctttccctggcagatagcaaaattcaagactctcaaaaggaaagcaggtgttcagcataagccatattgtttgcacaagcagttcagacacagtaagccagtcttatcagttaattgtgggagcccctccaaaatctaagttcccaaatgccggccagtggccaaccctgtaatcaggcctctccaaggatagcagtttaggcctgctatgttaactcttttctgcacaaaacctatagagttagggctttggatctgagatgaatgaagtgtgggtagatttactgagtcctgttatatgggttctgccctaccaggaaaactatgccagttctcagggcttttgtgcattaatctcctaggcatttgaggctatgactaaattccatagggatttatcatgtggattccactgtgcttgagatggcagtttagatttcagctctgctgtacatattgcaaactagagccaaagactttaaagtgtgtactggcctcagggggatgaggttaatttttttttttcattttagatactttcccttttagtactcctcctacttttcttatttttactaaaaaggtaccactctatgaacaaactaataaaacaaggccagtcttggaaggaaaaaaataataattcttagtgtgacagtctccaagagaagcaagaatataagcttagaacaaggggttaagaatccagaattcctgggttcttttaactaattttgctactcacttgccactttggagagctactcactcactttggataggttacttgtttcttctttgcctgagtttaaacctattgtgaatgaatgaaataccctgtagtatatttcataaatacattatgtggcattttattaatggaggtctttaatgtagggcttttatggaaatatgaagtatttatgtatttattgattatttatttttaccatgttattgaagtcaatggtgtttgattagctcagtgggtgagcaagcatatggtgctactggagtcaaggctggtcagtaggaagcatcagtccattccatggccactggtaatctaacgtaatgaatggtgtcttttgttgttgttgttgttgttgttgttgtttgagacagagtcttgctctgtcgcccaggctggagtgcagtggtgtgatctcaactcactgcaacctccgccttctgtgttcaagtgattctcctgcctcagcctcccgagtagctgggactacaggcgtgtgccaccatgcctggctactttttgtatttttagtagagacggggtttcaccatgttggccaggctggtcttgaactcctgacttcatgacccacccgcctcggcctcccaaagtgctgggattacaggtgtgagccaccgtgcccagccatgagcggtcttgaaaatgaaaaatggtcttggccacagaaaccaggtatgagggagtggttggaatggtataaagtcatcactgttagggaaacagtaactttaaatgcatgttaacagtgggtctttaaaaatgaatgtcatttggttaaagagttttgctgggcattgagataatctgacagcatctccacttcctgttttttttcttaatctccactttttttttttctatgatgagcgcccctaaaatgctggtaagcttctttccaacaaaattgcggtcaaagtaggatgctggggaatgctgattttagcaaaagcttgtagaaaagagtggcctggcacatgagcttaaaaaaaagaaaaaaagctggctcttgaattttggcacagtgcaacctgttccataccagacaaatgaacaggcttaatctggtaccaattctttttctctcttactcctcagaagtgaagggactgcagatcttgttgttttggggacactttcatggaactgtatgtaggtttttttgaatggtgagaaatctgaataattggtaaggggaagggaatccctcatttcagcttttcttgatgttgttactaataactatgaaaaaacttctgagagaacaatgtgaactgaagatgactcagcagttaagacaatgctaagttctgaaaccacaggtaaatgaagggctaattaatgtgtggtatacttggacaaaatgaagtactcatttgcactggattactgtgtaatgataacgaacactgttcaagaacgatttatatttccataagatttgtactaaattttataaaagtaaaacaactttttat

SEQ ID NO: 7250 - DNA, 3930 bp, Homo sapiens
gcgatccgggccgggagctgcgggcgcccgggcgcccgaggcttcccggtgcgctccgccaggtcagtcatcgctagagggttattattgacatttactcatcataaaatgtgatgtcagcctaccagctcggagtgcagttcctggtttccagtttacaacattgaccagttgctaacatgttatctctgaggaacttggaatgataaatacagccatacttaaatagaagattcttggccgtgtagataaggaaaataagataaggcaatatttttgaactattctataatagaaatgaggatatatacacaaaatgacccagtgctgttttcttagggtgcatcctttgtttttctggttttggtcttttcatcacaggatggcattagctctgtgtctgcaggtgctgtgcagcctgtgtggctggctctcgctctatatttctttctgccacctgaataagcaccgaagctatgagtggagctgccgcctggtcaccttcacccatggagtcctctctataggcctctccgcttatattggcttcattgatggcccatggccttttacccacccaggctcacccaatacacctctccaagttcatgtcctgtgtctcaccttgggctacttcatcttcgacttgggctgcatctggcgctttgcatggaggaagagcatcaagaagtaccatgcttggagaagcaggcggagtgaggaacggcagctgaaacacaacggacatctcaaaatacactagccaaggcttgctccagattatggattgggttaagtcagccatgggaaccaggttggaaatatgactgttacataattacacttataacaaacttaggtttcaataaagggctaaatgtattgatcaatttggtcagtcttcaagccgagcatataccagtattaaaacactaacttctacagtagcacagttgtagaaagtgagaatactccatggtagttgggaataagtgagaactgtgaagtgagtacaactggcatttgttttcatttgtggtgaccctgggtcctcctgtccctgggaggtttgatgttcaggcagtttagaaaggaactcgaaaaagattagtgctatttcttgttcctttgagaagtaactctttcaataaacacttatttctgctttccatatagcaatttatctaagtttaccccatttactataaagtgaggggcttacaggaagagacacgcctttgacattctgaacattagatcggggaattgggtcgcttaaacagaggggcataggagggtgagagtgaaactggcagtgagggggagggctacttactgaacctcctataccaactgtgccagaggtgcccaagaccactgccaggttctgtaattctctgggaagactcagtggactcagcatatagtcttacttatagttttgatttattatagtgaaaagatacaaagaaaaatcggtaaaaggaaaaggcacctgagacaaagtctagggtaaagcaagcacaagtttccagagtcctctcccaatggaatcacacaggatgcacttaattcccctagcagtgatttgttacgacatgtgaatgagttgtctactggacaaggtcactacagactcagtgcccaaagtttttactgaggacaggtcatctaggcaggctttccctggcagatagcaaaattcaagactctcaaaaggaaagcaggtgttcagcataagccatattgtttgcacaagcagttcagacacagtaagccagtcttatcagttaattgtgggagcccctccaaaatctaagttcccaaatgccggccagtggccaaccctgtaatcaggcctctccaaggatagcagtttaggcctgctatgttaactcttttctgcacaaaacctatagagttagggctttggatctgagatgaatgaagtgtgggtagatttactgagtcctgttatatgggttctgccctaccaggaaaactatgccagttctcagggcttttgtgcattaatctcctaggcatttgaggctatgactaaattccatagggatttatcatgtggattccactgtgcttgagatggcagtttagatttcagctctgctgtacatattgcaaactagagccaaagactttaaagtgtgtactggcctcagggggatgaggttaatttttttttttcattttagatactttcccttttagtactcctcctacttttcttatttttactaaaaaggtaccactctatgaacaaactaataaaacaaggccagtcttggaaggaaaaaaataataattcttagtgtgacagtctccaagagaagcaagaatataagcttagaacaaggggttaagaatccagaattcctgggttcttttaactaattttgctactcacttgccactttggagagctactcactcactttggataggttacttgtttcttctttgcctgagtttaaacctattgtgaatgaatgaaataccctgtagtatatttcataaatacattatgtggcattttattaatggaggtctttaatgtagggcttttatggaaatatgaagtatttatgtatttattgattatttatttttaccatgttattgaagtcaatggtgtttgattagctcagtgggtgagcaagcatatggtgctactggagtcaaggctggtcagtaggaagcatcagtccattccatggccactggtaatctaacgtaatgaatggtgtcttttgttgttgttgttgttgttgttgttgtttgagacagagtcttgctctgtcgcccaggctggagtgcagtggtgtgatctcaactcactgcaacctccgccttctgtgttcaagtgattctcctgcctcagcctcccgagtagctgggactacaggcgtgtgccaccatgcctggctactttttgtatttttagtagagacggggtttcaccatgttggccaggctggtcttgaactcctgacttcatgacccacccgcctcggcctcccaaagtgctgggattacaggtgtgagccaccgtgcccagccatgagcggtcttgaaaatgaaaaatggtcttggccacagaaaccaggtatgagggagtggttggaatggtataaagtcatcactgttagggaaacagtaactttaaatgcatgttaacagtgggtctttaaaaatgaatgtcatttggttaaagagttttgctgggcattgagataatctgacagcatctccacttcctgttttttttcttaatctccactttttttttttctatgatgagcgcccctaaaatgctggtaagcttctttccaacaaaattgcggtcaaagtaggatgctggggaatgctgattttagcaaaagcttgtagaaaagagtggcctggcacatgagcttaaaaaaaagaaaaaaagctggctcttgaattttggcacagtgcaacctgttccataccagacaaatgaacaggcttaatctggtaccaattctttttctctcttactcctcagaagtgaagggactgcagatcttgttgttttggggacactttcatggaactgtatgtaggtttttttgaatggtgagaaatctgaataattggtaaggggaagggaatccctcatttcagcttttcttgatgttgttactaataactatgaaaaaacttctgagagaacaatgtgaactgaagatgactcagcagttaagacaatgctaagttctgaaaccacaggtaaatgaagggctaattaatgtgtggtatacttggacaaaatgaagtactcatttgcactggattactgtgtaatgataacgaacactgttcaagaacgatttatatttccataagatttgtactaaattttataaaagtaaaacaactttttataaa

SEQ ID NO: 7251 - DNA, 2383 bp, Homo sapiens
tactttctacagtctgtggagacaggtgagcgacgaacttctgagacaggtgtgggtgcgagggtcgggagggtcatgggattgggaccgaggtgtgaggagggaatctgcaattccttgctacacagagcgctggcaacttctgacaggctgtttctggggtatgggctgcctcgggttgttgctgttacaaggaaagaaaagagttcccctgcccaccgcctcccagccactgggctacctcctggcaggaaatttgcaaactgagtttaacaagttaggatcagcagagggtagaggagggccctggcagatgtggggtctagaagaggacaggagttatcagggcctccggccattgtgctgggcctttgcctgtacaattgtttctcaagcagttgtgtccctgtggctttggtgcgcctgtgtgcactttctccctccacctggagcatgggctaacaccggaggaaaggaaaagacagagtcagacagggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggaatgggggcttcggtcccagctccaatcaatgcagactgagagcccagggccctcaggcaatgcacgggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtcttctggcaacatttggtgacctaccccatatccaatatttccagcgttagattgaggatgaggtagggaggtgatccagagaaggcggagaaggaagaagtaacctctgagtggcggctattgcttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaactcctgatcccaaagcctattgtgttttcaacacaaggtaataggaagccaagcaacttgcatgtctcccaatccctgtctagggacagctgctggtgcaggatggaagacttcctataaacagaatgggcgaccaattgtgtctacagagggggtgggctgagcatgggcacgcatgtccccagcctcctggacgagcaaagtcagtcaaagcgctggtgatccctgctccgcgtgcgtagcagtgtctgtgcctctcctgcccaggggctagagagcagtctccagtgcagggtccccatcctatctgaaaacagtggagtcagtgaccccaggtggagggacttccagttttaacaatgggttggtatgaaggccagaaggagtgaaacatgtgaactttctggcgaggagactccctcttgaatcatccatatgtagccccggggtcacttgcgaagagtctctaacagcttctgcctcactcctaagctctgaccgctaggctttcaccccagccgccggtcctgattcctgagatcccaatattgagcaccaggtttcctggaattgtgtgctgcggctgtgatgtaggtttcggtcgctggaagctgctaaaccatagctgacgccccctcctaagccagccttccttccccgcgcgggcatctgtccagggccttgtcgcgctctcagtctccttcgcagcctggccccaaccgttcaacttcaataaagcaaaactccagcca

SEQ ID NO: 7252 - DNA, 1226 bp, Homo sapiens
atgaaagtgataatcaggcagcccaaatgattgttaataaggatcaaatgagatcgtgtatgtgggtccaatcaattgattctacacaaaggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggaatgggggcttcggtcccagctccaatcaatgcagactgagagcccagggccctcaggcaatgcacgggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtcttctggcaacatttggtgacctaccccatatccaatatttccagcgttagattgaggatgaggtagggaggtgatccagagaaggcggagaaggaagaagtaacctctgagtggcggctattgcttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaa

SEQ ID NO: 7253 - DNA, 1257 bp, Homo sapiens
actttctacagtctgtggagacagttgtgtccctgtggctttggtgcgcctgtgtgcactttctccctccacctggagcatgggctaacaccggaggaaaggaaaagacagagtcagacagggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggaatgggggcttcggtcccagctccaatcaatgcagactgagagcccagggccctcaggcaatgcacgggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtcttctggcaacatttggtgacctaccccatatccaatatttccagcgttagattgaggatgaggtagggaggtgatccagagaaggcggagaaggaagaagtaacctctgagtggcggctattgcttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaa

SEQ ID NO: 7254 - DNA, 1907 bp, Homo sapiens
ttctacagtctgtggagacaggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggaatgggggcttcggtcccagctccaatcaatgcagactgagagcccagggccctcaggcaatgcacgggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtcttctggcaacatttggtgacctaccccatatccaatatttccagcgttagattgaggatgaggtagggaggtgatccagagaaggcggagaaggaagaagtaacctctgagtggcggctattgcttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaactcctgatcccaaagcctattgtgttttcaacacaaggtaataggaagccaagcaacttgcatgtctcccaatccctgtctagggacagctgctggtgcaggatggaagacttcctataaacagaatgggcgaccaattgtgtctacagagggggtgggctgagcatgggcacgcatgtccccagcctcctggacgagcaaagtcagtcaaagcgctggtgatccctgctccgcgtgcgtagcagtgtctgtgcctctcctgcccaggggctagagagcagtctccagtgcagggtccccatcctatctgaaaacagtggagtcagtgaccccaggtggagggacttccagttttaacaatgggttggtatgaaggccagaaggagtgaaacatgtgaactttctggcgaggagactccctcttgaatcatccatatgtagccccggggtcacttgcgaagagtctctaacagcttctgcctcactcctaagctctgaccgctaggctttcaccccagccgccggtcctgattcctgagatcccaatattgagcaccaggtttcctggaattgtgtgctgcggctgtgatgtaggtttcggtcgctggaagctgctaaaccatagctgacgccccctcctaagccagccttccttccccgcgcgggcatctgtccagggccttgtcgcgctctcagtctccttcgcagcctggccccaaccgttcaacttcaataaagcaaaactccagcc

SEQ ID NO: 7255 - DNA, 2114 bp, Homo sapiens
tacagtctgtggagacaggtgagcgacgaacttctgagacagttgtgtccctgtggctttggtgcgcctgtgtgcactttctccctccacctggagcatgggctaacaccggaggaaaggaaaagacagagtcagacaggggcctgccccatcacctgaattccagagatgccagtgtgcactgaagccccaggcagggcgtgcccaggaccggatcctggatggtggagcctggggaggggccatggtgccaatgcacttactggggagactggagaagccgcttctcctcctgtgctgcgcctccttcctactggggctggctttgctgggcataaagacggacatcacccccgttgcttatttctttctcacattgggtggcttcttcttgtttgcctatctcctggtccggtttctggaatgggggcttcggtcccagctccaatcaatgcagactgagagcccagggccctcaggcaatgcacgggacaatgaagcctttgaagtgccagtctatgaagaggccgtggtgggactagaatcccagtgccgcccccaagagttggaccaaccacccccctacagcactgttgtgatacccccagcacctgaggaggaacaacctagccatccagaggggtccaggagagccaaactggaacagaggcgaatggcctcagaggggtccatggcccaggaaggaagccctggaagagctccaatcaaccttcggcttcggggaccacgggctgtgtccactgctcctgatctgcagagcttggcggcagtccccacattagagcctctgactccaccccctgcctatgatgtctgctttggtcaccctgatgatgatagtgttttttatgaggacaactgggcacccccttaaatgactctcccaagatttctcttctctccacaccagacctcgttcatttgactaacattttccagcgcctactatgtgtcagaaacaagtgtttctgcctggacatcataaatggggacttggaccctgaggagagtcaggccacggtaagcccttcccagctgagatatgggtggcataatttgagtcttctggcaacatttggtgacctaccccatatccaatatttccagcgttagattgaggatgaggtagggaggtgatccagagaaggcggagaaggaagaagtaacctctgagtggcggctattgcttctgttccaggtgctgttcgagctgttagaacccttaggcttgacagctttgtgagttattattgaaaaatgaggattccaagagtcagaggagtttgataatgtgcacgagggcacactgctagtaaataacattaaaataactggaatgaactcctgatcccaaagcctattgtgttttcaacacaaggtaataggaagccaagcaacttgcatgtctcccaatccctgtctagggacagctgctggtgcaggatggaagacttcctataaacagaatgggcgaccaattgtgtctacagagggggtgggctgagcatgggcacgcatgtccccagcctcctggacgagcaaagtcagtcaaagcgctggtgatccctgctccgcgtgcgtagcagtgtctgtgcctctcctgcccaggggctagagagcagtctccagtgcagggtccccatcctatctgaaaacagtggagtcagtgaccccaggtggagggacttccagttttaacaatgggttggtatgaaggccagaaggagtgaaacatgtgaactttctggcgaggagactccctcttgaatcatccatatgtagccccggggtcacttgcgaagagtctctaacagcttctgcctcactcctaagctctgaccgctaggctttcaccccagccgccggtcctgattcctgagatcccaatattgagcaccaggtttcctggaattgtgtgctgcggctgtgatgtaggtttcggtcgctggaagctgctaaaccatagctgacgccccctcctaagccagccttccttccccgcgcgggcatctgtccagggccttgtcgcgctctcagtctccttcgcagcctggccccaaccgttcaacttcaataaagcaaaactccagcca

SEQ ID NO: 7256 - DNA, 1680 bp, Homo sapiens
agagagctgtttactaggcacgactgcgaaggcaagggggcaccagctcaggactgcatctgcctgccatttcccttccactcctcctttctggagtctgacattagaaagccagcgagaaggaagattcaaacaaccaaccctgatttcctgcttctccttttcatgagtgttcctgtggtctctgcacctcctttctgtcccccggcagagggcagtagagatggccggcccaaggcctcggtggcgcgaccagctgctgttcatgagcatcatagtcctcgtgattgtggtcatctgcctgatgttttacgctcttctctgggaggctggcaacctcactgacctgcccaacctgagaatcggcttctataacttctgcctgtggaatgaggacaccagcaccctacagtgtcaccagttccctgagctggaagccctgggggtgcctcgggttggcctgggcctggccaggcttggcgtgtacgggtccctggtcctcaccctctttgccccccagcctctcctcctagcccagtgcaacagtgatgagagagcgtggcggctggcagtgggcttcctggctgtgtcctctgtgctgctggcaggcggcctgggcctcttcctctcctatgtgtggaagtgggtcaggctctccctcccggggcctgggtttctagctctgggcagcgcccaggccttactcatcctcttgcttatagccatggctgtgttccctctgagggctgagagggctgagagcaagcttgagagctgctaaaggcttacgtgattgcaagggttcagttccaaccatggtcagaggtggcacatctgctcagccatctcattttacagctaacgctgatctccagctccagcgatggaacccactacagaggaggtggggcccctgtgtcaaagaggccgaggggcagcaagggcagccagggcacctgtgacttcttagtacaagattgtctgtccttcaggacttccaaggctcccaaagactccctaaaccatgcagctcattgtcacaccaattcctgctttaattaatggatctgagcaaatcttcctctagcttcaggagggtggggagggagtgattgctgtcatggggccagacttccaggctgatttgccaaatgccaaaatgaaacctagcaaagaacttacggcaacaaacgaggacattaaaagagcgagcacctcagtgtctctggggacatggttaaggagcttccactcagcccaccatagtgagtgggccgccataagccatcactggaactccaaccccagaggtccaggagtgatctctgagtgactcaacaaagacaggacacatggggtacaaagacaaggcttgactgcttcaaagcttccctggacctgaagccagacagggcagaggcgtccgctgacaaatcactcccatgatgagaccctggaggactccaaatcctcgctgtgaacaggactggacggctgcacacaaacaaacgctgccaccctccacttcccaacccagaacttggaaagacattagcacaacttacgcattggggaattgtgtgtattttctagcacttgtgtattggaaaacctgtatggcagtgatttattcatatattcctgtccaaagccacactgaaaacagaggcagagacatgt

SEQ ID NO: 7257 - DNA, 447 bp, Homo sapiens
atggccggcccaaggcctcggtggcgcgaccagctgctgttcatgagcatcatagtcctcgtgattgtggtcatctgcctgatgttttacgctcttctctgggaggctggcaacctcactgacctgcccaacctgagaatcggcttctataacttctgcctgtggaatgaggacaccagcaccctacagtgtcaccagttccctgagctggaagccctgggggtgcctcgggttggcctgggcctggccaggcttggcgtgtacgggtccctggtcctcaccctctttttcctctcctatgtgtggaagtgggtcaggctctccctcccggggcctgggtttctagctctgggcagcgcccaggccttactcatcctcttgcttatagccatggctgtgttccctctgagggctgagagggctgagagcaagcttgagagctgctaa

SEQ ID NO: 7258 - DNA, 768 bp, Homo sapiens
ccgagccctgccaaccatggtgaacttgggtctgtcccgggtggacgacgccgtggctgccaagcacccgggactcggggagtatgccgcatgccagtcacacgccttcatgaagggcgttttcaccttcgtcacaggcaccggcatggcctttggcttgcagatgttcattcagaggaagtttccataccctttgcagtggagcctcctagtggccgtggttgcaggctctgtggtcagctacggggtgacgagagtggagtcggagaaatgcaacaacctctggctcttcctggagaccgggcagctccccaaagacaggagcacagatcagagaagctaggagagctccagcaggggcacagaggattgggggcaggaggagtctggaacacagccttcatgccccctgaccccaggccgaccctccccacaccctagggtaccccagtcgtatcctctgtccgcatgtgtggccaggcctgacaaacacctgcagatggctgctgccccaacctgggacctgcccaggaggttggagcagaaagggctctccctggggtggtgtttctcctctagggtattgggatgcatgttctgcactgccagcagagagggtgtgtctgggggccaccacctatgggacacggggtcgaaggggcctgtacactctgtcatttcctttctagcccctgcatctccaacaagtccaaggtgacagctggtgctaggggcgtggggttaataaatggcttatccttctctcca

SEQ ID NO: 7259 - DNA, 2263 bp, Homo sapiens
gcacatgcgcaggaggctcaatgacagtcgagctttggctaaggctccggggaaagggtctagccatgctgcatgtgacccggggggtctgggggtccagggtccgagtatggccactgttgcccgcgctcctcgggcccccccgggccctctcatcgctggcagccaaaatgggggagtatcgcaagatgtggaaccccagggagccccgcgactgggcccagcagtaccgcgagcgcttcattcccttctccaaggagcagctgctccgcctcctaatacaggaattccactcgagtccggcagagaaggcggctttggaggcgttctcggcccacgtggacttctgcaccctgttccactaccaccaaatcctggcccggctgcaggccttatatgaccccatcaaccctgacagggagaccctcgatcagccatcactaacggatccccagcgtctgtctaatgagcaggaggtgcttcgggctctggagcccctgctggcccaggccaacttctccccgctgtctgaggacaccctggcctacgcgctggtggtccaccaccctcaggatgaggtccaggtgacagtaaatttggatcagtatgtctacattcacttctgggccctgggccagcgagtcgggcagatgcccctgaagtccagcgtgggctccaggcgtggcttcttcaccaagctgccccctgcggagaggagatactttaagcgggtggtcctggcagcccggaccaaacggggacacctggtactgaagagtttcaaggacacgccgctggaaggcctggagcagctgctgccggagctgaaggtgcgcacgcccaccctgcagcgcgccctgctcaacctcatgctggtagtctccggcgtggcgatcttcgtcaacgtgggcatggtggtgctaaccgacctcaaggtggccacctccctgctgctgctgctcttcgccatcttcatgggcctgcgggcctccaagatgttcgggcagcggcgcagcgcgcaggcgttggagctggcgcacatgctgtactatcgcagtacgtccaacaactcggagctgctcagcgccctggccctgcgcgcgcaggacgagcacaccaaggaggcgctgctggctcacagcttcctggcccggcggccagggggcactcaaggctcgcccgaagagacctccaggtggctccggtcggaggtggagaactggctcctagccaagtcaggctgtgaggtgaccttcaacggaactcgggccctggcgcatctgcaggccctgacccccagcatgggattgtacccacccccgggtttccccaaactagacccagtggctccgatcacttccgagcccccgcaagccacgcccagcagtaacatctcctgagtagaacctacctccctgcccagtcagcaggctaggaactaagccccgcctccttcacgacaggctgtcaattacggttattatacttttcactccaacttccaataactgacaggtgattatttttgctgcactgtgtgcttaagcaaagcagccaatcaaagcagctagcagttgttaagtcttccccgccccttcgatgaacagccaatcaaagcgatttagctctgcttctgttccatttcttagtcccaccctcaccataaacatccaagtgtggtttggctgaggagctgagggtgtctgccaatcacagctgctcagctctggcttctgtaaaccgccaggtagaagagttaaagctgcgccctcccgagactatatatcattgtctttttcagcccgctccgggcaaactgcccatcatgtgcaccaaggccgttagccctgcctcctggcaaacgtccagtgacagctgctgggttccatcaactttgggcagccggttgtcgctgcagggaaggaaccaataagaatttctaaaggaaacctgatcttgctatcaattgctgctgcttaaatggcaggccaactggtcagctgctgatcagggtgtctaggctgaaggagttggagaccttgtgctaggtaggtgaaccagaaaccaccctcgccaccaagactcgctcccaacctggctcccggcaacctcaggtgccttcctcgcccaggtctttcaccctttctacagaaactacctcggtctggatctccccaccaccagcagcctgtgcaatatttattggtctatcaatttctcccgtctcctgtcccaaagtaataaatcatgtttaataagtctg

SEQ ID NO: 7260 - DNA, 1963 bp, Homo sapiens
gcacatgcgcaggaggctcaatgacagtcgagctttggctaaggctccggggaaagggtctagccatgctgcatgtgacccggggggtctgggggtccagggtccgagtatggccactgttgcccgcgctcctcgggcccccccgggccctctcatcgctggcagccaaaatgggggagtatcgcaagatgtggaaccccagggagccccgcgactgggcccagcagtaccgcgagcgcttcattcccttctccaaggagcagctgctccgcctcctaatacaggtgacagtaaatttggatcagtatgtctacattcacttctgggccctgggccagcgagtcgggcagatgcccctgaagtccagcgtgggctccaggcgtggcttcttcaccaagctgccccctgcggagaggagatactttaagcgggtggtcctggcagcccggaccaaacggggacacctggtactgaagagtttcaaggacacgccgctggaaggcctggagcagctgctgccggagctgaaggtgcgcacgcccaccctgcagcgcgccctgctcaacctcatgctggtagtctccggcgtggcgatcttcgtcaacgtgggcatggtggtgctaaccgacctcaaggtggccacctccctgctgctgctgctcttcgccatcttcatgggcctgcgggcctccaagatgttcgggcagcggcgcagcgcgcaggcgttggagctggcgcacatgctgtactatcgcagtacgtccaacaactcggagctgctcagcgccctggccctgcgcgcgcaggacgagcacaccaaggaggcgctgctggctcacagcttcctggcccggcggccagggggcactcaaggctcgcccgaagagacctccaggtggctccggtcggaggtggagaactggctcctagccaagtcaggctgtgaggtgaccttcaacggaactcgggccctggcgcatctgcaggccctgacccccagcatgggattgtacccacccccgggtttccccaaactagacccagtggctccgatcacttccgagcccccgcaagccacgcccagcagtaacatctcctgagtagaacctacctccctgcccagtcagcaggctaggaactaagccccgcctccttcacgacaggctgtcaattacggttattatacttttcactccaacttccaataactgacaggtgattatttttgctgcactgtgtgcttaagcaaagcagccaatcaaagcagctagcagttgttaagtcttccccgccccttcgatgaacagccaatcaaagcgatttagctctgcttctgttccatttcttagtcccaccctcaccataaacatccaagtgtggtttggctgaggagctgagggtgtctgccaatcacagctgctcagctctggcttctgtaaaccgccaggtagaagagttaaagctgcgccctcccgagactatatatcattgtctttttcagcccgctccgggcaaactgcccatcatgtgcaccaaggccgttagccctgcctcctggcaaacgtccagtgacagctgctgggttccatcaactttgggcagccggttgtcgctgcagggaaggaaccaataagaatttctaaaggaaacctgatcttgctatcaattgctgctgcttaaatggcaggccaactggtcagctgctgatcagggtgtctaggctgaaggagttggagaccttgtgctaggtaggtgaaccagaaaccaccctcgccaccaagactcgctcccaacctggctcccggcaacctcaggtgccttcctcgcccaggtctttcaccctttctacagaaactacctcggtctggatctccccaccaccagcagcctgtgcaatatttattggtctatcaatttctcccgtctcctgtcccaaagtaataaatcatgtttaataagtctg

SEQ ID NO: 7261 - DNA, 2156 bp, Homo sapiens
acatgcgcaggaggctcaatgacagtcgagctttggctaaggctccggggaaagggtctagccatgctgcatgtgacccggggggtctgggggtccagggtccgagtatggccactgttgcccgcgctcctcgggcccccccgggccctctcatcgctggcagccaaaatgggggagtatcgcaagatgtggaaccccagggagccccgcgactgggcccagcagtaccgcgagcgcttcattcccttctccaaggagcagctgctccgcctcctaatacaggccttatatgaccccatcaaccctgacagggagaccctcgatcagccatcactaacggatccccagcgtctgtctaatgagcaggaggtgcttcgggctctggagcccctgctggcccaggccaacttctccccgctgtctgaggacaccctggcctacgcgctggtggtccaccaccctcaggatgaggtccaggtgacagtaaatttggatcagtatgtctacattcacttctgggccctgggccagcgagtcgggcagatgcccctgaagtccagcgtgggctccaggcgtggcttcttcaccaagctgccccctgcggagaggagatactttaagcgggtggtcctggcagcccggaccaaacggggacacctggtactgaagagtttcaaggacacgccgctggaaggcctggagcagctgctgccggagctgaaggtgcgcacgcccaccctgcagcgcgccctgctcaacctcatgctggtagtctccggcgtggcgatcttcgtcaacgtgggcatggtggtgctaaccgacctcaaggtggccacctccctgctgctgctgctcttcgccatcttcatgggcctgcgggcctccaagatgttcgggcagcggcgcagcgcgcaggcgttggagctggcgcacatgctgtactatcgcagtacgtccaacaactcggagctgctcagcgccctggccctgcgcgcgcaggacgagcacaccaaggaggcgctgctggctcacagcttcctggcccggcggccagggggcactcaaggctcgcccgaagagacctccaggtggctccggtcggaggtggagaactggctcctagccaagtcaggctgtgaggtgaccttcaacggaactcgggccctggcgcatctgcaggccctgacccccagcatgggattgtacccacccccgggtttccccaaactagacccagtggctccgatcacttccgagcccccgcaagccacgcccagcagtaacatctcctgagtagaacctacctccctgcccagtcagcaggctaggaactaagccccgcctccttcacgacaggctgtcaattacggttattatacttttcactccaacttccaataactgacaggtgattatttttgctgcactgtgtgcttaagcaaagcagccaatcaaagcagctagcagttgttaagtcttccccgccccttcgatgaacagccaatcaaagcgatttagctctgcttctgttccatttcttagtcccaccctcaccataaacatccaagtgtggtttggctgaggagctgagggtgtctgccaatcacagctgctcagctctggcttctgtaaaccgccaggtagaagagttaaagctgcgccctcccgagactatatatcattgtctttttcagcccgctccgggcaaactgcccatcatgtgcaccaaggccgttagccctgcctcctggcaaacgtccagtgacagctgctgggttccatcaactttgggcagccggttgtcgctgcagggaaggaaccaataagaatttctaaaggaaacctgatcttgctatcaattgctgctgcttaaatggcaggccaactggtcagctgctgatcagggtgtctaggctgaaggagttggagaccttgtgctaggtaggtgaaccagaaaccaccctcgccaccaagactcgctcccaacctggctcccggcaacctcaggtgccttcctcgcccaggtctttcaccctttctacagaaactacctcggtctggatctccccaccaccagcagcctgtgcaatatttattggtctatcaatttctcccgtctcctgtcccaaagtaataaatcatgtttaataagtctg

SEQ ID NO: 7262 - DNA, 1481 bp, Homo sapiens
acatgcgcaggaggctcaatgacagtcgagctttggctaaggctccggggaaagggtctagccatgctgcatgtgacccggggggtctgggggtccagggtccgagtatggccactgttgcccgcgctcctcgggcccccccgggccctctcatcgctggcagccaaaatgggggagtatcgcaagatgtggaaccccagggagccccgcgactgggcccagcagtaccgcgagcgcttcattcccttctccaaggagcagctgctccgcctcctaatacaggaattccactcgagtccggcagagaaggcggctttggaggcgttctcggcccacgtggacttctgcaccctgttccactaccaccaaatcctggcccggctgcaggtgacagtaaatttggatcagtatgtctacattcacttctgggccctgggccagcgagtcgggcagatgcccctgaagtccagcgtgggctccaggcgtggcttcttcaccaagctgccccctgcggagaggagatactttaagcgggtggtcctggcagcccggaccaaacggggacacctggtactgaagagtttcaaggacacgccgctggaaggcctggagcagctgctgccggagctgaaggtgcgcacgcccaccctgcagcgcgccctgctcaacctcatgctggtagtctccggcgtggcgatcttcgtcaacgtgggcatggtggtgctaaccgacctcaaggtggccacctccctgctgctgctgctcttcgccatcttcatgggcctgcgggcctccaagatgttcgggcagcggcgcagcgcgcaggcgttggagctggcgcacatgctgtactatcgcagtacgtccaacaactcggagctgctcagcgccctggccctgcgcgcgcaggacgagcacaccaaggaggcgctgctggctcacagcttcctggcccggcggccagggggcactcaaggctcgcccgaagagacctccaggtggctccggtcggaggtggagaactggctcctagccaagtcaggctgtgaggtgaccttcaacggaactcgggccctggcgcatctgcaggccctgacccccagcatgggattgtacccacccccgggtttccccaaactagacccagtggctccgatcacttccgagcccccgcaagccacgcccagcagtaacatctcctgagtagaacctacctccctgcccagtcagcaggctaggaactaagccccgcctccttcacgacaggctgtcaattacggttattatacttttcactccaacttccaataactgacaggtgattatttttgctgcactgtgtgcttaagcaaagcagccaatcaaagcagctagcagttgttaagtcttccccgccccttcgatgaacagccaatcaaagcgatttagctctgcttctgttccatttcttagtcccaccctcaccataaacatccaagtgt

SEQ ID NO: 7263 - DNA, 1165 bp, Homo sapiens
acatgcgcaggaggctcaatgacagtcgagctttggctaaggccttatatgaccccatcaaccctgacagggagaccctcgatcagccatcactaacggatccccagcgtctgtctaatgagcaggaggtgcttcgggctctggagcccctgctggcccaggccaacttctccccgctgtctgaggacaccctggcctacgcgctggtggtccaccaccctcaggatgaggtccaggtgacagtaaatttggatcagtatgtctacattcacttctgggccctgggccagcgagtcgggcagatgcccctgaagtccagcgtgggctccaggcgtggcttcttcaccaagctgccccctgcggagaggagatactttaagcgggtggtcctggcagcccggaccaaacggggacacctggtactgaagagtttcaaggacacgccgctggaaggcctggagcagctgctgccggagctgaaggtgcgcacgcccaccctgcagcgcgccctgctcaacctcatgctggtagtctccggcgtggcgatcttcgtcaacgtgggcatggtggtgctaaccgacctcaaggtggccacctccctgctgctgctgctcttcgccatcttcatgggcctgcgggcctccaagatgttcgggcagcggcgcagcgcgcaggcgttggagctggcgcacatgctgtactatcgcagtacgtccaacaactcggagctgctcagcgccctggccctgcgcgcgcaggacgagcacaccaaggaggcgctgctggctcacagcttcctggcccggcggccagggggcactcaaggctcgcccgaagagacctccaggtggctccggtcggaggtggagaactggctcctagccaagtcaggctgtgaggtgaccttcaacggaactcgggccctggcgcatctgcaggccctgacccccagcatgggattgtacccacccccgggtttccccaaactagacccagtggctccgatcacttccgagcccccgcaagccacgcccagcagtaacatctcctgagtagaacctacctccctgcccagtcagcaggctaggaactaagccccgcctccttcacgacaggctgtcaattacggttattatacttttcactccaacttccaataactgac

SEQ ID NO: 7264 - DNA, 3442 bp, Homo sapiens
aacctgctgtcctatgaaggcctctaggtcaccggtgctaaagccctcctttctccaccctccttaagtggaggtaaacgtcccagcaggaagtcaaggctggattggcgctcttcgcgagcaccctgggaacgggagtctgggtcacgggtgctagagccctcccctctcctcccggccggtgtatgggaaattgtccccgcagaaagtaaaggctggccaggccgcccccagcacgtagagggaatgagtcaggctccggctccacactggcacgtagtgggcggatcgcgccggcgctgagtaggaaggagcttcagccgccagcccggaacgcatcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaagtgctttcatatttttgttcatcaaaagtgaaataccaaataacacgtgttccatggataccactccattaataacagagcatgtgatcaacacaacccaagacccctgttcctgggtggataaactttctacagtacaccaccgcatagtgggctgcagtcttgcagtgatatctggagtactctatggatctacatttgtgccaatcatctacatcaaggaccacagcaaaagaaatgatagtatatatgcaggggcaagccaatatgatttagactatgtgtttgcgcacttcagtggcatctttcttacaagtactgtctactttctggcctactgcatagccatgaaaaatagtcctaaactatatcctgaagcagtcctaccaggattcctgtcaggagtactttgggctatagctacctgctgttggttcatagcaaatcactctctgagtgctgtggtcagttttccaataatcactgctggtccaggatttatagctgcaatgtggggtatcttcatgtttaaggaaataaagggtctacaaaactacctattaatgatacttgcattttgcatcatcttgactggagccttatgcactgctttttctaaaatctaacaatgacaaaaccagcaggtggcagcagtagttaagagaacgcgtctatcggacagcggagagatcatgctgagaaaagagtgcattttcatatagcaaatggatctcagccactgttggagtgggtaaatgatttttttccccaaaaatgtgagaatgaaggaagattgagtttcattcaagtataaaaatgaaaatttcttctgatgaactgtttatgaaggtagtactttactgggtgactaaaatgtctacattattatagcattacatacgaggatgctctttttaccacagtatgtacctagtgttgcataatctagaacacagtatagagtccatatacaaagaagttacagtccatatttctcacctattaccccagtgaagtgaggcagaaataccttgggcgaggagggagagccttaccttctaatggaattagattccaaagatatttggatcctttgtttcataaagtaaatgcatagttggtaactaaatgttaaaaaggccattttattattgttagccaaaacttctgtttatttcaagttaatatcgcccaactctacatcatctacccattttagctcataatgcttttgattatcgccagataaagtccattctcagagaacaaaaatttttcatcattgagaaaatgtgcataacataatacatacatacacaagtatattcacgtacataaatacacacagatatgttgctaaagtgagattgtaggttatcagtaacaatttaaaggaaacaaccactcttttgaatgtacaacttttttttctgaaatacacttttctaaaaccctcttaactggaggtttcctgttttcttcttgttttaactggtggtttccagtaggcaaaataaaatgacaggcatgctagttttttttttttttttttttttttaagaaaactgaaattaagccaggcagggtggcgcactactataatcccagctgctggggcggctgaagtaggagggtcacttagcccaagagtgcaaatctgccagcctaggcaacatagcaaggtcccatctctaaaaaagaaatttaatttaaatttgtaagaaaaaagaaaactgaaacagaactgccagtacaatgtttgttgcaattgtttccaaaactttgagataacgaaacccctattcaaatgtaaattttacccattcccacctgatagtactgtttattactttgctatgcaggagaaacaaaacagctttttatttgtgtgtatactctgaagtcaatgtgcatgggttaaatcccacctctgcttcattttatttgtgtggctttggacaagttcctaagccctctgtgtcaggcccctcattaacaaaatggagtttatgatggcatctacctcacatggttattgtgtggttgaaattagttcaaatctgtaaagtatgttgatgagtatctggtacttggcaaacactatataattgttagctttattattatgtgttgtttgaaggggaaaaaagtttttgtagattggagaacaccatgtaagagctactaagctcaccaccttcccatccaaacaattattactcctctaaatgaatactacttaaaagtgatggagcttctgtttgtttattgaattgctaatacaaataaatatttgactataacttcttatactcattttaattttaacctgaaatgtcattaaattatgctgataaactttgaataaattgtgatacaaaagctatttttctcatttaaatatattttagaattttatattggataacttttaattattctttagttgggatttccaatttatatgcaaaattttaaatgtgaagtaaagcagtttcagaagaaaaatg

SEQ ID NO: 7265 - DNA, 642 bp, Homo sapiens
gtcgaaatgcacctcatgcactctaattagcacgtcaaattagtctctccgtttcagaggtgtagggcctttgtggagccttctcaataaaataatttgccactcttgaaggttagacattctcttctatcaatgtacacataaaggttttgttttgctttgcttgttgtgaattaaaatggggagaaaatgatgtgttagctatcacccagtcatgtgtctttttagtcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacag

SEQ ID NO: 7266 - DNA, 535 bp, Homo sapiens
gtagagggaatgagtcaggctccggctccacactggcacgtagtgggcggatcgcgccggcgctgagtaggaaggagcttcagccgccagcccggaacgcacagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaag

SEQ ID NO: 7267 - DNA, 576 bp, Homo sapiens
acgtagagggaatgagtcaggctccggctccacactggcacgtagtgggcggatcgcgccggcgctgagtaggaaggagcttcagccgccagcccggaacgcaaagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaag

SEQ ID NO: 7268 - DNA, 575 bp, Homo sapiens
agtgacattccatgagacaagcagtcctgtggtgaggcccatgtcaagaaggcctgagatctcccaccatcagctacagccaatttgtcagtcacagatcctcaaaatgagcagcagatacactcagtctgtaggatcatttagcaactcggggaaggaggtcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacag

SEQ ID NO: 7269 - DNA, 764 bp, Homo sapiens
agtgacattccatgagacaagcagtcctgtggtgaggcccatgtcaagaaggcctgagatctcccaccatcagctacagccaatttgtcagtcacagatcctcaaaatgagcagcagatacactcagtctgtaggatcatttagcaactcggggaaggaggtcataggttagcttttcaagacacttcctgcatctctgacctgttgcacctctgttatcttggcacctctgttatcttagcagcaagcacctgcctcagctgacccttgagccataacccatagggcttattccaaagggccagtgtgcaaaatatgaatccaagatggcattgtggaaagacgctgtacctcctgtgataaaattactttggtggtgcttttttctcatgtatctcgggaaactaaaaatctgaattgtattcagtggccttttccaaatgaagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaa

SEQ ID NO: 7270 - DNA, 1070 bp, Homo sapiens
ttttgagccacctgacaattcagtccagcacagcaactgaaggaaggcgttccccaacctgctgtcctatgaaggcctctaggtcaccggtgctaaagccctcctttctccaccctccttaagtggaggtaaacgtcccagcaggaagtcaaggctggattggcgctcttcgcgagcaccctgggaacgggagtctgggtcacgggtgctagagccctcccctctcctcccggccggtgtatgggaaattgtccccgcagaaagtaaaggctggccaggccgcccccagcacgtagagggaatgagtcaggctccggctccacactggcacgtagtgggcggatcgcgccggcgctgagtaggaaggagcttcagccgccagcccggaacgcagttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaagtgctttcatatttttgttcatcaaaagtgaaataccaaataacacgtgttccatggataccactccattaataacagagcatgtgatc

SEQ ID NO: 7271 - DNA, 546 bp, Homo sapiens
atgagacaagcagtcctgtggtgaggcccatgtcaagaaggcctgagatctcccaccatcagctacagccaatttgtcagtcactcatcatttctcattatacacagagatcctcaaaatgagcagcagatacactcagtctgtaggatcatttagcaactcggggaaggaggtcataggttagcttttcaagacacttcctgcatctctgacctgttgcacctctgttatcttggcacctctgttatcttagcagcaagcacctgcctcagctgacccttgagccataacccatagggcttattccaaagggccagtgtgcaaaatatgaatccaagatggcattgtggaaagacgctgtacctcctgtgataaaattactttggtggtgcttttttctcatgtatctcgggaaactaaaaatctgaattgtattcagtggccttttccaaatgaagctcctgaaaagtacatcaagtctaaagtgaaccagctaactcattaagactggaatcatgagcaacaatggagcagacctaacctttg

SEQ ID NO: 7272 - DNA, 731 bp, Homo sapiens
aaaggctggccaggccgcccccagcacgtagagggaatgagtcaggctccggctccacactggcacgtagtgggcggatcgcgccggcgctgagtaggaaggagcttcagccgccagcccggaacgcatcataggttagcttttcaagacacttcctgcatctctgacctgttgcacctctgttatcttggcacctctgttatcttagcagcaagcacctgcctcagctgacccttgagccataacccatagggcttattccaaagggccagtgtgcaaaatatgaatccaagatggcattgtggaaagacgctgtacctcctgtgataaaattactttggtggtgcttttttctcatgtatctcgggaaactaaaaatctgaattgtattcagtggccttttccaaatgaagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaa

SEQ ID NO: 7273 - DNA, 3699 bp, Homo sapiens
cgtagagggaatgagtcaggctccggctccacactggcacgtagtgggcggatcgcgccggcgctgagtaggaaggagcttcagccgccagcccggaacgcagtgagtacagccactcaaaggaaagccaagtcgctttgcaggggagcgtctcatgatttttcagaaacgtgctcatggttaaaaagaaaaatcaaggctcggaataaatacattcaagcactgttaattttagcccaaagacaggcggtacttgcctggagatttgggaaaatcaacatgaaactaaaaatgaaattttagttggagtggagcaagcagtattgatcagaacataccaaatacgaattttttcaaagtctgcgtagaagtttaaattactaggaaaaatgtaaaggagaagtatttactaataaatgaaacaaaagtaataaaataaaaatgaattaatatagtttgacaaaatatcagcgaacgctgaaaagaaaacattaaaataatgtttgagactttttaggttttgtgcaggaagaattgggaaaaatgtgctggatggagtgatactgcttttcttttccacaaaaatttcattattttagagagcggtagagcctttttaaagacagtaagttattgccaattcacaatgaaataagatcacatgctctgaaatgtacaagagctgcatgcaataaacttcatttatctataggtaataactgattgatgtttattcagtagtcgaaatgcacctcatgcactctaattagcacgtcaaattagtctctccgtttcagaggtgtagggcctttgtggagccttctcaataaaataatttgccactcttgaaggttagacattctcttctatcaatgtacacataaaggttttgttttgctttgcttgttgtgaattaaaatggggagaaaatgatgtgttagctatcacccagtcatgtgtctttttagtcataggttagcttttcaagacacttcctgcatctctgacctgttgcacctctgttatcttggcacctctgttatcttagcagcaagcacctgcctcagctgacccttgagccataacccatgtaagtcactgcagggctgaacctctctttgagcctaacagtagaataataattatttttattgaatagtgttaatgtgtcaatgttgaaatgtgcctcagtgtgtcttcctcaaccacatccctatagaggatgttttcttaatagcaatgtgtttttgttttaagaaagtccacacaatttcaaatacacattttctttactaaagtttattgaccagttttgaagtgatccttgttttcagttaaactatctttaataatggtaaataacatattttgtaggttgttgtatatttaatattctctgcaagaacacataaggaacaatacatggacctttaaatatttgtcattgtgaaataaaataacaaggaaaggtgatttcaggtgtactttattcaatacatatatacaagaagttattactataacattaaatttgcaggaaaaaagaaaccactggattattctgcttctattccagagggcttattccaaagggccagtgtgcaaaatatgaatccaagatggcattgtggaaagacgctgtacctcctgtgataaaattactttggtggtgcttttttctcatgtatctcgggaaactaaaaatctgaattgtattcagtggccttttccaaatgaagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggtttaggccttggaatcttaatctggggatcatttaatgccttaactggctgggcaagctcaaggtttggctggtttggattggatgcagaagaagtatcaaatccgctgctaaattacattggagctgggctatcagtagtaagtgctttcatatttttgttcatcaaaagtgaaataccaaataacacgtgttccatggataccactccattaataacagagcatgtgagtatagtatgagagacaacttgatttgaaacataaaattaagataaatggataatacataaattttaaacacagatgaaaaagtggtgtttgctcatcactcctggctatgtaaaatatcttagcttatttattatgggtaggtctatgtagcaatcaatcaatatttccgcagttgagcttctcagcaagcacacgggtttatttattttgattaacagatctctactaggtgatatatatataaccccatttttgtaatgatttaaagattcctacaatagaggaaccctaaatactgtagaggaatgtgaaaataactttagaaagtcagaggaaggaggttttgaagttggtccaggggagaatagaccataggaggccaagaaaggtaagtgaagtcctatgagaataggaactggtatcccattctacccgaagtgaaaaacagaaaatatgataggagtcactgttttgatcttgaagaatctaaatcagtctggaatagtaaatctgaatgaaacaggagcaacttttaaaagggacctgataaagcgcaagtgtcagtagctacatatacaaaagtgacttcagggcaaagcctcattgtcatgaacccaggctctaatccttctcatctcaagaaatctctcctgtctgccctgggccagtgctatccagctgccctctgaatccagcgctcctcacccccagtggggtattgccccttggcagggtgcttatttaccccttacttcaaaattaatcttttctcctttccttcttcccctatccaaacttttatcaactaaaaccttagttaaattgacactaaagttgaatagtaattagcttaagtgtaaagagaagaggtttattaatccacaggcatctctaatcagggaaatgtttcagggagaagggaggagttggctttgggaaagggttccttgcctgcttcagggatccagacacctcctgcccaaccatcctccaaaacaatggaacaaaataataaaataaatgcagcttggtaaaagatacacagtaggctaactgcctgagatttttctaggcaataagtttaaagatccataaacagcatgattgatgggtacagaaccatgcatcatgagctccttatgatgaaagaaaccgttattgccaaaggaaaacttgacttagcacatgacaaagaattcaaatctactttcttgtctcttacaaaaataataggattataacatcaagaacacttcagttggccaggcgtgatggctcatgcccgtaatcccagcactgtgggaggtcaaggtgggcagatcacctgagttcaggagttcaagaccagcctgtccaacatggtgaaactctatctctactaagaatacaaaaaaaaaaaaaa

SEQ ID NO: 7274 - DNA, 525 bp, Homo sapiens
agtctctccgtttcagaggtgtagggcctttgtggagccttctcaataaaataatttgccactcttgaagtcataggttagcttttcaagacacttcctgcatctctgacctgttgcacctctgttatcttggcacctctgttatcttagcagcaagcacctgcctcagctgacccttgagccataacccataagctcctgaaaagtacatcaagtctaaagtgaaccagctaactcattaagactggaatcatgagcaacaatggagcagacctaacctttggttacatctcctgttttgtagctatccttttgtttggctcaaattttgtgccacttaaaaaatttgatactggtgatggaatgtttctccagtgggttctttgtgctgccatatggttggttgccttggttgtcaatctgatattacattgtccaaagttttggccttttgcaatgcttgggggctgcatttgggcaacagggaacattgctgttgtcccaattatcaaaaccattggttta

SEQ ID NO: 7275 - DNA, 1779 bp, Homo sapiens
attgccgggccagtgcgggagccggagcggagccggggccggagcgggcggaatggagcccctgcgcgcgcccgcgctgcgccgcctgctgccgccgctgctgctcctgctgctgtcactgcccccccgcgcccgggccaagtacgtgcggggcaacctcagttccaaggaggactgggtgttcctgacaagattttgtttcctctcggattacggccgactggacttccgtttccgctaccctgaggccaagtgctgtcagaacatcctcctctattttgatgacccatcccagtggccagccgtgtacaaggcaggggacaaggactgcctggccaaggagtcagtgatccggccggagaacaaccaggtcatcaacctcaccacccagtatgcctggtccggctgtcaggtggtatcagaggagggaacccgctacctgagctgctccagtggccgcagcttccgctcaggtgatggattgcagctggagtatgagatggtcctcaccaatggcaagtccttctggacacgacacttctccgctgatgagtttgggatcctggagacagatgtgaccttcctcctcatcttcatcctcatcttcttcctctcttgttactttggatatttgctgaaaggtcgtcagttgctccacacaacttataaaatgttcatggccgcagcaggagtagaggtcctgagcctcctatttttctgcatctactggggtcaatatgccaccgatggcattggcaacgagagtgtgaagatcttggccaagctgctcttctcctccagcttcctcatcttcctgctgatgcttatcctcctggggaagggattcacggtgacacggggccgcatcagccacgcgggctccgtgaagttgtctgtctacatgaccctgtacacgctcacccatgtggtgctgctcatctacgaggcggaattctttgacccaggccaggtactgtacacgtatgagtcgccggccggctacgggctcattggactgcaggtggcggcctacgtgtggttctgctatgctgtgcttgtctcactgcgacactttcctgagaagcagcctttttatgtgcccttctttgctgcctataccctctggttctttgcggttcctgtcatggccctgattgccaatttcggcatccccaagtgggcccgggagaagattgtcaatggcatccagctggggatccacttgtacgcccatggcgtgtttctgatcatgacccgcccatcagcggccaacaagaacttcccgtaccacgtgcgcacgtcgcagatcgcttcagccggagtccctggacccggagggagccaatccgctgacaaggccttcccgcagcacgtctatgggaacgtgacgtttatcagcgactcggtgcccaacttcacggagctcttctccatccccccgcccgccacctcccccctgccccgagcggcgccggattctgggctcccgctgttccgtgacctccggccccctggcccccttcgagacctctgaccccgctggactccggaacacccgtggtgaccgccgggaccctgcctgtgactctccaggactctgcgaccccgggatggatattgcgatgctggtctcgaccctgaaaccctccctcggatctgtgacctcggacccgtactccatctgccgcatctccattccgggggccttccctcgggtccctggcagaaagacattttaccccttcttgccaaaataaaaaaggattcgtttttatctat

SEQ ID NO: 7276 - DNA, 1456 bp, Homo sapiens
agattacgccactgcaccccaacctgggcgacagagccagactctgtcaaaaaaaaaagaaacagaaagaggtcaggcgcagtggctcacaactgtaacctcaagcactttgggaggccgagatgggaggatcacttgtgcccaggaatttgggaccagcgtggcaacataatagagtttctgacaggagaatttatatacaggatgtataccattgacatgcacagccagctggaattgactgcttcgttgataccccagccaggcacatccctgattcctctggtgatggtgagcaacccccactccctggggttccaggccaccttctacgagaacggttacacatcagatgggaacaccaagtacaaactggatattttcctaaaacagcagcagcactggggcaggaccgactccaacttcacttccagtttaaagaaagccaccatgtctaccttaactgtggacatagcaaacaaggaaatttcatgtgtggatatcaagccactgtcgacactgatttcagttggctgcgacctggataaaaagatcgtcatccagaacaaagtttccgcctgttccatgggcatcctggaccccttgaccctgcaagacaattacagcttcatcatcgagaaggaattctacgaccccggcttccaggggcagcagtcctccgaggacctgcacgtgttttactcctaccagcagctgggctgtcctctcctcgtctactatgacaccctatggaagcccgtggtggagctgtggcgaaaagacagtttccaggaggtcatcgacgccgagtatgtgttactggaggtgaacgggcagttctcatactcctattccctgacggcccagtcggccatgtgtacctcccagccgcagaactggaccaccatgataaaggaattcggggggcccttcttctggaacagagagaactatgtgagctgccacgaccccaacaacaatgcccctttgaggtggccagacgtccagtatcagatcttgggcggccggacagcaaaccagatcattttcggccacaatggcttttatgtcttctacatttcgatcgtggatccgtactacagctactgtcaactggagaccatctttagcatctacgtgtatggagcattccccgtgcagctggtctctgctggagtcgtcatcctactgatcatctccagcatcctggggtccgtttggctggcctacaagacccccaagctgctacgcacagcacgcggccgcaggatcaagaagtgtgcgacacagctgtgtaggagatgcaagacggtctgccagttcagggcctcagccacagccagggcaggcacagagcccccgggacgccaccgcactcctcacggaggcaggtctgaccactgaggccggtccacagggtcccaaccccttgtcttcaaataaagtataatgtaac

SEQ ID NO: 7277 - DNA, 2167 bp, Homo sapiens
gattgtgcagcgactccccgtggcggttgaggggcagtggtggcggcggaagcccaagtcgatgctgatgttgatgctggtggcggctgtgaccatgtggctccgaccgctggtcacagctcagctctgtcgttctcgcacagtgaggacaggaaaagtgtttaatctgatacaggacgttcaaggggaccgcctgtattttcatcctacaacaacacgcttgattaaacatccttgcgagaaaaatatagcactatatctagggaaacaagtttttttcacaatggataactttgagactagtctccttccatttaccatccctacatcaatgcaggtcggcgtaccagaagtgacatcagcacattttgctggttcgttattgctgttagtagtggatcaaaaagtctatatttatgattatgaaaataattcttggagcatgtctttaggtataaaacaccctgttacacatgtctctggtgataattgttgttatactggaagtttgttttgtgtgcatgtcagtaatttggtttttgcatatttccgtggagatcagatatcccagacttatatatattattcaaatactgggggattcagtttttggaagtatcactatgacagacaggcagaaatcattgggtctttaggcggaatcttccactttttttctttgtcacaggttgcgatgcttgtagtgaatcaagggaagggcatgttcaagtactcagatcaccccctcaaccggagtttcgggctgtcttttgactataatgggactctagacatcctcatcgcccccggccagagaggcatcctgctcctatggtttgagaacagcctgttgttttcccataatgcaggtcagctcgtcgacaccgtccgggtgaaaaaaggagaccagaccttgttttcttccatttttgaagccaagatcaccatccacaacattgctgtcactgaaaatgaactggcagttataactcgggaggataatttgtattatggcaatctgggcatcgtgccaagttccataatcaaatttgcagaccaatacatctggtcagaagacgtggccctgatgttcaggagcccagggactctggaaatactgaccccactgcgtgacacagcctttccagcttttgatttccagaagtgcctcgtgaatatccaggcgcttctcatggaccctgaactccacgttggaaagtgcaagatagagtttctgacaggagaatttatatacaggatgtataccattgacatgcacagccagctggaattgactgcttcgttgataccccagccaggcacatccctgattcctctggtgatggtgagcaacccccactccctggggttccaggccaccttctacgagaacggttacacatcagatgggaacaccaagtacaaactggatattttcctaaaacagcagcagcactggggcaggaccgactccaacttcacttccagtttaaagaaagccaccatgtctaccttaactgtggacatagcaaacaaggaaatttcatgtgtggatatcaagccactgtcgacactgatttcagttggctgcgacctggataaaaagatcgtcatccagaacaaagtttccgcctgttccatgggcatcctggaccccttgaccctgcaagacaattacagcttcatcatcgagaaggaattctacgaccccggcttccaggggcagcagtcctccgaggacctgcacgtgttttactcctaccagcagctgggctgtcctctcctcgtctactatgacaccctatggaagcccgtggtggagctgctggagtccagtggcatgaacacagttcattgcagccttaacctcccaggctcaagcggtcctcctgcctcagcctcccaagtagctgggactgcagttgcataccacaatgcccggttaatttttttttttttttttttttttttttttttgagacagagtctcgctctgtcgcccaggctggagtgcagcggtgtgatcttggctcaccgcaagctctgcctcccgggttcacgccattctcctgcctcagcctcccgagtagctgggattacaggcgcccgccactgcgcccggctaattttttttatttttagtagagatagggtttcaccgtgttag

SEQ ID NO: 7278 - DNA, 2516 bp, Homo sapiens
gattgtgcagcgactccccgtggcggttgaggggcagtggtggcggcggaagcccaagtcgatgctgatgttgatgctggtggcggctgtgaccatgtggctccgaccgctggtcacagctcagctctgtcgttctcgcacagtgaggacaggaaaagtgtttaatctgatacaggacgttcaaggggaccgcctgtattttcatcctacaacaacacgcttgattaaacatccttgcgagaaaaatatagcactatatctagggaaacaagtttttttcacaatggataactttgagactagtctccttccatttaccatccctacatcaatgcaggtcggcgtaccagaagtgacatcagcacattttgctggttcgttattgctgttagtagtggatcaaaaagtctatatttatgattatgaaaataattcttggagcatgtctttaggtataaaacaccctgttacacatgtctctggtgataattgttgttatactggaagtttgttttgtgtgcatgtcagtaatttggtttttgcatatttccgtggagatcagatatcccagacttatatatattattcaaatactgggggattcagtttttggaagtatcactatgacagacaggcagaaatcattgggtctttaggcggaatcttccactttttttctttgtcacaggttgcgatgcttgtagtgaatcaagggaagggcatgttcaagtactcagatcaccccctcaaccggagtttcgggctgtcttttgactataatgggactctagacatcctcatcgcccccggccagagaggcatcctgctcctatggtttgagaacagcctgttgttttcccataatgcaggtcagctcgtcgacaccgtccgggtgaaaaaaggagaccagaccttgttttcttccatttttgaagccaagatcaccatccacaacattgctgtcactgaaaatgaactggcagttataactcgggaggataatttgtattatggcaatctgggcatcgtgccaagttccataatcaaatttgcagaccaatacatctggtcagaagacgtggccctgatgttcaggagcccagggactctggaaatactgaccccactgcgtgacacagcctttccagcttttgatttccagaagtgcctcgtgaatatccaggcgcttctcatggaccctgaactccacgttggaaagtgcaagatagagtttctgacaggagaatttatatacaggatgtataccattgacatgcacagccagctggaattgactgcttcgttgataccccagccaggcacatccctgattcctctggtgatggtgagcaacccccactccctggggttccaggccaccttctacgagaacggttacacatcagatgggaacaccaagtacaaactggatattttcctaaaacagcagcagcactggggcaggaccgactccaacttcacttccagtttaaagaaagccaccatgtctaccttaactgtggacatagcaaacaaggaaatttcatgtgtggatatcaagccactgtcgacactgatttcagttggctgcgacctggataaaaagatcgtcatccagaacaaagtttccgcctgttccatgggcatcctggaccccttgaccctgcaagacaattacagcttcatcatcgagaaggaattctacgaccccggcttccaggggcagcagtcctccgaggacctgcacgtgttttactcctaccagcagctgggctgtcctctcctcgtctactatgacaccctatggaagcccgtggtggagctgtggcgaaaagacagtttccaggaggtcatcgacgccgagtatgtgttactggaggtgaacgggcagttctcatactcctattccctgacggcccagtcggccatgtgtacctcccagccgcagaactggaccaccatgataaaggaattcggggggcccttcttctggaacagagagaactatgtgagctgccacgaccccaacaacaatgcccctttgaggtggccagacgtccagtatcagatcttgggcggccggacagcaaaccagatcattttcggccacaatggcttttatgtcttctacatttcgatcgtggatccgtactacagctactgtcaactggagaccatctttagcatctacgtgtatggagcattccccgtgcagctggtctctgctggagtcgtcatcctactgatcatctccagcatcctggggtccgtttggctggcctacaagacccccaagctgctacgcacagcacgcggccgcaggatcaagaagtgtgcgacacagctgtgtaggagatgcaagacggtctgccagttcagggcctcagccacagccagggcaggcacagagcccccgggacgccaccgcactcctcacggaggcaggtctgaccactgaggccggtccacagggtcccaaccccttgtcttcaaataaagtataatgtaacatagca

SEQ ID NO: 7279 - DNA, 852 bp, Homo sapiens
ggccctggccgtggcgaaagagccggcggagccggagacccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtccgagtacaacgccttctggaaatgcgtccaggctggagtcacctacctctttgtccaactctgcaagatgctgttcttggccactttctttcccacctgggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcactccaggttttagtgaagtaaacagtatttggaaagtt

SEQ ID NO: 7280 - DNA, 904 bp, Homo sapiens
aggtgggtgccaggccctggccgtggcgaaagagccggcggagccggagacccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtgagtgcgggaagggcgcggggcggagagggcgcggggcccgggccgaccctcacctcccgcttctccaggtccgagtacaacgccttctggaaatgcgtccaggctggagtcacctacctctttgtccaactctgcaagatgctgttcttggccactttctttcccacctgggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcactccagg

SEQ ID NO: 7281 - DNA, 767 bp, Homo sapiens
ccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtccgagtacaacgccttctggaaatgcgtccaggctggagtcacctacctctttgtccaactctgcaagatgctgttcttggccactttctttcccacctgggaaggcggcatctatgacttcattggggagttcatgaaggccagcgtggatgtggcagacctgataggtctaaaccttgtcatgtcccggaatgccggcaagggagagtacaagatcatggttgctgccctgggctgggccactgctgagcttattatgtcccgctgcattcccctatgggtcggagcccggggcattgagtttgactggaagtacatccagatgagcatagactccaacatcagtctggtccattacatcgtcgcgtctgctcaggtctggatgataacacgctatgatctgtaccacaccttccggccagctgtcctcctgctgatgttcctcagtgtctacaaggcctttgttatggagtgagttgggtggggtttagggctgggtccaaagtggggtgggttatctagtctcccttccttattgtgacattttcctgcaggaccttcgtccacctctgctcgctgggcagttgggcagctctactggcccgagcagtggtaacggggctgctgg

SEQ ID NO: 7282 - DNA, 669 bp, Homo sapiens
cagaaggtcgcgcgcgggcccccgccagtcaggtgggtgccaggccctggccgtggcgaaagagccggcggagccggagacccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtccgagtacaacgccttctggaaatgcgtccaggctggagtcacctacctctttgtccaactctgcaagatgctgttcttggccactttctttcccacctgggaaggcggcatctatgacttcattggggtccattacatcgtcgcgtctgctcaggtctggatgataacacgctatgatctgtaccacaccttccggccagctgtcctcctgctgatgttcctcagtgtctacaaggcctttgttatggagaccttcgtccacctctgctcgctgggcagttgggcagctctactggcccgagcagtggtaacggggctgctggccctcagcactttggccctgtatgtcgccgttgtcaatgtgcactcctaggcttggtgtctcagacattgatgtaccttttccctgcctcactccaggttttagtgaagtaaacagtatttggaaa

SEQ ID NO: 7283 - DNA, 992 bp, Homo sapiens
gctcagcgcgagacggctgggcgccgagtgggacagcgctggtgcggagactgcttccggactccaggtaccgcgcttggcggcagctggccccagacttctgtcttttcagctgcagtgaaggctcggggctgcagaattgcaaccttgccaatggacctgatcggttttggttatgcagccctcgtgacatttggaagcatttttggatataagcggagaggtggtgttccgtctttgattgctggtctttttgttggatgtttggccggctatggagcttaccgtgtctccaatgacaaacgagatgtaaaagtgtcactgtttacagctttcttcctggctaccataatgggtgtgagatttaagaggtccaagaaaataatgcctgctggtttggttgcaggtttaagcctcatgatgatcctgagacttgtcttgttgctgctctgagcatctggaggaacagaaaactaagttcatgtcatcctgctgtaatgggcagagcatattttttttgtatttaaaagataaacttcaatatggaatgctagaaacacaaatagcactgtcacctctaatatgaacattagtttgaggtagtttttttctaaagcaaaaattttaactgttttctaattgtcaagcactattttcattaaaagtgtctaatgaatcatgatatactcttccatttgttgtgtctattttttatatatttggtattttttgaaaattccaaatactcatgtctcaagtaagcttaaactacaacttgtcacataaaggaagtcttaagtggagttcacagaatgataatgtatctatttgtcatttgtgttatatttgaaattattagaaattatgctttttccattttaattgtattgctgccagtgctatttttttctttaaaaaattttattcttagcacactgttatgtcctaactgaatgtattcagtattcaaataaaagacattttggttcaaa

SEQ ID NO: 7284 - DNA, 787 bp, Homo sapiens
gtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacagccgctacatctgttacttttgttggtgttatgggaatgagatcctactactatggaaaattcatgcctgtaggtttaattgcaggtgccagtttgctgatggccgccaaagttggagttcgtatgttgatgacatctgattagcagaagtcatgttccagcttggactcatgaaggattaaaaatctgcatcttccactattttcaatgtattaagagaaataagtgcagcatttttgcatctgacattttacctaaaaaaaaaaagacaccaaatttggcggaggggtggaaaatcagttgttaccattataaccctacagaggtggtgagcatgtaacatgagcttattgagaccatcatagagatcgattcttgtatattgattttatctctttctgtatctataggtaaatctcaagggtaaaatgttaggtgttgacattgagaaccctgaaaccccattccctgctcagaggaacagtgtgaaaaaaaatctcttgagagatttagaatatcttttcttttgctcatcttagaccacagactgactttgaaattatgttaagtgaa

SEQ ID NO: 7285 - DNA, 975 bp, Homo sapiens
gcctttctccccgccctgccgcggccccggggcgcagcgcgcacgcaatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccagtttgctgatggccgccaaagttggagttcgtatgttgatgacatctgattagcagaagtcatgttccagcttggactcatgaaggattaaaaatctgcatcttccactattttcaatgtattaagagaaataagtgcagcatttttgcatctgacattttacctaaaaaaaaaaagacaccaaatttggcggaggggtggaaaatcagttgttaccattataaccctacagaggtggtgagcatgtaacatgagcttattgagaccatcatagagatcgattcttgtatattgattttatctctttctgtatctataggtaaatctcaagggtaaaatgttaggtgttgacattgagaaccctgaaaccccattccctgctcagaggaacagtgtgaaaaaaaatctcttgagagatttagaatatcttttcttttgctcatcttagaccacagactgactttgaaattatgttaagtgaaatatcaatgaaaataaagtttactataaataata

SEQ ID NO: 7286 - DNA, 998 bp, Homo sapiens
gcacgcgccacgacgtcccgcctttctccccgccctgccgcggccccggggcgcagcgcgcacgcaatcgcgtttccggagagacctggctgctgtgtcccgcggcttgcgctccgtagtggactccgcgggccttcggcaggtcgatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccagtttgctgatggccgccaaagttggagttcgtatgttgatgacatctgattagcagaagtcatgttccagcttggactcatgaaggattaaaaatctgcatcttccactattttcaatgtattaagagaaataagtgcagcatttttgcatctgacattttacctaaaaaaaaaaagacaccaaatttggcggaggggtggaaaatcagttgttaccattataaccctacagaggtggtgagcatgtaacatgagcttattgagaccatcatagagatcgattcttgtatattgattttatctctttctgtatctataggtaaatctcaagggtaaaatgttaggtgttgacattgagaaccctgaaaccccattccctgctcagaggaacagtgtgaaaaaaaatctcttgagagatttagaatatcttttcttttgctcatcttagaccacagactgactttgaaattatgttaagtgaaatatcaatgaaaataaagtttactataaataata

SEQ ID NO: 7287 - DNA, 992 bp, Homo sapiens
aatcgcgtttccggagagacctggctgctgtgtcccgcggcttgcgctccgtagtggactccgcgggccttcggcagatgcaggcctggggtagtctcctttctggactgagaagagaagaatggagaagcccctcttcccattagtgcctttgcattggtttggctttggctacacagcactggttgtttctggtgggatcgttggctatgtaaaaacaggcagcgtgccgtccctggctgcagggctgctcttcggcagtctagccggcctgggtgcttaccagctgtatcaggatccaaggaacgtttggggtttcctagccgctacatctgttacttttgttggtgttatgggaatgagatcctactactatggaaaattcatgcctgtaggtttaattgcaggtgccaggtactttcattctattactcttctttaccatgtagagttcagtttattgcccagaatactttatgcattcaaaaccttacttgtttcagagtatctgatgctatgcatcaactgacgtttgacttatacactaataggagatgcttcaaaaacaatagttgatttaatgtcaaatgacatgagtatatccattcactgtggagatggctttgttctctggtcctagctccttcctatatggtggcagaagttttattgcaaagctatgactgcagccttttgtgtgacttgcggaggatgtgtgggggtcccatatttcttaggtgtgtaggtgtcttttgtagaaaattttgctaaaaggaaattttgattgaatcctgttttctaattttgattataatacctaaaccaaattgtggtttttaaaaaatgtagttgtaggccaggcacggtggctcacacctgtaatccaagcacagtgggaggccatggcgggcatatcacttgaggtcaggagtttgagaccagcctggccaacatggtgaaactcctctctatgaaaaatacaaaaattaggt

SEQ ID NO: 7288 - DNA, 1113 bp, Homo sapiens
aggagctcgccgcgatgccccgccccactctccacccgctgaatgcagggcgcatgctgctacttggcggctcaagccccgcccgcaccgtccccattctctgaccgcccctctcccggtacactgcgcaggcacaacagagccgctcccctctcctcgccccgccaccgggacggagagcgcccgccgctgcatttccggcgacacctcgcagtcattcctgcggcttgcgcgcccttgtagacagccggggccttcgtgagaccggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccccattccctgctctgaggaacagtgtgaaaaaaagtcttttaggagatttacaatatctgttcttttgctcatcttagaccacagactgactttgaaattatgttaagtgaaatatcaatgaaaataaagtttactataaataata

SEQ ID NO: 7289 - DNA, 1161 bp, Homo sapiens
gccctgcaggcgctgcggacaggggaagcacagagattccccgccgcgttccctggactcaggagctcgccgcgatgccccgccccactctccacccgctgaatgcagggcgcatgctgctacttggcggctcaagccccgcccgcaccgtccccattctctgaccgcccctctcccggtacactgcgcaggcacaacagagccgctcccctctcctcgccccgccaccgggacggagagcgcccgccgctgcatttccggcgacacctcgcagtcattcctgcggcttgcgcgcccttgtagacagccggggccttcgtgagaccggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccaggtctcaggatccaaggaacgtttgggttttcctagctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccccattccctgctctgaggaacagtgtgaaaaaaagtcttttaggagatttacaatatctgttcttttgctcatcttagaccacagactgactttgaaattatgttaagtgaaatatcaatgaaaataaagtttact

SEQ ID NO: 7290 - DNA, 1177 bp, Homo sapiens
gccctgcaggcgctgcggacaggggaagcacagagattccccgccgcgttccctggactcaggagctcgccgcgatgccccgccccactctccacccgctgaatgcagggcgcatgctgctacttggcggctcaagccccgcccgcaccgtccccattctctgaccgcccctctcccggtacactgcgcaggcacaacagagccgctcccctctcctcgccccgccaccgggacggagagcgcccgccgctgcatttccggcgacacctcgcagtcattcctgcggcttgcgcgcccttgtagacagccggggccttcgtgagaccgcttgttttctgcaggtgcaggcctggggtagtctcctgtctggacagagaagagaaaaatgcaggacactggctcagtagtgcctttgcattggtttggctttggctacgcagcactggttgcttctggtgggatcattggctatgtaaaagcaggcagcgtgccgtccctggctgcagggctgctctttggcagtctagccggcctgggtgcttaccagctgtctcaggatccaaggaacgtttgggttttcctagctacatctggtaccttggctggcattatgggaatgaggttctaccactctggaaaattcatgcctgcaggtttaattgcaggtgccagtttgctgatggtcgccaaagttggagttagtatgttcaacagaccccattagcagaagtcatgttccagcttagactgatgaagaattaaaaatctgcatcttccactattttcaatatattaagagaaataagtgcagcatttttgcatctgacattttacctaaaaaaaaagacaccaaacttggcagagaggtggaaaatcagtcatgattacaaacctacagaggtggcgagtatgtaacacaagagcttaataagaccctcatagagcttgattcttgtatattgatgttgtcttttctttctgtatctgtaggtaaatctcaagggtaaaatgttaggtgtcagctttcagggctctgaaaccccattccctgctctgaggaacagtgtgaaaaaaagtcttttaggagatttacaatatctgttcttttgctcatcttagaccacagactgactttgaaattatgttaagtgaaatatcaatgaaaataaagtttact

SEQ ID NO: 7291 - DNA, 1296 bp, Homo sapiens
ctcatcaatttacccagaccttcaggaaagtggtataggtgcaggcctgctgcagtctcctgtctggagagaattagaagagaacaatgcagatggaccctggcccacaggtgcctttatactggcttggctttgtctatgcagcactggctgctttaggtgggatcagtggttatgcaaaagtaggttctgtccagtccccttctgctggattcttcttcagtgagttagcaggcctggatgcttctcagccatcacggaatccaaaggaacatttgagttctcccgtttacatctgggatcttgctaggtattatgcgaataagattctaacactctggaacatttacgcttgtgggtttagttgcaggtgcctgctgatagtttccaaacttggaagtatgtatggtgaacagatcctgtcagttgtagctatgtctcagcttggactcatgaagaattaaaaatctcccaacttccactatttttaatatactctgagaaataagtctataaattcacatagtctgatattttacttaaaaaaaaaatggaactgaacttggcaggaaaaaactcagtcattgtcattacaatcttacagaggtggcaagtatacaccacaagagattactattgttcagtttttgcatgttgatattatctcccctttttctttttgagacaaggtctcactctattgcccaggctggggtgcagtgatgcctgcagcctcgacctcctgggctcaagcaatacttctgcctcagtctcctgagtaactaggactacaggtgcctgctaccatgcccagttttttactgttgttgttgttcgtttctttatctttgaagagacaatgtcttgctatattgcccaggctggtcttacagcctcaggcaatcctctggtcttgacgtcccaaattgctgagattacagggatgagcaaccatgcctggcctttttatctcctctttctgtgtctataggtaaaatctcaaggtagaaaataatagatgtcaacactggggaatctgaaacctcatgccctactcagaagaaaaacacgaaagaaaaagctctttgagatttagggtatctgttcttttgctcatcttacagcacagagctactctgaaattatgttaaatgaaatatcaataaaaataaagtttactaaaaataaaaagcatccttaataaacactgtcaaagatcaatatttttcattttgttcagctatgagtaaacattttccttcatttttaaaaattaagttgcatttttggccattg

SEQ ID NO: 7292 - DNA, 1484 bp, Homo sapiens
aaacctttcagggctgctccgagggccgcagctagagtcggcgccacgagggggccgagcagggtgcggcggcggcggggcgctccggggaggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtatgccatggctgtgatgaaccaccatgtatgccctgtggagaactggtcctacaacgagtcctgccctcctgaccctgctgagcaagggggtcccaagacctgctgcaccctggacgatgtccccctcatcagtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtattttagtacttttttttatattaaaagaattctaatttgc

SEQ ID NO: 7293 - DNA, 1518 bp, Homo sapiens
gagggccgcagctagagtcggcgccacgagggggccgagcagggtgcggcggcggcggggcgctccggggaggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtatgccatggctgtgatgaaccaccatgtatgccctgtggagaactggtcctacaacgagtcctgccctcctgaccctgctgagcaagggggtcccaagacctgctgcaccctggacgatgtccccctcatcagcaagtgtggctcctatcccccagaaagctgcctcttcagcctcattggcaacatgggtgctttcatggtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtattttagtacttttttttatattaaaa

SEQ ID NO: 7294 - DNA, 1776 bp, Homo sapiens
aggtggttgcctgcgcgccgccgactcgccaccgctccactgggccggcacccagcctctccttggcgtggcctcttcggttgtccagcccttctcccagccctggtccctcagaaggagggtaactcccttccagatgttacggtccgcctgcgtctctcagcacgccggtggcatttgggttgaccgcggaggcccccagtgccagagggtgttcacgttctgccgtgggctcagcccaaactttggacgctcagagacccaacgggagcgctggataaggtgttgacccccttcccctcccccttcccggccagttacccactcctggactttgatctctctccaccaggccaggacagctgatggttgtggcagaaacatctcaaggtagctggtccgcccccacttccccatctacctcttgtcctccccccaacaccaccaccaccctggctcccctccctcatgaccgcctggatcctcctgcctgtcagcctgtcagcgttctccatcactggcatatggactgtgtatgccatggctgtgatgaaccaccatgtatgccctgtggagaactggtcctacaacgagtcctgccctcctgaccctgctgagcaagggggtcccaagacctgctgcaccctggacgatgtccccctcatcagcaagtgtggctcctatcccccagaaagctgcctcttcagcctcattggcaacatgggtgctttcatggtggccctgatctgcctcctgcgctacgggcagctcctggagcagagtcggcactcttgggttaacaccacggcactcatcacaggctgcaccaacgctgcgggcctcttggtggttggcaactttcaggtggatcatgccaggtctctgcactacgttggagctggcgtggccttccctgcggggctgctctttgtttgcctgcactgtgctctctcctaccaaggggccaccgccccgctggacctggctgtggcctatctgcgaagtgtgctggctgtcatcgcctttatcaccctggtcctcagtggagtcttctttgtccatgagagttctcagctgcaacatggggcagccctgtgtgagtgggtgtgtgtcatcgatatcctcattttctatggcaccttcagctacgagtttggggcagtctcctcagacacactggtggctgcactgcagcctacccctggccgggcctgcaagtcctccgggagcagcagcacctccacccacctcaactgtgcccccgagagcatcgctatgatctaaggtctggggagggtggctggcccggcctccacagcaccccaccccatatcttctttccatttatttcgtaccaaaaacaattttgagaaagtattctgttgggatctgggcttcctcacttctggagaagtggccatcccatgcccacctgtgccatggaggagtgggccctgccagctgccacagctgcatgacctgcttccccaccccacggtgtcgttttgtttttaaaggtcacctgtcctcactcacccagccagcccttcaggtgccttctactcccagtgccaaagccagaccactggggtttcctgctgcaggaattgggggctgggaacagcagaggggatagaagtctggtggaggtggagtgggcacgccttagcctacggaaaggcccatttctgggcccactgagctgcactgggattcttcactctgcccctcacttcctttagggcaaataacacagcagaaccacgtgggtatttt

SEQ ID NO: 7295 - DNA, 428 bp, Homo sapiens
tgggcacacagccccttgggacaagctggcaccactgctgtccagcagggtggccctgacaaatatacttctagccagggcaatttccagagggcctgtagctgggggcatgctgcaggtgctggtgtggcatcaagccttagggacctcaacttgagtccccagcaacaataatgaggctgaatggggccagaaatcaaggtatgccatggctgtgatgaaccaccatgtatgccctgtggagaactggtcctacaacgagtcctgccctcctgaccctgctgagcaagggggtcccaagacctgctgcaccctggacgatgtccccctcatcagtggccctgatctgcctcctgcgctacgggcagctcctggagcagagtcggcactcttgggttaacaccacggcactcatcacaggctgcacc

SEQ ID NO: 7296 - DNA, 943 bp, Homo sapiens
ggctccagacacccaacctacccgtggccggatgtctgcctgagccccaccccgaatgccagcccttcttccctgagctcacccagccccagctccaggactgagagccccaggaagcttggagaggtgtgagagagacaggtgtccagcctcagccccgatccttcacctgcagagcccggcatgtggggctacctgtcgctgatgcctgtcttcctagctgtctgggctatctctggcgtctggatcgtttttgccattgcagtgaccaacaggactgtggacctcagtaaaggctttccctacatcagcatctgcggatccttcccccctcagagctgcatcttcagccaggtgctcaatatgggagctgctctggccgcgtggatctgcattgtccgttaccaccagctccgggactggggcgtcagaaggtggcctaaccagctgatcctatggacgggtcttctgtgtgccctgggcacctccgtggtaggcaatttccaggaaaagaaccagcggcctacgcacttggcaggggccttccttgccttcatcttgggtaacgtctacttctggctgcagctcctcctgtggaggctgaagaggctgccccagcccggggctgcctggattgggcccctccgcctgggcctctgcagcgtctgcaccatcctcattgtggccatgatcgtcctccacgcctgctcgctgcgtagcgtctctgcggcctgcgagtgggtcgtggccatgctgctgttcgcgctcttcggtctcttagccgttgacttctccgccctggagagctgcaccctgtgtgttcagccgtggcccagcctcagccccccgccggcctcccccatctccctgccggtccagctgtagcaggcaccctgacccgggccttgccctcaccagtgaagcaggaaagatggggccaatc

SEQ ID NO: 7297 - DNA, 875 bp, Homo sapiens
agccaggccagcagccctagcttctggaaggatccttcaggctccagacacccaacctacccgtggccggatgtctgcctgagccccaccccgaatgccagcccttcttccctgagctcacccagccccagctccaggactgagagccccaggaagcttggagagagcccggcatgtggggctacctgtcgctgatgcctgtcttcctagctgtctgggctatctctggcgtctggatcgtttttgccattgcagtgaccaacaggactgtggacctcagtaaaggctttccctacatcagcatctgcggatccttcccccctcagagctgcatcttcagccaggtgctcaatatgggagctgctctggccgcgtggatctgcattgtccgttaccaccagctccgggactggggcgtcagaaggtggcctaaccagctgatcctatggacgggtcttctgtgtgccctgggcacctccgtggtaggcaatttccaggaaaagaaccagcggcctacgcacttggcaggggccttccttgccttcatcttgggtaacgtctacttctggctgcagctcctcctgtggaggctgaagaggctgccccagcccggggctgcctggattgggcccctccgcctgggcctctgcagcgtctgcaccatcctcattgtggccatgatcgtcctccacgcctgctcgctgcgtagcgtctctgcggcctgcgagtgggtcgtggccatgctgctgttcgcgctcttcggtctcttagccgttgacttctccgccctggagagctgcaccctgtgtgttcagccgtggcccagcctcagccccccgccggcctcccccatctccctgccggtccagctgtag

SEQ ID NO: 7298 - DNA, 1990 bp, Homo sapiens
aaaggcttcggaaggaagcggctcgcccgcccacacccggctcctgccccgggtgactattaggggccccgggggggtggcagaagcccgagacccaggggatcaactctccccgaaggcctagcagcggggaccccagaataagtcgggggcgggccccggcgcggcaggagggggccgggcgggcgggtgagcagatcccaccccttcctgaaggaagcgccctacccgccgctactgctgccgccgccgccaccgcagcaggtcacagcccctcgaggcgacagcggccccgccgcaccagagcagtggtacaggcatggatgggaagaaatgcagcgtatggatgttcctacctcttgtatttactttgtttacttcagctggattgtggatagtatacttcatagctgtggaagatgacaaaattttaccattaaattcagctgaaaggaaacctggtgtgaagcatgcaccatatataagcattgcaggtgatgatcctcctgcaagctgtgtgtttagtcaagttatgaacatggcagccttcctagcccttgtggtagctgttctgcgcttcatacaactgaaaccgaaggttttaaacccgtggctgaatattagtggattggtggctctgtgtctggcttccttcggaatgaccttacttggtaattttcagctcacaaatgatgaagaaatccataacgtcggaacttccttgacctttggatttggcacattgacctgctggatccaggctgcgctgacactcaaggtcaacatcaagaatgaaggacggagagttggaattccacgggttattctgtcggcatctatcactctctgtgtggtcctctacttcatcctcatggcccaaagcatccacatgtatgcagccagggtccagtggggcctggtcatgtgcttcctgtcttattttggcacctttgccgtggagttccggcattaccgctatgagattgtttgctctgagtaccaggagaatttcctaagcttctcagaaagcctgtcagaagcttctgaatatcagactgaccaggtgtaaaccatcagtttttccttgctggtgaggtgggtgtgacagtgggggaggggccagtaggacacactcacaggacttgacatagaacctcatttcacacacacacacacacacacattcatggccacatttgccaaatgagcttttcagggcgagttatttctttaatgaaaaagcacaagcccttatgtgtcgaaatacacgctgttacactgaaaatatatgcacgacagagcaagaagcttgtgcatgatcacttcttatccgtccccttcccagcactccctcctcttcccattctctccacatgtctcaagcaccctaccgagtagggcaggccaaatgttccttgggagtaatgccaactcccgacgttgccttcaggtccaaagggcttggaaccagctcgtgaggaagttctgaatctggcactaatattcttgagtggataatagtgtatcatagaataggacggaaattgtattgagatgtgaccctgtgtcgcctgtggaaaggcatagtgagaagaactttcccacgaaagcccccttcatcgttgttcagtggtcggctgtgtggatcccaggagagacatatgccacagactgtgagagcaaagcccgccgctgtgatctggacttgatgcactgtgactgagaatgatttccaaatgtgaatatgtgtagggacgtggtctatcaggcctggaacaagatgggggcagtgaaggtatggtttagtgtttgctttcatagtatgccatgtacaatgttttatatttcatagtttcttttaagtaactaccatgagtctctctaagcctcatggacaaagatgtagaccaaatgcaagagctgagcttgctttgggttcaaccatgatcaaagaaaaactgaggtcacctgcaggcttacgtgggaagct

SEQ ID NO: 7299 - DNA, 403 bp, Homo sapiens
actgctgccgccgccgccaccgcagcaggtcacagcccctcgaggcgacagcggccccgccgcaccagagcagagtctcactctgtcacccaggctggagtgaagtggagcgatctcggctcactgcaacctccgcctcctgggctcaagcgattctcctgccttagcctcctgcatagctgggactacagtggtacaggcatggatgggaagaaatgcagcgtatggatgttcctacctcttgtatttactttgtttacttcagctggattgtggatagtatacttcatagctgtggaagatgacaaaattttaccattaaattcagctgaaaggaaacctggtgtgaagcatgcaccatatataagcattgcaggtgatgatcctcctgcaagctgtgtgt

SEQ ID NO: 7300 - DNA, 1652 bp, Homo sapiens
ttgtgcaaaaaccctaggtgtgcggacgaaagagagccaggcagaaggttacaacaggtcaggaataaataaccaccaggcggaggatccaagattctgtccttccttttgttggatgaggagcgccaggcaaacgcgtccacaaaggcttcggaaggaagcggctcgcccgcccacacccggctcctgccccggtggtacaggcatggatgggaagaaatgcagcgtatggatgttcctacctcttgtatttactttgtttacttcagctggattgtggatagtatacttcatagctgtggaagatgacaaaattttaccattaaattcagctgaaaggaaacctggtgtgaagcatgcaccatatataagcattgcaggtgatgatcctcctgcaagctgtgtgtttagtcaagttatgaacatggcagccttcctagcccttgtggtagctgttctgcgcttcatacaactgaaaccgaaggttttaaacccgtggctgaatattagtggattggtggctctgtgtctggcttccttcggaatgaccttacttggtaattttcagctcacaaatgatgaagaaatccataacgtcggaacttccttgacctttggatttggcacattgacctgctggatccaggctgcgctgacactcaaggtcaacatcaagaatgaaggacggagagttggaattccacgggttattctgtcggcatctatcactctctgtgtggtcctctacttcatcctcatggcccaaagcatccacatgtatgcagccagggtccagtggggcctggtcatgtgcttcctgtcttattttggcacctttgccgtggagttccggcattaccgctatgagattgtttgctctgagtaccaggagaatttcctaagcttctcagaaagcctgtcagaagcttctgaatatcagactgaccaggtgtaaaccatcagtttttccttgctggtgaggtgggtgtgacagtgggggaggggccagtaggacacactcacaggacttgacatagaacctcatttcacacacacacacacacacacattcatggccacatttgccaaatgagcttttcagggcgagttatttctttaatgaaaaagcacaagcccttatgtgtcgaaatacacgctgttacactgaaaatatatgcacgacagagcaagaagcttgtgcatgatcacttcttatccgtccccttcccagcactccctcctcttcccattctctccacatgtctcaagcaccctaccgagtagggcaggccaaatgttccttgggagtaatgccaactcccgacgttgccttcaggtccaaagggcttggaaccagctcgtgaggaagttctgaatctggcactaatattcttgagtggataatagtgtatcatagaataggacggaaattgtattgagatgtgaccctgtgtcgcctgtggaaaggcatagtgagaagaactttcccacgaaagcccccttcatcgttgttcagtggtcggctgtgtggatcccaggagagacatatgccacagactgtgagagcaaagcccgccgctgtgatctggacttgatgcactgtgactgagaatgatttccaaatgtgaatatgtgtagggacgtggtctatc

SEQ ID NO: 7301 - DNA, 2562 bp, Homo sapiens
gccgcgctcgggctcgagctccgcgcactccctccgcggccgctgagccgagcggacgcccccgggggccgcgtcgcagccctccgtgctcccccctatcatgcccggtgcccaggctggggccgcccaagcagccaggacaccatgcccgaggacggcgctggcgacggcggggaggtgcccgcgctcatcccggacggcgagccgctgcgggaagagcagcggcccctgaaacagtccctgggaagctccctgtgccgcgagtcgcactggaagtgcctgctcctcacgctgctcatccacgcctgcggggccgtggtggcctggtgtcgcctggccacagtgccgcggctggtcctggggcccgaggccgccttggcccggggagccgggggcccgccaccgacctacccggccagcccctgctccgatggctacctgtacatcccgctggccttcgtctccctcctctacctcctctacctggctgagtgctggcactgtcacgtgcggtcctgccaggcgccacgcaccgacgcccacacggtgctggcgctgatccgccggctgcagcaggcgccgccgtgcgtctggtggaaggccaccagctatcactacgtgcggcgcacacgccagatcacgcgctaccgcaacggcgacgcctacaccaccacgcaggtgtaccatgagcgcgctgacagccgcacggcccgcggcgagtttgactactcggcgcacggcgtccgcgacgtctccaaggagctggtggggctggcggagcacgcggccacgcggctgcgcttcaccaagtgcttcagcttcggcagcgcggaggccgaggcctcgtacctcacgcagcgggcgcgcttcttcagcgccaacgagggcctggacgactatctggaggcgcgcgagggcatgcacctgaaggacgtagacttccgcgagtcgctcatggtcttcgccgacccccgcagcccgccctggtacgcgcgcgcctgggtcttctggctcgtgtcggcggccacgctgtcgtggcccctgcgcgtcgtggccgcctatggcacggctcacgtgcactaccaggtggagaagctctttggcgccagctcgcccccgccgggggccgtgcccagcgggcccccgctgtcccgcgtggccacagtggacttcactgagctcgagtggcacatctgctccaaccggcagctggtgcccagctactcggaggccgtggtcatgggcgcgggctcgggcgcctacctcagaggctgccagcgctgccgccgctctgtcagcagcaactcgctgccccccgcccggcccagcgggccccgcctgcccttcagccgcagccgcctctcgctgggcgctggcggccgggccacgccaggggtcttccgcagcctgagcggggggccgctggggcgccgtggagaggacacggaacccctggagagcccgccctgctatgaggacgccctctacttcccggtgctcattgtccacggagacagcggctgccagggggatgggcagggtgctctctgagaccccccacggcccccagagtggccccctccccaccattccaccatgggcttagatgcccgagtgattgttgtccaaaacaggcgggaaaacagaccagccacacacaaggggcaggggtgagggtgggggtgggggtccttaaacagactaaaatgcagttacctgtggtcattttggaggaagtggaagcctaagaatcgcccccagcatggcttcatcccccaagatggccgatgatctggcctgaaggcctctcacaaagggcaggagaagaagcttccagaaaggctgggatggaggaggagtcctgcggccagctgttgcctgcagcagaggctgcctgtggacacttccctaccggggctgaggccatgctgggagcccccccagtgacgcagaagcacaaattggaggcttggggccatgcccagccaggttggcttccctggggctgaagagctggctgtggtggcaccatggccttggccctgctactcacccaacattcccatcctcccctgataggcccctcctccttgcctgccctctctcccgctgctcagggccagtcactccccccacatgcagctacccctacaacctggggttccttctcagggcctcacctggtccccacatcccctggcctctgctcctgcctcccaaagtccatgtctgcctccatcagccacacacacgcagggacgcccgttccttgccctcccggacttatctactcttcactttcctgatgatccatggggcccaggcctagagggcatccgaggggctgggccttggccacagcctcttggatgatgtccttgctccaccacgcaggcccttgcttctcccatcaacgagtcttggcccaggggacactgaccctcccccagggaggagagaggagttccttccctttcaacgagggcttccacgccctctaaggggtggcggggaagggaggaggctgagaagatgcagattaaataaaggtatggaatggaa

SEQ ID NO: 7302 - DNA, 3061 bp, Homo sapiens
atgtccccccctggctcggccgcgggagagagcgccgccggcggcggcggcggcggtggcggccccggggtctcggaggagctcacggcggcggcggcagcggcggcggcggacgagggccccgcccgagaggagcagcgtcccatccagccctctttcaccaagtccctctgccgtgagtcccactggaagtgcctcctgctctcgctgctcatgtacggctgcctgggggcagtggcctggtgccacgtcaccacagtgacgcgcctcaccttcagcagcgcctaccagggcaacagcctcatgtaccatgacagcccctgctccaacggctatgtctacatccccctggccttcctgctcatgttgtacgccgtctacctggtggagtgttggcactgccaagcccgccatgagctgcagcaccgtgttgatgtgagcagtgtgcgggaacgtgtgggccgcatgcagcaagccacgccctgcatctggtggaaggccatcagctaccactatgtccgccgcacccgccaggtcaccagataccgcaatggagacgcctataccaccacccaggtaccaggctgcctaggaagccaggtggtgcctttaagatctccatggagaaacgcacagctcgacgcaggatccgacgaagaaccagcctaaaggggttcagagcccagacatgaatccccagcggctcatggtcagcaatatggggagtgggaaggacgaggtccagtgtgtgctcccacctcaaagctctccctctccccattcctcctactggctcaaccagacccacctctcctgttccctccctcctccacctgagacccccagcagcccctgtcctctctgtagcccttccagactcacgggggacctgacatcccagggaagatgccatcagagatgcagacactgagtgtgcggatgtggtcagccaccacgcggtacgctgtgtctgtgcgcccctcgtctgccacccctactcggcccaagtaagggggtgccctgcagccctgggaagcagaagagtcagccagtggccctgcctgacctggcccaggtgggtgctctttatcgcctctagagcatctgccctcagccctaaagccaaccacatccagaatggccttgccagtccagtcctgggctgagaagcctcacagatgagcacaagccaggccctgccctcacggggctcatatttggtgctacaagtgaacatatctgtgaccatttactgaatttctactatcagaactgggtgagtacttgaacaacatggcctcgaatccccaaaacagcccattccaggaggtattagcatgcttgctttaaagaagaagaagctgaggctcagaggaactcagtgacacaaggctacccagctctcaaggagcagatctgagatctcagccgggcctgttggactccaggtgctctccactacctgttcttgcctctcccatcttttgtgggggtgggcagggagggagagtgtaagctacatacacggaaatgctccaaagcagggagcttgattcacttaccaccaaacctctctcttccccaagcttcttcgtctaacagtcatgccattcactgtgttgctcaagtcaatagcctgggagccatctttgaattctttttcccctacccgtcatgatccatcagtggttccttttgctcctacctccatgacatctctcaaatcaatctacttgtctctacttccactgctattatccgaagcatgccctgtggtccttgcctggaccgataatagcctcccaactgattcctaagtttctgctctcatctccctccagctcatcctccacacagcaacaggagtgagccaccgtgcccagccctgagaactcttctcaccactctgagaatcaaggccccactttggactttgaggcccacaagactggattctgccttcttctctgtgagactgttcacaaaaatggccctttcctaggcatatgccactttaaaatgggactttacagctgtttcccatcaagggacagaatccatttctccatcccctgaatctctgctggctttgtgacttgctttggcccatagaatacagtggaaacaacactgttctgagcctatgtgtctgctctctgtcttggaaccttgctgagctgtgatgtggacaagcccagactagccagctaggtgatgacagacacatggtccagtcacccctactgcccccaaactgacagccagccaagccccagaggagctgcggcctctcagctcaccacagatggatgaatgagctcacacaagaccaaagaatgagccagctaagcccagcctaaacgctagctcacagactcagggggcagatacatggttgttggttaagccacagagcattagggtggttatacagcaaaagccaactgacacatgttcctactatatcccatgggattctcctttagctggctggccaccttttagtttttggcacatgtcaagccctttcttgcggggcaaggagggagggtataagctacacacatgtggaaatgctccaaagcagggagcttgattcacctagctccaaacctctctcttccccaagcttcttcatctcagtaaacagtcatgccattcactgtgttgctcaagccaatagcctgggagccatctttgatttctctttcccctccccatctaatccatcagtaccaaggcccttggtacctgctgtcccctctgcctggaaagaacttcctgtagctgactcctcctttggggctcagctcaaaggtcatcttcttggtgagccttccccaagcaccttatctaagattcctctgtacccctccttcttcctagttactttcacccatgtttactgcctgttcacaatctgtaagctattaccttgttctttaacacatttattgattgtctatctctcatgctagcatataatctccatgatctctttcctgcttactgctgtgtcttctgtaccaaacacaaaggatttaacataaagtaagcactc

SEQ ID NO: 7303 - DNA, 4895 bp, Homo sapiens
cgggagcgggcgggaggcggagcggcgccgcgagggcctcaaggtgacacccgcccccggccccggccccccccggcccggccccccagcctgcctcccaccctcagcccccagccccttactcccggtgccctttccgggccccctcccccggcggggggtggggagcagcgagggccccgccccctcccgtcctctccccagggcccgcgcaggatgcccccggcccctggcagccccccgggaggtcctgagctcgacgcgccccctctacgccatgtccccccctggctcggccgcgggagagagcgccgccggcggcggcggcggcggtggcggccccggggtctcggaggagctcacggcggcggcggcagcggcggcggcggacgagggccccgcccgagaggagcagcgtcccatccagccctctttcaccaagtccctctgccgtgagtcccactggaagtgcctcctgctctcgctgctcatgtacggctgcctgggggcagtggcctggtgccacgtcaccacagtgacgcgcctcaccttcagcagcgcctaccagggcaacagcctcatgtaccatgacagcccctgctccaacggctatgtctacatccccctggccttcctgctcatgttgtacgccgtctacctggtggagtgttggcactgccaagcccgccatgagctgcagcaccgtgttgatgtgagcagtgtgcgggaacgtgtgggccgcatgcagcaagccacgccctgcatctggtggaaggccatcagctaccactatgtccgccgcacccgccaggtcaccagataccgcaatggagacgcctataccaccacccaggtctaccacgaacgcgtcaacacgcacgtggcggaggctgagttcgactacgcgcgctgcggcgttcgcgacgtgtccaagacgctggtggggctggagggcgcgccggccacgcggctgcgcttcaccaagtgcttcagtttcgccagcgtggaggccgagaacgcgtacctgtgccagcgcgcgcgcttcttcgcagagaacgagggcctagacgactacatggaggcacgcgagggcatgcacctcaagaacgtggacttccgtgagttcatggtggccttcccggacccggcccggccgccctggtacgcctgctcgtcggccttctgggccgcggcgctgctcacgctgtcgtggccgctgcgagtgctggccgagtaccgcacggcctacgcgcactaccacgtggagaagctatttggcctggagggcccgggctcggccagcagcgcaggcggtggcctcagccccagcgatgagctgctgcccccgctcacccaccgcctgccgcgggtcaacacagtagacagcacggagctcgagtggcacatccgctccaaccagcagctggtgcccagctactctgaggcggtgctcatggacctggcggggctcgggacgcgctgcggcggggcaggcggcggctacgcgccctcgtgccgctacggtggggtaggcggcccgggcgcggcgggcgtggctccctaccggcgcagctgcgagcactgccagcgcgccgtcagcagctcgtctatcttctcgcgcagcgccctaagcatctgcgccagcccgcgggccggcccggggcccggtgggggcgcgggctgcgggggcagccgcttctcgctgggccgtctctacggctcccggcgcagctgcctgtggcgcagccgcagcgggagcgtcaacgaggccagctgccccacggagcagacgcggctgtccagccaggccagcatgggggacgacgaggacgacgacgaggaggaggccgggccgccgccgccctaccacgacgccctctactttccggtcctcatcgtccaccggcaggaggggtgtctgggccacagccaccggccgctgcaccgccacggctcctgcgtagagacctcactgtgacctccggccccggagtggcccgcgccgtcctcccgcctgcccctcgccggactgtgctccctctgcgacgcagggcgagtcaccacggtgactgaggccgcgcggggggcagggaaagggaggtgagggccgcaagacaggcccggatggggccgagacccccgctgtccctgtacataaagagaccgatgggtgggagggggtcggctgctccccgagatccccctggcagagtcattcttccagccccaaccctgagttcctaaagggacacctccctcctgtccagcccttcaacagatcttctgttagatgacaaccgtgccgtgggccccgcgttgggccttgtctgaagggagaggccctggcatgcggatgggagatttagaggctgtggagaagggaacttggggctttccttccttcgtggcctcactcccctggggcctctctctatggagggggcaatggtttggtgaccagcaggctggattccaactagctaatgcattcagcaggtctgaggctggggccaggtgtcagccctaggcctccatccaacaccgtggaaatgttgctgccctcttcttggcgctgaccccaagattggggtttcctttctgccgctccctccactgttgtttatctaactgggcccccactccaggtccagagggactgtgctcactgcacagacatcactcaccttccgctccccagtcctgcagagctgttgccagggtgcagtggggaggggagtgaaatgtggaggactgtgtacctcagtcctctctctaaactcctcagcctcccaacaggggcctcctcacctgggttctgagtgtataccccttttagagagtgagatgccacccgggcagcactcgttaaagctggccagcacgagtgactaaggggagagagcatgacatagacctgggtggcaacggggacctctggaagcaggtgggagtaagagaggagagggcagtggagggtagaggaaaaggacctccagaggtggggtgtctgtgggggcggcctttgcctccctaaacctgtgcggaggagtggagtgtgcttgtcgctcaaacacatctctgggggactgaggacgttgtcacaagccccaactggagaaataattccaatggcagggtcagaggcaagcattctctaaatcttgcccaacccttccatccttccctatcctatgagctgaagccctgctgtgtgtcgcagggtcttcaaaggggcatcctgccaccaccccagggcgctggccccacgtcctgttcccctaaagctctgacaccgccttctctccgtgtgctccccccaccacctccaccctgatgtgcttcagtgtgcatgtctgtgaacagccctcctgccctgccaactcccctggctaaagtctccccagcagatttagcacccagggattgagctcacatttcaggctagagaggataacccttgggccacccacatctctcacccctgatgcttcttacttcgcctgagccatcagaactcctccttaccctccttcagcccctctcatcttccttcagcccagccaggcctgcaccaccaactgtgtggcctccacctatgcaacatcgcctctggctccccttcccttcttcctagcggggagtgcgaggggcccaaattgtggggataccatggcccatggcttctaaagggtttagctttactttcaggtagagatggctgagtgaggagggagaagaggctagagagagggaggcttgggcaggggaaacagctgcccaccaggttttcctggacagcagtgcccacctgcctactagcactgaacctgcctggaccctgagtctgtgctccttgggggcctggcgtttggagcacccttctttcctctgaatggacatctgtgaggtacaggtggtgagctgcagcctcaggctccatttcttagccagctggcacctggatgtcatgctttgtgtggggacagcctggccacctcagggctccaaggaaggaggaacgtggctcctcctccctcaggcctgttcctgagacagagcctggtctcacaagaggggaagggggacctctattattatttttgcctgtattgaccatttctgcctaggtcgtctcagacagcctcatctcccacacatgcacagacttagagagaaaccaattctttggtctattttcttggtagctttactgattgccagggaaaatgaaaaccagaaaattaattaatctctaaaattaaactttacactgaatgttcttgtttctctaattagaacttctgctagcagctgtggctatacacacacacacacacacacacaccctcacacctacacgtttgcactccggaactgtcagagggtgtcaggcacagacagactctaggttgcctagacaggcacacacatgcagtcactcccaagccccctttggtgctctgctcagcgcctgcttagcggaaggagtccctggagagcaggcactcctggactggggttgtagcccatgacctgccctttggggacacagttctggaggctctgggccaatgaatcagcccaaggaggatgggcaatggcgctcagcctgaatcagtcagctaggtctcttgtggccctgggggctgatgtgattcctgtaggtgtggccccagggtggacagctacagagtgatgggggactcatgtagggcacctggaaggctccatgtgtcctggggacaagggcttgtggggtgggctgggcctggctggggagaagacaggtctctgtcaattgggtgcatcacactgtggcctttttgtcgtggatttaagcgcaaagattgtacaaatcaaactggtggataataaagtcgtggatgactcactga

SEQ ID NO: 7304 - DNA, 10698 bp, Homo sapiens
ggctggagaggcgtgataatagaaccagtgcttcaacagcaacttctcttttgcaatccttgctggtctgacaggctcctgcagaattacatcacttcctaaaaaacaggcacacacctctccttcaagtcagcaccgacccaaacaagcaggaaacaggaaatgttcacgtttcagagaggctgcagcccggcgcagcatcctgagcgcgcctctgccgaggcgagcggacatgcaggctccccgcgcagccctagtcttcgccctggtgatcgcgctcgttcccgtcggccggggtaattatgaggaattagaaaactcaggagatacaactgtggaatctgaaagaccaaataaagtgactattccaagcacatttgctgcagtgaccatcaaagaaacattaaatgcaaatataaattctaccaactttgctccggatgaaaatcagttagagtttatactgatggtgttaatcccattgattttattggtcctcttacttttatccgtggtattccttgcaacatactataaaagaaaaagaactaaacaagaaccttctagccaaggatctcagagtgctttacagacatatgaactgggaagtgaaaacgtgaaagtccctatttttgaggaagatacaccctctgttatggaaattgaaatggaagagcttgataaatggatgaacagcatgaatagaaatgccgactttgaatgtttacctaccttgaaggaagagaaggaatcaaatcacaacccaagtgacagtgaatcctaaacctgaatggcgctcatgttttccaagagaagcagcccctgagggagtctgctgaggctgccaacagaggatgaagaggatacaaatttaattaatttcaaatcaacatagacacaagaaccttttgctgtttcttccaacgcccactcttcctaatgatggcatcacttgcacttggaagaatgtgcaattgagaagtactaggaaaaggcctggctgccatccatcgctgcctctgagggtggagaaggaggcgggtgatgtgctcacttctgatcaacatgtgttgcctcctctcagccaacttctagctcactgaactcactctggtcatgataaatgttcgtcacctttctgcttcattccttagggcctaaatcaggaagctgttttatcgatggtttccttttgggtcagtaaccagctttggataatttcctctgattattcaagtcgtgggacaggtaaactacattcagcaggaacttttctcgaggagtgttatgtcatggaaaagacaccaaacacagcaagtattttaatgaatacaccatcccagggggtcagtaagctctgcctgccaagaagacacagtgagaggggtccacagtcctgatgaggtggcgtttggtaacttgtagaccctagcatggccaggtctggtcacccttaagaacttctcagagaaactaggaatcttcagtgaaagaactaatgttctcctcagctgaaattcccttgcttgtcagcatttctgcaaagctcacacttgtttcaccatacctcccttggatgtgacatgtaggtaggaagtatgtgcaggtgggagtcatctgtcagccttctatgtttcagagatcctgaaggtggtttgaaacaaacagaagaggagcaggaaatatccgtgcctgtggcagatctcactcatcatgcttagcattctctcccgccaagctgggataagcctcatgtcctaacacagcacaacaggaggtctctgtcagtccatcagagatgacattctatgtgatatttttgacatccttgtgctaaaagcaatggcacaaaatggaaaagggcctattgaccacacctactccagtaaaattgttcttcatttattccttaattttctaaatctgacccctttaaagcaatctagcaaattgagaatcctcagctctccttggatacctgatattttatttcaagaaagagacaaagaaggaaaattttatttattttactacccacatataaaccgaagggagatgggactacccaaacatttgctgctcaattttgtgtcttgtgcttgaaagtctgccctaatgcataacaaaaactacttgtctcctaccttttgggatccctttaacaagtatttgccttctgaactacgtggataatttcaaaggcagagttccagaccagagaggtctttccatacaatgaaagctataactagctggttgtgtttaaccactgctatcacgctatcctgggactgcatagaactttgacaaaagacagacttcatggtacacaacttcaacagattttctgtcatattctcaccagcacatctgaatgaggctttgtgttttccttgctctcttgcatgttccttttcaactcatggcccacagtgactctcagatatttatgccaaaattgcatacaattgttttctgaatcataacttgtctatttttctgcctatgtgtgctactttcagtttgtttctcatcaacattttgactctcagaagagcctccatttgcccctttctctctttaggtatctaagatctttgaacacctgggcctttacatttgatccaaccctatcaaataatgaacttctcagagaggcatctggggtcctggaacttcatgttgatgaagtcatattatataatatgataaaaatattctcatgcagtattttaaataatttcaaattctagaagaagcaaatttcagcgacatgtcattgagtttttatttggtaaagctataattgtgcagtgtacaaagcactttttaaaaagatagtttattctgtcagggtatatgaagttagtatacagccagaacagccaagcctcaattcttgtaccttgtgtctttttattactgtttaatcaatagatatcatatgtttatgacagtttcaagaattgtttttaaacccaaacttaattttatgtttcagactattgttaaaaaaacaaaacaaaaaccaaaaaaaccctcactaatttgccctaattggatagggcaatcagaacaaaatctgactttcgaatatttaaaagatatgtaagtttgattgcattttcgtacattttaagcaaactaggttaacaacaacatagcctagtcaaacttctcaggaaacttgttttaataaatatgtaaaaatacccattcatgactcttgacccaatggtgtgactcctccctctgggaagggctttgttacccaatgcaagaccacagcctggatccaccttgatgtaggtggctcctggataacccacatcaaacaaatgtgataaagatgagtaaaactggtcttgggaaaataatttcatagtttttttttctcctagttatgctgtataatacaggagaaccaaaagctgtaaaattattttattttattttttaaagacagggtctcactatgttgcccaggctggtttcaaactcctgggctcaagcagtcctcctgtctcagcctcccaaagtgctgggattacaggcatgagccactgagcccgaccagctgtaaaattattatattcattttcactatgtgctacttcttctcacctgactttttttttttttttttgagatggagtctcactctgtcacccaggttagagtgcagtgtcacgatctcggctcactgcaacctccgcctcccaggttcaagcaattctcttgcctcagcctcccaagcaactgagattacaggcctgtgtcactatgcccagctaatttttgtatttttagtagagatggggttttcaccatgttggtcaggctggtctcaaactcctgacctcaagtgatccaccagcctcggcctcccaaagtgctggattacaattgtgagccactgtgtctggccacacactgactttcactgtaatatctggatgttttatgtaacatatctgggcaatagggcttatggcagaattggccctcgtggtgtaggccttccaagttccaagtctcatttttagtattcctccgttccaacccctggatccaccagttccaacagcctggatccaccttgatattgacagccaggcagatgcttctgctgatcaccgcagctctagcaatggaaatggatatgttaagaaaatacttgtctattcttttattttggtggtttaaactattaattcacaccatctctgaaaaaaggccttatgttgactaaagaaaacataggctttagtttcagcttctgtcagaattagtaccaattctgaatctggtggagtgataagacatggtttcatgctgggaagacactgctgaaatcctccttgtgggagaacatggaaattttatactgaattaaattaacgcatgtgacttttcacattcagagacattcaggatgaattctggggtttccatttaatagctataacaggcagtccagaacaacttcacatatagcagcatttctgctatgtgacaatgaccaaaagagttcctgtatattagtgtctagtggaatatttcaaattgcagaacccagacaaccaattgcctgaattattattattttttgtttttagcaactctttggctttatcttgatactgtcttgtctggcaccaaagttttatttccttcttagtcctcttggggatagtttttgggtgtttttttttatttttctttttttgagacggggtctcatgctgatgcccaggctggagtgcaatggtgtgattatggctcactgcagcctcaacttcccaggctcaggtgattctattacctcagcctcccaagtagctgggactactggtgtgcactactaggactggctaattttttgtatcttttgtacagatagggtttcaccgtgttgctcaggctggttttgaacttctaggttcaagcaatcctcccaccacagcctccaaaagtcctgggattacaggtgtgagccaccataactggctggaattatttgtacctggaccttgtgttttgtttttttgccctactatcttttctaaataacatatcatgttcctgagatagcagtatatacaattatgtaaaatagagctttatatgaactctgtacatgctctaagctctttttgaatgatattttaagaagtttctaaaccaaagtgcttaagaaaacatgaagatgttaatttcatgaagactgtacaagtttagaagtacaatgtagacctgtttaagacaaaggtggatgggctttggggttttttttacaattggacttcaggtacagaaggcttgggtaatggtactcctcagttcatatcaccttatcattggcctttagtattttgtaaataagtaactggacttttatgaaaagcatattcttaacagtttcccatttcctttttttttttttttaagatagtgttttgctctgttgccctggctggagtgcagtggcatgatcttggctcactgcagcctccacctcccaggctcaggcgatcctcctgccccagcctcccaagtagctgggattacaggcgtgcacaactgcatgcacaactaatttttgtatttttagtagagacagggtttcgccatgttggccaagctagtctcaaactcctgggctcaagtgatccgcccacctcagcctcccaacatgttgggattataggcataagccaccatgcccagccagttttcatttctttggtctgcatgtaaaggactaaagaatgatatgtagctactacactgcagcaaacaacatttttccagtgtacaaatcagtggagagtaagcaatgtattactctgatgtcggtgaaacacctcaaattataaataatgccaggaacatgtgaaaactccacatgtttaataaatgccagctttcagaaaaagcagagattataggtattcaacaagttaaacaataatctggtagattagtaataatttaacacatgtgtatcttgtatttaaagttaactgaaaattatgtaaaaaaaaaaaacactgtgtttgactttcttttgttttacaagtgatgcagagtatctgctgagaaggtcagttagatcatctgatgtcatatttgccacttagcttttgtcccagcagcatataaattctaccttgtaagcctcatattagaagtggtcccagccaggcacagtggcttacttcccaacactttgggagtccacggctggtggattgcctgagctcgggagtttgagaccagcctggccaacatggtgaaaccccatttttacaaaaatgcaaaaattagccaggtgtggtagtacacacctgtaatcccacctactcggggggctgaggcccaagaatcacttgaacccaggaggcggcagttgcagtgagccaagattgtgccactgcactgcatcctgggtgacagagcaagattctgtctcaaagaaaagaaaaagaaatggtcccattgctacggattagaactaatttgtaaaactatcagaattttaagactgattaaaggttttaggtgtttttctcctactttgcatactgagaataatatgtatagtatttttccagtatgatttacaattttataaatgtcagtatacatatgtatatataaattattctcaactccatttttttttaaataaaataagtacatgtttgtgtgctaaattgctcatttggcagtgatagattgaaaaacatttataaatttaaaaataaagcactataagatatgaggaatgaatagcttctatgtgaatttctatgtaattaatatcaatatttagaataaaagtgtatttgaggataagatatttgtttactaaaatgttttatttactaagagtagaggtgaattatgcatctttctaaggaaaagttcttttaatttctgtgtctatgaaaaagaattcataattcataattcttaattgccctcttttgatccatataattctttaaataaacgaaacaataccaattcaaaaaggggcctgctttgtataaaattgtctaacctaaaaattaagtagactttctgcatatctaaaatatattattacacattcttgtctttattcttccttacaaaacatttttaaatgaaggaatgaaattttaattgtttatgagaatataacttttaaaaatatttctagtaggccaggcatggtggctcatgcctgtaatcccagcactttgggaggctgaggcacgtggatcacctgaggtcaggagttcgagaccagtctgaccaatatggtgaaaccctgtctctactaaaaatacaaaaattagccaggcatggtggctgtcgcctgtaatcccagctattcgggaggctgaggcaggagaattgcttgaacctgggaggcggggtttgcagtgagtgccaagactgagccactgcactgcaggctgggtgacagagtgaaactccatctcaaaaaaaaaaaaaattctagtaaaaatggaaaaatccacaagaaaacctctttttttcctgattactcacttttcttcatgcctttaattttaacctcatctcacaccttgatattagaagaaagtaaggctgaaaggcagattcataagttgtagataacatgaagacttccttgaataaggatttattctttcggctcacaaagaccagtcagtattattgacaaacaacaggcaggaagatttctcctaaaagtctcaactaaagttaaacctggtccattatggcatcaatctacccctagaaactgatgcagagtctatttcctccctgttttaactagaacttagccagactggagacagcatggacccaaagagcatgcagtcccacagagttagggaaaggatgcatcttgaccagcattcatcatgtggatcagttaggaattaagttcctgattcaaggtgagctcatatggccgctccctggtcatctaggacacaagttccttctaactcttccccaccttcattagtacagggcttctttcctgtgttgccacatgatccaaaatggtggttgtaactccagcatgatattcacaagaaggaaagagagggaaccagcacaagggtgagcctcccaagtaggtcagccacttttaaatagctttcctgccagcccagtgaagcaactctgcttacatctcattggccaatctctgcaaggcagcagggaacagtcatctctatggttggtacattatcactttcaacaataagggattctgtctcacaaagtggtggaagaatattgggtatctgaagaggtagccaccctggccagaaggtgctaaacactaaacatacatcatctcattttaatcctagtaattacttatgaggtaggtttagagaacttataccttgttccatgtctttccaactccaaagcacaagtttttaatcactgcactgcactgcatccccaataactagccgtaggaaagtgttttaaaaggcatcacttggcggggtgcagtggctcacacctgtaatcccaccactttgggaggccgaggcaggcggatcacctgaggtcaggagtttgagaccagcctggccaacatggtgaaacccccgtctcaactaaaaatacaaaaattagccaggcatagtggcatgtacctgtaatcccagctactcaggaggctgaggcaggagaatcacttgaacctgggaggcggaggttacagtgagatgagatcacaccattgtactccagccttgtctaaaaaaaaacaacaaaaaaacaaacaaaaaaaagtttcagtcattgtcaaggatgccttaaggtgagcatagcctgagataagaagtaacagaggctgcaggctgagataagaaggaacagaggcagtgaaggcaggaccctaggcccagaagtaatggtctatcatgctgagaaaaaagccagggcttagaataggggtgataagtaaaaagcctagttttaaaatctaagtgctggtaaaggtttggtcactaggtgaaaaaataaagttcccacttactagagctgacataaacagcatatgatcctctttaaggttgcagtggagaggcatgtccagggactctcaagttagagacaggtgtgtttagtgctagaattggaaagacattcaagcagactggcatgttgcctcttcacagccatagtcgtgctggcttgcaggatactccagcctagaatgtatataggagtgtggagaacagcaaaatcagcattgcttgggattcagcctgagctcaagtggcccacccctggaggcatccagtgttcacacttcccaagagagaaaacctgattggatgggtgtttcagcagtctattgctgcttaaacacctcaaaacttagcagcttaaaacaacaacactcaatttatttttcacacaaatctgcaatttgcatgaggctcagtgcaaatggttcaactctctcccacacggcattggctgggcagttcaactggatctgggggtcccactttcagatgactcacatggctggcaagtttgttctggctgtcggataggagcccagccaagcctgtggtccagcggccttggcttttatgatgtgggcctctccatagactccttgggcttcttcacagcatggcagctgagttccaagagcaagtgtcccaagagagcaaagtagaaatgcatagtatttttataatttagactcagaaatcacatcacatcacttctgccatactttattgtttgagacagttacaaagtctacctaggttcaaggtggaaaggacataaaccccacttgtccttggaggcgtgtcaaagccacattatgagaagagcaagtgggataagggatttgttgcaggcaccgttggaaaatgtgatctgcccaaattggtgtgtcttcatgcaatatcgaggaaatatattaggtagtttcgtgtcaaggaacattgtggatatttgacctccctgaatcccagtgcctatgtgctctttggcttggacatagacccctggtccagtagtctgtagtaggtggtagaactagttttaccaactacatgagtcatgagccatgggactgaatgggttgtaggtggatcagacacatagaaatgtatgactactctcaaagcatgaggttaaaatgggagcagattagactgagcaccttgaggatagggatcagtcttactcatctctgtatcctgaaaagtgcttggcgctactgcacgctccataataacagaaaaaccaattatttaatgagctaggagttacatatcatctttccttaagtacctaatcagtctttatcatcagtgagtgcagaactcaaatatggtattgttcatcttccatcaccattttctcccaagtttcctggtttaattgcattttcctcactttccatctaatggatcctgatgtcattctttatctttatttcatattgtcctattgtgtgtattgtattgtatttttagctacattaaatccaatatggaaggaagcagagaacgatcataattgaactaacaagcaagtggaggtggagagaaagtggccccaatttggaaggtgaaggaaaactggggatggagcctaactgatcattaaaatgctcgaagcagctctttccaa

SEQ ID NO: 7305 - DNA, 878 bp, Homo sapiens
aaacaggaaatgttcacgtttcagagaggctgcagcccggcgcagcatcctgagcgcgcctctgccgaggcgagcggacatgcaggctccccgcgcagccctagtcttcgccctggtgatcgcgctcgttcccgtcggccggggtaattatgaggaattagaaaactcaggagatacaactgtggaatctgaaagaccaaataaagtgactattccaagcacatttgctgcagtgaccatcaaagaaacattaaatgcaaatataaattctaccaactttgctccggatgaaaatcagttagagtttatactgatggtgttaatcccattgattttattggtcctcttacttttatccgtggtattccttgcaacatactataaaagaaaaagaactaaacaagaaccttctagccaaggatctcagagtgctttacagacatacctcctggtatgaaatttgcagtgtcttgatgtgtgaggtctctctgaaagagctgcagggaaaacagcgggcgataaactacccctttaaacaggctgtggctacatgatgcctggcttactcagtaaatcttctggaaagagactctttctcttgctcactgctcagcgtggaaacaagaaaaggaagccagaggctcctgtagctcctgccctcccctagcctccaccagacaaccccactatcgaatgcacagaggagaggatctgagaggagagtactgtcaggctaagtgggggggaagtaggaactgaaggaggaggacaaagtgggttggaggagatgaaatggaaggattgttggagggaaaatggaataggggtttgagatggagctttgtaagagctgcatttgcctcctggttgcaaaggga

SEQ ID NO: 7306 - DNA, 1935 bp, Homo sapiens
atgaggtgaactgcattaacctaaagtgctgcagagataaacttaaagcaggaagcaacataccatgaatgtactgcaagggaacacatttgtgtcatgtgaagagacatgacaaaaacagccctccttaaattatttgtggcaatagtgatcacattcattttaattttgccggaatatttcaagacaccgaaagaaagaacattggagctatcatgtctggaagtgtgtttgcaatctaattttacctattcactctcctccttaaatttttcttttgtgacttttctgcaaccagtaagggaaactcagattatcatgagaatctttctaaatccctccaattttcgtaacttcaccaggacttgccaagacatcacaggtgaatttaaaatgtgctcctcgtgtttggtttgtgagtctaaaggaaacatggattttatttctcaggaacaaacatcaaaagttcttatcaggagaggatcaatggaagtgaaagcaaatgattttcattcaccttgtcagcactttaacttcagtgtagctcctctggttgaccacttggaggaatataacactacctgtcatctaaaaaaccacactggaagatcaacaatcatggaggatgagccaagcaaggagaaatcgataaactacacttgtagaatcatggaatacccgaatgattgtatacacatttctttgcacctagagatggatataaaaaatatcacttgttccatgaagatcacttggtatattttagttctattagtttttatatttttgatcatcctcactatccgcaaaatacttgaaggccagagaagagtgcaaaagtggcagagtcatagagacaaacctacatctgttctcttaagaggaagtgattcggagaaactgagagcattgaatgtgcaggttctttcagcagagaccacgcagaggctgcctttggatcaagtccaggaagtgcttcccccaattccagaactataagttacttccacagtgcatcagtgagatcaatatacacgaatatccccgggcaagttggaccgagccctttgaagaatactcagaagtttattttgtgaatgagtagactggaaaatgtttgtgtccagctgaggatgcacagttggaaagcaggaggaatgctgactggttgatgaaaactagcttaagagcattcattcgctccatgagatcaagggaacaagagtgtttgcaagaagccattatgagtcatggaaaaaaagatgatgaaacccatggaaacagcaagagaattcccactctctctcttcttaaaaaaaatctatcattatacagcacagagtggagccaagtttttaattttgaggaaccaaaaacaggatcaaatatgaaaaccctttcttttattgggccacattgtagatgctgatttgataattgtttcctatgcagatagattatttttatttcacagattatttaaaagggaagagggcctggttgtttatttatatgtttgtttgcatttatgaatcttgctgccttttagcaccaggatgtttttaaaaaaattcaaagaggccaggcgcagtggctcatgcctgtaatcccagcactttgggattctgaggtgggaggatcatgaggtcaagggatcgagaccatcctggccaacatggtgaaaccctgtctctactaaaaacacaaaaattagctgggtgtggtggtgcgcgcctgtagtcccagctcctcaggaggctgaggcaggagaatcacttgaacctggcaggcagagtttgcagtgaaccaagatcacgccactgcattacagcctggtgcagagcaagactctgtctcaaaaaaaaaaaaaaaaaaaaatcaaagataccaataaaacgaatttaaataaaatacttaagtactttaatagcaaaa

SEQ ID NO: 7307 - DNA, 654 bp, Homo sapiens
agtgcgaatcatgggaggcggctggtggtgggctcgggccgctcgccttgcccgtcttcgcttccggaggtcgctactgccgcctcagcggccccggagcgggggcgcccgggggtccttcgcccccggccacggtccccgcgccggggcttcgccgcccccagtgtccgagctggatcgtgcggacgcctggctcctccgaaaagcgcacgagacagccttcctctcctggttccgcaatggcctcctggcatcgggcatcggggtcatctccttcatgcagagtgacatgggtcgggaagcagcatatggcttcttcctgctgggcggcctgtgcgtggtgtggggcagcgcctcgtacgccgtgggcctggcggcgctgcgaggacccatgcagctgacgctggggggcgcggccgtgggcgcgggcgccgtgctggccgccagcctgctctgggcgtgcgccgtgggcctctacatggggcagctggagctggacgtggagctggtgcccgaggacgacgggacggcctccgcggaaggccctgatgaggcgggtcggccgccacccgagtgagcgacacggccgtggggcctggcaggcgctggacagcgcccgaggactgggacattaaacctgacctcccctcctcc

SEQ ID NO: 7308 - DNA, 1778 bp, Homo sapiens
gggtgagtgcaccgcgttctcgcacgcgtcatggcggtcctcggagtacagctggtggtgaccctgctcactgccaccctcatgcacaggctggcgccacactgctccttcgcgcgctggctgctctgtaacggcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctggtcctgcgcttcttcctggagtaccagtggtttgtggactttgctgtgtactcgggcggcgtgtacctcttcacagaggcctactactacatgctgggaccagccaaggagactaacattgctgtgttctggtgcctgctcacggtgaccttctccatcaagatgttcctgacagtgacacggctgtacttcagcgccgaggaggggggtgagcgctctgtctgcctcacctttgccttcctcttcctgctgctggccatgctggtgcaagtggtgcgggaggagaccctcgagctgggcctggagcctggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcctgggcccagctcctctactatcccccgacccatcctcagccagcgctgcccccatcggctctggggaggacgaagtccagcagactgcagcgcggattgccggggctctgggtggcctgcttactcccctcttcctccgtggcgtcctggcctacctcatctggtggacggctgcctgccagctgctcgccagccttttcggcctctacttccaccagcacttggcaggctcctagctgcctgcagaccctcctggggccctgaggtctgttcctggggcagcgggacactagcctgccccctctgtttgcgcccccgtgtccccagctgcaaggtggggccggactccccggcgttcccttcaccacagtgcctgacccgcggccccccttggacgccgagtttctgcctcagaactgtctctcctgggcccagcagcatgagggtcccgaggccattgtctccgaagcgtatgtgccaggtttgagtggcaagggtgatgctggctgctcttctgaacaaataaaggagcatgccgattttt

SEQ ID NO: 7309 - DNA, 1930 bp, Homo sapiens
aggccggtgggtgagtgcaccgcgttctcgcacgcgtcatggcggtcctcggagtacagctggtggtgaccctgctcactgccaccctcatgcacaggctggcgccacactgctccttcgcgcgctggctgctctgtaacggcagtttgttccgatacaagcacccgtctgaggaggagcttcgggccctggcggggaagccgaggcccagaggcaggaaagagcggtgggccaatggccttagtgaggagaagccactgtctgtgccccgagatgccccgttccagctggagacctgccccctcacgaccgtggatgccctgggtctggccagcatgacccagaacttagagccacttctgaagaagcagggctgggactgggcgcttcctgtggccaagctggctatccgcgtgggactggcagtggtgggctctgtgctgggtgccttcctcaccttcccaggcctgcggctggcccagacccaccgggacgcactgaccatgtcggaggacagacccatgctgcagttcctcctgcacaccagcttcctgtctcccctgttcatcctgtggctctggacaaagcccattgcacgggacttcctgcaccagccgccgtttggggagacgcgtttctccctgctgtccgattctgccttcgactctgggcgcctctggttgctggtggtgctgtgcctgctgcggctggcggtgacccggccccacctgcaggcctacctgtgcctggccaaggcccgggtggagcagctgcgaagggaggctggccgcatcgaagcccgtgaaatccagcagagggtggtccgagtctactgctatgtgaccgtggtgagcttgcagtacctgacgccgctcatcctcaccctcaactgcacacttctgctcaagacgctgggaggctattcctggggcctgggcccagctcctctactatcccccgacccatcctcagccagcgctgcccccatcggctctggggaggacgaagtccagcagactgcagcgcggattgccggggctctgggtggcctgcttactcccctcttcctccgtggcgtcctggcctacctcatctggtggacggctgcctgccagctgctcgccagccttttcggcctctacttccaccagcacttggcaggctcctagctgcctgcagaccctcctggggccctgaggtctgttcctggggcagcgggacactagcctgccccctctgtttgcgcccccgtgtccccagctgcaaggtggggccggactccccggcgttcccttcaccacagtgcctgacccgcggccccccttggacgccgagtttctgcctcagaactgtctctcctgggcccagcagcatgagggtcccgaggccattgtctccgaagcgtatgtgccaggtttgagtggcaagggtgatgctggctgctcttctgaacaaataaaggagcatgccgatttttacaaacagggtctgagtggtttgggactcgggcttgtgcagggtggtagctgtcttgcacgtccctgtggcacctgcccgggtgcagggtgggggctgcgcgggagggagagaggagcaggactgagaggggagcaaaggtctgggaggagaaaggagagcaagaaggaggccaggctcggcggctcacgcccgtaatcccaaatcccagcactttgggaagccaaggcgggcagatcacttgaggccagcagtttgagaccagcctggtcaacgcatggtgaaacccagtctttactaaaataacaaaaattaggcatggtggcgcatgcatgtagttccagctactgagaaggatgagccagaagagtcgcttgaacctgagaggtggaggctgcagtgagccgagatcgcatcacactccagcctgggtgacagagtgaaactctgtctc

SEQ ID NO: 7310 - DNA, 2594 bp, Homo sapiens
ggcagagccggaagaccctctctttcgctgtttgagagtctctcggctcaaggaccgggaggtaagaggtttgggactgccccggcaactccagggtgtctggtccacgacctatcctaggcgccatgggtgtgataggtatacagctggttgttaccatggtgatggccagtgtcatgcagaagattatacctcactattctcttgctcgatggctactctgtaatggcagtttgaggtggtatcaacatcctacagaagaagaattaagaattcttgcagggaaacaacaaaaagggaaaaccaaaaaagataggaaatataatggtcacattgaaagtaagccattaaccattccaaaggatattgaccttcatctagaaacaaagtcagttacagaagtggatactttagcattgcattactttccagaataccagtggctggtggatttcacagtggctgctacagttgtgtatctagtaactgaagtctactacaattttatgaagcctacacaggaaatgaatatcagcttagtctggtgcctacttgttttgtcttttgcaatcaaagttctattttcattaactacacactattttaaagtagaagatggtggtgaaagatctgtttgtgtcacctttggattttttttctttgtcaaagcaatggcagtgttgattgtaacagaaaattatctggaatttggacttgaaacagggtttacaaatttttcagacagtgcgatgcagtttcttgaaaagcaaggtttagaatctcagagtcctgtttcaaaacttactttcaaatttttcctggctattttctgttcattcattggggcttttttgacatttcctggattacgactggctcaaatgcatctggatgccctgaatttggcaacagaaaaaattacacaaactttacttcatatcaacttcttggcacctttatttatggttctgctctgggtaaaaccaatcaccaaagactacattatgaacccaccactgggcaaagaaagtatccctttaatgacagaagccacattcgatactctgcgactctggttaataatcctgctgtgtgctttgcggttggccatgatgcgtagtcacctgcaagcttatttaaatttagcccaaaaatgtgtggatcagatgaagaaagaagcggggcgaataagcacggttgagctacagaaaatggtggctcgagtcttttattatctttgtgtcattgcactgcagtatgtggcgcctctggtaatgctgcttcacacaactctgcttttgaaaacactaggtaatcattcctggggtatttatccagaatctatctctaccttaccagtggataatagtctactgtccaattctgtttactctgaattaccatcagctgaagggaaaatgaaggtaactgttacacaaataacagtggcactgagcagcttaaaaaatatttttactcctcttctttttcgaggacttctgtcttttctgacctggtggattgctgcttgcctcttttctacaagcctttttgggcttttctatcaccagtatctgactgtggcatgaatctcagttaacaaaaaagcatatccaaatcaccctttaaattaaaatatctgtgcccttaaagggctgatgaaaaccagaagaaagcaaatacaatgggaaaaaaaaaacatatcagaatgtcttgtattaaatgtttcctctgtattctcagggtgaattaatgtagtaatatttaaaattacaaaatagattgttaactgttacactgtggcattggaattttaactctttgtatttactggtatgagagggctatctacaagggtaatatttctgattaccctggtttacagaaacctccagcagtctttgaaacatctcacatgactctagttattgattgcttttaatggttttatggtactgttgatagtcatagtggctgcctatagaacaatcttcaaactgagccatgctttaggggagggaaaggggctaaagtctcttctgttggtaatttattagttactcttgaaacaataaaatccaacagaaaggaagagatagctactgtatattacagtaaagaaagctgcatagttattttaaatttaatggagatgaatatggttaaaatatataactactgctgcttgagaatagcaagagtattgttttaaaacatattccacccaacttgagagttcttttaaaatgattggccatatgaacatttgtaatcttgccattaggtttggacctgccatattttgttttattctgtgatcctaactagttccttttaataggctaaaatatttatcaatactgatcagactttaaagaaattactttgtaaacctgctgactacctgtatgtattgtatatatattatatattaaatatataatatattgagattataaaagatgaaaatattgaatccttataatattttaagttgcagaatgtatgttaaaaagtgacttgaatgagatgtatttgtatctagaaattttatttctttttggaatgagattaaaatacattttgaaagttca

SEQ ID NO: 7311 - DNA, 1049 bp, Homo sapiens
ggcagagccggaagaccctctctttcgctgtttgagagtctctcggctcaaggaccgggaggtaagaggtttgggactgccccggcaactccagggtgtctggtccacgacctatcctaggcgccatgggtgtgataggtatacagctggttgttaccatggtgatggccagtgtcatgcagaagattatacctcactattctcttgctcgatggctactctgtaatggcagtttgaggtggtatcaacatcctacagaagaagaattaagaattcttgcagggaaacaacaaaaagggaaaaccaaaaaagataggaaatataatggtcacattgaaagtaagccattaaccattccaaaggatattgaccttcatctagaaacaaagtcagttacagaagtggatactttagcattgcattactttccagaataccagtggctggtggatttcacagtggctgctacagttgtgtatctagtaactgaagtctactacaattttatgaagcctacacaggaaatgaatatcagcttagtctggtgcctacttgttttgtcttttgcaatcaaagttctattttcattaactacacactattttaaagtagaagatggtggtgaaagatctgtttgtgtcacctttggattttttttctttgtcaaagcaatggcagtgttgattgtaacagaaaattatctggaatttggacttgaaacagggtttacaaatttttcagacagtgcgatgcagtttcttgaaaagcaaggtttagaatctcagagtcctgtttcaaaacttactttcaaatttttcctggctattttctgttcattcattggggcttttttgacatttcctggattacgactggctcaaatgcatctggatgccctgaatttggcaacagaaaaaattacacaaactttacttcatatcaacttcttggcacctttatttatggttctgctctgggtaaaaccaatcaccaaagactacattatgaacccaccactgggcaaagaaatttccccatctggaagatga

SEQ ID NO: 7312 - DNA, 1892 bp, Homo sapiens
gcacttctgactcgagtccccgccgcgcttgtcgtcgccgccgccgggatccgcagccccgcgccatggagccggccgcgggcatccagcgccgcagctcccaggggcccaccgtcccgccgccgccccggggccacgcgccaccggctgccgcccccggcccggccccgctgagctccccggtgcgcgagccgccccagctggaggaggagcggcaggtgcggatcagcgagagcggccagttcagcgacgggctggaggaccgaggcttactagaaagcagcacccgcctgaaacctcacgaagcccagaactacaggaagaaggcattgtgggtgtcctggttctccatcattgtcaccctggccctcgcggtggctgcctttactgtctccgttatgaggtacagcgcctctgcttttgggtttgcatttgatgccatcctggacgtcctgtcatcggcgattgtcctgtggcgttacagcaacgcggccgctgtgcactctgcccatagggagtacatagcctgtgtcatcttgggggtgatattccttctgtcatccatatgtatagtggtcaaagccatccatgacctctcaactaggctgctcccagaagtggacgatttcctgttcagtgtctccattttaagtgggattctttgcagcatcctggccgtgttgaagttcatgctggggaaggttctgaccagtagagcactcataacagatgggtttaactccctcgtgggtggcgtgatgggcttctccattcttctgagcgcggaagtgttcaagcatgactcggcggtctggtacctggacggcagcataggcgttctgatcggcctcaccatatttgcctatggggtcaaactcctcatcgacatggtgccgagggtgaggcagacacgtcactacgagatgtttgagtgaagggggccagcatccgcatgagaccatcgagatgaggagtttccacataggcaaagggtgccaatatttaactgaacatctggtttctttttggaagttttctttcacatggtttgtcattacaagacaaggtctgcccagccaggtggatctaccttgcccccatcacctgccgcccccatcaaacatgttgggacaatgcccataggaatggacctccttccccgtctccagctgggactggcgttttttagtctctggagtatgatggttctcatgggtaggatgagatctttggcagaaaggtcttcggtggtgctctgagcctgcgctgcataggactgagcagacccacctcctccagcttgggtggccctgccactcctggttccaagtctctcctttcctggcaggtcttaagggaagattgtacccctcaccctttacatacccagaatcatcagtatgtcacttcctaatttctatcagtgtatctcattatttcatactgttttactaatcctaagtctaaacagatttgctcaaaaggagaccattctattttttaaagtacttagtgatacacgtataagctttgcatggacgaattaaataagcacattgaccttttcttgtacattcagaacctgaacatccatgtgaaaactgggtccatttttgagagatgtgaaactacagtttatttgtaataaataaatataatctatccgtatatgcatatatctatatgctgtgttaagtggtaatgggtacattacagtctgtgagagatggatcgctccctctgtaaggaacaagacgttctcagctgatgtcacggtaggtttagattctgtagagtgttccccaacccgcaccgttctgtacctctcacaccactgcttgcccgggcagtagtggctgaccaataaagacctttacctgttttgtatggca

SEQ ID NO: 7313 - DNA, 279 bp, Homo sapiens
tgtggtatgtcaaggagtggcttactagaaagcagcacccgcctgaaacctcacgaagcccagaactacaggaagaaggcattgtgggtgtcctggttctccatcattgtcaccctggccctcgcggtggctgcctttactgtctccgttatgaggtacagcgcctctgcttttgggtttgcatttgatgccatcctggacgtcctgtcatcggcgattgtcctgtggcgttacagcaacgcggccgctgtgcactctgcccatagggagtacatgtaa

SEQ ID NO: 7314 - DNA, 5452 bp, Homo sapiens
aagttgctagctgggggcagagacggccacgcggttgcaggagtaagagatccctctgtggcgaattggccaacggctcctttcaaccctgcctcgttggtggccactggagaagcgcggggggctcccccagacagccgtggggacaagttagagccagcactttaccccgggccttgcgtgtagcttcccctcccctactctcggtgccctggtgtctggaggggggttgtgggggtgtgcccgccttacatggtccaccacccgggcaaccctctgggcttgtgttccatctcactcttgcttcctgtactgtggtcaaggggaaccactgcatcatgtcccggtatagctaccagagtctcctggactggctctatgggggcgtggaccccagttttgcaggcaatgggggccccgactgtgctgccttcctctcttggcagcagcggctgctggaaagtgtggtggtcctgaccctggctctgttggagatcctggtggccctgcggcacatcctgaggcagacgaaggaggacggtaggggtagccctggcagccagccagagcaggtgacccagcggccagaggaaggcaaggagagcctgagcaagaatctgctcttagtagccctgtgcctgaccttcggggtggaggtgggctttaagttcgccaccaagaccgtcatctacctgctcaacccctgtcacctggtcaccatgatgcatctcccctttgaattggagatttactacattcagcatgttatgctctacgtggtacccatctacctgctttggaaaggaggtgcttacactccagagcccctcagcagtttccggtgggctcttctctcaactggcctcatgttcttttatcacttcagcgtcttgcagatcctcggcctggtcaccgaagtgaatttgaacaacatgctgtgtccggccatctcagacccattctacggcccctggtatcgcatctgggcctcgggacaccagactctcatgaccatgacccacgggaagctggtcatcctgttctcatacatggctgggcccttgtgtaaatatctgctggatttgctccggcttccagccaagaaaatagactgaaggtgcttattttttttttttttcctccctgaggaagcaagtcgtgacttgacttggagaacacccagttcttgataaaatcatgggagagggcagtaggatgtttggtgtatttctttttcctcctttctgtccctttcttctaccactcttcctttcccagctcttccccctacgatgtctccttgagcctggggtgtagtgctgggcgctggattttcctccttccctttggctctctctctgctcctagtggccttacatggggagattgcagtgagcggctctttcactctgcttgtcggtgctttaacaacagctggttgaggagaaagggaacaacaagtagtagttcttttggcatcgaagcaatgagattgggttgtgtttcatttctccactgccagggacctccaggcttatgctggcgtcccatttagtctccagcacagcccttaccacgggggactgaggccttgtttctataccagcggcaagcccagagccgagggatttcacagctcgtggtcaagacagaaccagccagattctggtcactggtgtcccatgactcaaagtaaacagccaaccagccactccctccaggatgctgcctggggtgggaggtgagagcaccacccagcccaagggctagattccattgagagggttggagatctattgcaatgacaaatccaaagtgaagagggtcaagatatatacagtactaggccagaccctgtgtaagttctgcctgtgagagttgagaactgatgcatatcccaatcagaagtgagcacagaaaactgtgatttgaatcatacactctgttttaggaaaatgttgataatagataccattttaatcttgagtgccccttaaatgtgttccctctccctttccctctccccccacccctccccctcccccctccctccctctttccctctctcaggcagcttcagggaagaatgagctggaattggctggttggttggtttttgagtttggagaatcctcgcatcagggcccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctcccttcccctgtcccactctaggcaacacagttgacctagaccagttccagtatttccagtttgaccgtgtttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaattttagtctcaggtgtttctgttgttgaagatccttgaatgaaaaggaaccctcaccatggggcttactgttataatgtttcttcatttactgttattaaaagatttatgagaa

SEQ ID NO: 7315 - DNA, 5566 bp, Homo sapiens
gaagttgctagctgggggcagagacggccacgcggttgcaggagtaagagatccctctgtggcgaattggccaacggctcctttcaaccctgcctcgttggtggccactggagaagcgcggggggctcccccagacagccgtggggacaagttagagccagcactttaccccgggccttgcgtgtagcttcccctcccctactctcggtgccctggtgtctggaggggggttgtgggggtgtgcccgccttacatggtccaccacccgggcaaccctctgggcttgtgttccatctcactcttgcttcctgtactgtggtcaaggggaaccactgcatcatgtcccggtatagctaccagagtctcctggactggctctatgggggcgtggaccccagttttgcaggcaatgggggccccgactgtgctgccttcctctcttggcagcagcggctgctggaaagtgtggtggtcctgaccctggctctgttggagatcctggtggccctgcggcacatcctgaggcagacgaaggaggacggtaggggtagccctggcagccagccagagcaggtgacccagcggccagaggaaggcaaggagagcctgagcaagaatctgctcttagtagccctgtgcctgaccttcggggtggaggtgggctttaagttcgccaccaagaccgtcatctacctgctcaacccctgtcacctggtcaccatgatgcatatctttctcctggcctgccctccatgtcggggagctatcgtcgtcttcaagctacagatgcacatgttgaatggagctcttctggcattgctgtttcctgtggtaaacactcggctgctcccctttgaattggagatttactacattcagcatgttatgctctacgtggtacccatctacctgctttggaaaggaggtgcttacactccagagcccctcagcagtttccggtgggctcttctctcaactggcctcatgttcttttatcacttcagcgtcttgcagatcctcggcctggtcaccgaagtgaatttgaacaacatgctgtgtccggccatctcagacccattctacggcccctggtatcgcatctgggcctcgggacaccagactctcatgaccatgacccacgggaagctggtcatcctgttctcatacatggctgggcccttgtgtaaatatctgctggatttgctccggcttccagccaagaaaatagactgaaggtgcttattttttttttttttcctccctgaggaagcaagtcgtgacttgacttggagaacacccagttcttgataaaatcatgggagagggcagtaggatgtttggtgtatttctttttcctcctttctgtccctttcttctaccactcttcctttcccagctcttccccctacgatgtctccttgagcctggggtgtagtgctgggcgctggattttcctccttccctttggctctctctctgctcctagtggccttacatggggagattgcagtgagcggctctttcactctgcttgtcggtgctttaacaacagctggttgaggagaaagggaacaacaagtagtagttcttttggcatcgaagcaatgagattgggttgtgtttcatttctccactgccagggacctccaggcttatgctggcgtcccatttagtctccagcacagcccttaccacgggggactgaggccttgtttctataccagcggcaagcccagagccgagggatttcacagctcgtggtcaagacagaaccagccagattctggtcactggtgtcccatgactcaaagtaaacagccaaccagccactccctccaggatgctgcctggggtgggaggtgagagcaccacccagcccaagggctagattccattgagagggttggagatctattgcaatgacaaatccaaagtgaagagggtcaagatatatacagtactaggccagaccctgtgtaagttctgcctgtgagagttgagaactgatgcatatcccaatcagaagtgagcacagaaaactgtgatttgaatcatacactctgttttaggaaaatgttgataatagataccattttaatcttgagtgccccttaaatgtgttccctctccctttccctctccccccacccctccccctcccccctccctccctctttccctctctcaggcagcttcagggaagaatgagctggaattggctggttggttggtttttgagtttggagaatcctcgcatcagggcccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctcccttcccctgtcccactctaggcaacacagttgacctagaccagttccagtatttccagtttgaccgtgtttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaattttagtctcaggtgtttctgttgttgaagatccttgaatgaaaaggaaccctcaccatggggcttactgttataatgtttcttcatttactgttattaaaagatttatg

SEQ ID NO: 7316 - DNA, 4975 bp, Homo sapiens
gcggctgctgcagggggaggaagacggggaggaggagccgtgcgccgcggcggcggccgccaggggaaccgagcgcccggcgcggagagcgcgggagcggagcagtagcccgatccggggccgcgggccgagctgccgatctttctcctggcctgccctccatgtcggggagctatcgtcgtcttcaagctacagatgcacatgttgaatggagctcttctggcattgctgtttcctgtggtaaacactcggctgctcccctttgaattggagatttactacattcagcatgttatgctctacgtggtacccatctacctgctttggaaaggaggtgcttacactccagagcccctcagcagtttccggtgggctcttctctcaactggcctcatgttcttttatcacttcagcgtcttgcagatcctcggcctggtcaccgaagtgaatttgaacaacatgctgtgtccggccatctcagacccattctacggcccctggtatcgcatctgggcctcgggacaccagactctcatgaccatgacccacgggaagctggtcatcctgttctcatacatggctgggcccttgtgtaaatatctgctggatttgctccggcttccagccaagaaaatagactgaaggtgcttattttttttttttttcctccctgaggaagcaagtcgtgacttgacttggagaacacccagttcttgataaaatcatgggagagggcagtaggatgtttggtgtatttctttttcctcctttctgtccctttcttctaccactcttcctttcccagctcttccccctacgatgtctccttgagcctggggtgtagtgctgggcgctggattttcctccttccctttggctctctctctgctcctagtggccttacatggggagattgcagtgagcggctctttcactctgcttgtcggtgctttaacaacagctggttgaggagaaagggaacaacaagtagtagttcttttggcatcgaagcaatgagattgggttgtgtttcatttctccactgccagggacctccaggcttatgctggcgtcccatttagtctccagcacagcccttaccacgggggactgaggccttgtttctataccagcggcaagcccagagccgagggatttcacagctcgtggtcaagacagaaccagccagattctggtcactggtgtcccatgactcaaagtaaacagccaaccagccactccctccaggatgctgcctggggtgggaggtgagagcaccacccagcccaagggctagattccattgagagggttggagatctattgcaatgacaaatccaaagtgaagagggtcaagatatatacagtactaggccagaccctgtgtaagttctgcctgtgagagttgagaactgatgcatatcccaatcagaagtgagcacagaaaactgtgatttgaatcatacactctgttttaggaaaatgttgataatagataccattttaatcttgagtgccccttaaatgtgttccctctccctttccctctccccccacccctccccctcccccctccctccctctttccctctctcaggcagcttcagggaagaatgagctggaattggctggttggttggtttttgagtttggagaatcctcgcatcagggcccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctcccttcccctgtcccactctaggcaacacagttgacctagaccagttccagtatttccagtttgaccgtgtttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaattttagtctcaggtgtttctgttgttgaagatccttgaatgaaaaggaaccctcaccatggggcttactgttataatgtttcttcatttactgttattaaaagatttatg

SEQ ID NO: 7317 - DNA, 5567 bp, Homo sapiens
ggaggggcccgtcggcggcgaagttgctagctgggggcagagacggccacgcggttgcaggaattggccaacggctcctttcaaccctgcctcgttggtggccactggagaagcgcggggggctcccccagacagccgtggggacaagttagagccagcactttaccccgggccttgcgtgtagcttcccctcccctactctcggtgccctggtgtctggaggggggttgtgggggtgtgcccgccttacatggtccaccacccgggcaaccctctgggcttgtgttccatctcactcttgcttcctgtactgtggtcaaggggaaccactgcatcatgtcccggtatagctaccagagtctcctggactggctctatgggggcgtggaccccagttttgcaggcaatgggggccccgactgtgctgccttcctctcttggcagcagcggctgctggaaagtgtggtggtcctgaccctggctctgttggagatcctggtggccctgcggcacatcctgaggcagacgaaggaggacggtaggggtagccctggcagccagccagagcaggtgacccagcggccagaggaaggcaaggagagcctgagcaagaatctgctcttagtagccctgtgcctgaccttcggggtggaggtgggctttaagttcgccaccaagaccgtcatctacctgctcaacccctgtcacctggtcaccatgatgcatatctttctcctggcctgccctccatgtcggggagctatcgtcgtcttcaagctacagatgcacatgttgaatggagctcttctggcattgctgtttcctgtggtaaacactcggctgctcccctttgaattggagatttactacattcagcatgttatgctctacgtggtacccatctacctgctttggaaaggaggtgcttacactccagagcccctcagcagtttccggtgggctcttctctcaactggcctcatgttcttttatcacttcagcgtcttgcagatcctcggcctggtcaccgaagtgaatttgaacaacatgctgtgtccggccatctcagacccattctacggcccctggtatcgcatctgggcctcgggacaccagactctcatgaccatgacccacgggaagctggtcatcctgttctcatacatggctgggcccttgtgtaaatatctgctggatttgctccggcttccagccaagaaaatagactgaaggtgcttattttttttttttttcctccctgaggaagcaagtcgtgacttgacttggagaacacccagttcttgataaaatcatgggagagggcagtaggatgtttggtgtatttctttttcctcctttctgtccctttcttctaccactcttcctttcccagctcttccccctacgatgtctccttgagcctggggtgtagtgctgggcgctggattttcctccttccctttggctctctctctgctcctagtggccttacatggggagattgcagtgagcggctctttcactctgcttgtcggtgctttaacaacagctggttgaggagaaagggaacaacaagtagtagttcttttggcatcgaagcaatgagattgggttgtgtttcatttctccactgccagggacctccaggcttatgctggcgtcccatttagtctccagcacagcccttaccacgggggactgaggccttgtttctataccagcggcaagcccagagccgagggatttcacagctcgtggtcaagacagaaccagccagattctggtcactggtgtcccatgactcaaagtaaacagccaaccagccactccctccaggatgctgcctggggtgggaggtgagagcaccacccagcccaagggctagattccattgagagggttggagatctattgcaatgacaaatccaaagtgaagagggtcaagatatatacagtactaggccagaccctgtgtaagttctgcctgtgagagttgagaactgatgcatatcccaatcagaagtgagcacagaaaactgtgatttgaatcatacactctgttttaggaaaatgttgataatagataccattttaatcttgagtgccccttaaatgtgttccctctccctttccctctccccccacccctccccctcccccctccctccctctttccctctctcaggcagcttcagggaagaatgagctggaattggctggttggttggtttttgagtttggagaatcctcgcatcagggcccatttctggaagattctgtagatctgtttcttggttttacagggccagtgttgtttccctagggccagatttcttcagtgtatccacactcagtgctgaattgtttaatgtgggggacatcacgtcctcctcatcctgtctacccccaaatcccatgtctaggttgaaagggggctgccaaagaattaagtcctcatgggtggaggttcaggtgctccacaaggaggagcttttgttgaaggacttcagctcagttatgcacggacctcaagcaggcaggaagtggctgggcattgctgactccacattgactcccactaggaacagatttgcttaagaacagaaaagctcatttggtgattttgtctgatgagcctcccttcccctgtcccactctaggcaacacagttgacctagaccagttccagtatttccagtttgaccgtgtttgacctacactgagcttcggtgcctcagtggtcataattttagcaagtggacctataggaagcaaccctgggagggaccgtccttctgcagaggcctgcgggcattgaggctatcaatccccagggcttggggagcaggaggggagggcaccaagtgctcttactctcctgagctccttttgatgcgtaagctttgtttttggccctctttgaaggcagggccaaacttttcttagtgcctctcaccttagggtggccctccagggaaggtgctccttgaatggctggattggccctgcccaccgtcaaactgctacatgtaggaatagctgatgaggaaatacacaaggcctcagtgccccttggcctctttacaaaaggagaagttggaaggggattgtgggaggagcccctgggggcctggtctgtcctccaccagaacttggagttgctgccagcagaggatctgtgcctcagctgaagactagctccggaatgtcataggggtgtgactgtgtaggccttctcctcctcctcgtttctgtggcatggcacaggttgcctggttgctcgagccttccccatgttgacatcctccacaagcttgcctttgctctgtctacagcttagtaccccattctggagggcactttctggtgcttggaaggagagaagaaagcaaaagccacatgcctggcatggccaagccagagacagatccacctgtcagaggaaggaagaagtaaagggggcatgcagggcttttgggggccagattggctcagaaacatgtaggtcaaaagaatagagggggcccagtctataggcttcacaaggagccatggcctgtatttggggcattggggagcataaggcatctgaactggtccagatctcactcttatcttgggccaagccaacgtggagagaagcaacccaaccagactcttggcagcctgccttacagggtagcccaccttatagggtagccctcatatctgccctgtgccggccctctactgccccagctttggtacaggagtgagggagaagctggagcttgcacacccagtggccagtggggctgtcttcccagctcctcctcagggctttcctgtcagtgccaagccagttccccagccaggtttccgtgtgccatttgccagcgtgtgggagctctgcgcgtgtgtgagggtgtttgtagaagagggcagtttcctttcaaatggccttaggaagggaaaagagtactccctccagcccctaggtagccttggccagggatgtgggccaagaacagtctgtggagctggccaacttgtggcatccactccaaatagcagagacccagtcacgcctgcttctggtcctccctgccctcagtatttggttttgtacaccaaagatgatctggcccatcttcctcccagaggcacaacagtaacatgttcctctgtcagcctgtgaaggcatgcagggttctgaagccacagactcagtctccccaagtcagcaatctctttctctctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctgaattttagtctcaggtgtttctgttgttgaagatccttgaatgaaaaggaaccctcaccatggggcttactgttataatgtttcttcatttactgttattaaaagatttatgagaa

SEQ ID NO: 7318 - DNA, 2564 bp, Homo sapiens
aagttgctagctgggggcagagacggccacgcggttgcaggagtaagagatccctctgtggcgaattggccaacggctcctttcaaccctgcctcgttggtggccactggagaagcgcggggggctcccccagacagccgtggggacaagttagagccagcactttaccccgggccttgcgtgtagcttcccctcccctactctcggtgccctggtgtctggaggggggttgtgggggtgtgcccgccttacatggtccaccacccgggcaaccctctgggcttgtgttccatctcactcttgcttcctgtactgtggtcaaggggaaccactgcatcatgtcccggtatagctaccagagtctcctggactggctctatgggggcgtggaccccagttttgcaggcaatgggggccccgactgtgctgccttcctctcttggcagcagcggctgctggaaagtgtggtggtcctgaccctggctctgttggagatcctggtggccctgcggcacatcctgaggcagacgaaggaggacggtaggggtagccctggcagccagccagagcaggtgacccagcggccagaggaaggcaaggagagcctgagcaagaatctgctcttagtagccctgtgcctgaccttcggggtggaggtgggctttaagttcgccaccaagaccgtcatctacctgctcaacccctgtcacctggtcaccatgatgcatctcccctttgaattggagatttactacattcagcatgttatgctctacgtggtacccatctacctgctttggaaaggaggtgcttacactccagagcccctcagcagtttccggtgggctcttctctcaactggcctcatgttcttttatcacttcagcgtcttgcagatcctcggcctggtcaccgaagtgaatttgaacaacatgctgtgtccggccatctcagacccattctacggcccctggtatcgcatctgggcctcgggacaccagactctcatgaccatgacccacgggaagctggtcatcctgttctcatacatggctgggcccttgtgtaaatatctgctggatttgctccggcttccagccaagaaaatagactgaaggtgcttattttttttttttttcctccctgaggaagcaagtcgtgacttgacttggagaacacccagttcttgataaaatcatgggagagggcagtaggatgtttggtgtatttctttttcctcctttctgtccctttcttctaccactcttcctttcccagctcttccccctacgatgtctccttgagcctggggtgtagtgctgggcgctggattttcctccttccctttggctctctcctcaaacttcatcgcattcatagaagctgcttgcagggtcgccgggctaaccagggtgatcggcgaactttaccgtacagtacctcagtctagctgtcagatcaccccttttgctgtagcctctgttgaggtttttatatttgtgatcattggtaattcagtgtcctatgaagtgggcacagctccccacagagagcaagttgtcagcaggtctctgtgcactggtattggggcagggcagtgccctgggggtaagctaggtggctcagggagtggcagaagggccatttttccctctgccaaaaagacttccttggatttgtagatgttgacccagagtcctctgtcccctcctgaagaggattttcttactggtttctactgaaggggaggtaggggaggaggaaaaaaggaccatgtgtgatgctgttagacaagacactgacgctgattatggagggtctcctgcaggcccttgtgggctccttggcaaggccccaggctgggaaggagctccccccactgcccatcctgcccgctttgtggcgggtagagtcagtgacagggaggcagccctccttttgtgtatatagagtgagctgatttgggctcaggaaaacctagtcgcttgttgctctcgtctgtgacatttttgtacactggtttgctactcatggcaagaaacagacaaagccccatgaaaaataaaacaaaacaaaagtcatttcaaacaaagctgttgttttgaaaactcttgctttcttttggtgtccattttgtgttctattttaaagaatctttcatttatattggtgttattgtagtgaagagaatgtgataggctgatctgtaatggtttctgtcaggagcttagcaaatgcctctgcccctcttcccctacccctgtccttcctcagttcccagctgggattgctatgcactgggcagacccgtcactgtctcccctgaacccccacacagtggcttcccttagaaccagtctttgtactctccctaaacagcagcaggcttaggatttttgtcaggctggttcttgcgtgctctgtgcccccaccagtttgctcacctcttggggcattttgtaatgtgttttctctgtcttgtaaaaccttttgattgtaccgaaatggtatctgcagtcgcctttggaaataaatggtcattaatttgtgtacttagcattctg

SEQ ID NO: 7319 - DNA, 1928 bp, Homo sapiens
gactccagtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttaggtgttttaagatgtttaccttaaagtttttcttggggaaagaatgaattaatttctatttcttaaaacatttccctgagccagtaaacagtagtttaatcattggtcttttcaaaactaggtgtttaaaaaaagagacatatatgatattgctgttatatcaataacatggcacaacaagaactgtctgccaggtcattcttcctcttttttttttaattgggtaggacacccaatataaaaacagtcaatatttgacaatgtggaattaccaaattaaaagagaatactatgaatgtattcatattttttctatattgaataaacaatgtaacatagataacaatataaataaaagtggtatgacca

SEQ ID NO: 7320 - DNA, 1657 bp, Homo sapiens
agtttagccgccgccggagaggacgggcgccgagccggggctgcggacttcggcctgcccctcacctcactcccgctgcttgcacctcccggatggtgctgactgctccctaagcggcggcggcggcgagtcgtgaggacgcgccgcggaggctgttcggggtcgaggcttcccgtcgccggcacttcctcttgcggcgcccgtgcgcggccggcccggcaggcgggatggcggccgcggctccagggaacggccgcgcatcggcgccccggctgcttctgctctttctggttccgctgctgtgggccccggctgcggtccgggccggcccagatgaagaccttagccaccggaacaaagaaccgccggcgccggcccagcagctgcagccgcagcctgtggctgtgcagggccccgagccggcccgggtcgagggacatcagtttttttcttggtagcaagctgtagattttgtttcaaggaaagcatcttcatcttctctagtttcatcatgtatagatggagattccgatgcagaaaatatttacaccagcagctccagttcataccaataaagaagatcctgctacccaaactaatttgggatttatccatgcatttgtcgctgccatatcagttattattgtatctgaattgggtgataagacattttttatagcagccatcatggcaatgcgctataaccgcctgaccgtgctggctggtgcaatgcttgccttgggactaatgacatgcttgtcagttttgtttggctatgccaccacagtcatccccagggtctatacatactatgtttcaactgtattatttgccatttttggcattagaatgcttcgggaaggcttaaagatgagccctgatgagggtcaagaggaactggaagaagttcaagctgaattaaagaagaaagatgaagaatttcaacgaaccaaacttttaaatggaccgggagatgttgaaacgggtacaagcataacagtacctcagaaaaagtggttgcattttatttcacccatttttgttcaagctcttacattaacattcttagcagaatggggtgatcgctctcaactaactacaattgtattggcagctagagaggacccctatggtgtagccgtgggtggaactgtggggcactgcctgtgcacgggattggcagtaattggaggaagaatgatagcacagaaaatctctgtcagaactgtgacaatcataggaggcatcgtttttttggcgtttgcattttctgcactatttataagccctgattctggtttttaacaagctgtttgttcatctatatttagtttaaaataggtagtattatctttctgtacatagtgtacattacaactaaaagtgatggaaaaatactgtattttgtagcactgattttgtgagtttgacccattattatgtctgagatataatcattgattctatttgtaacaaggagttttaaaagaaacctgacttctaagtgtgggtttttcttctctccaacataattatgttaatatggtcctcatttttcttttggtgcagaaccgttgtgcagtggggtctaccatgcaattttctttcagcactgacccctttttaaggaatacaaattttctccttcatcacttag

SEQ ID NO: 7321 - DNA, 4630 bp, Homo sapiens
cttttccggtggagaggagcctatcctagtgtcttaaccgcccgtcttggtaggcggtgccgtgacaagcccaaccggacggctggagagggcgagaagggcagacgggacatgcagcctcttccgcctgagccccggaagggtgatgtggctgcggcatcgccggcctcgctatgtctgccattttcaattttcagagtctattgactgtaatcttgctgcttatatgtacctgtgcttatattcgatccttggcacccagcctcctggacagaaataaaactggattgttgggtatattttggaagtgtgccagaattggtgaacggaagagtccttatgttgcagtatgctgtatagtaatggccttcagcatcctcttcatacagtagctggggaaaatgccagaatgtagttgccatcagatttgattgtgaacaaggactgactgcagaaaataatggaaaggatgtttaactcttttatctccgaacattgaatgagataaatttccagatgctgttctctattttaatgttattggaccaatgttctgtataaacaattaagatgtaaccatttaatagtctgtaacaatcaacctcagtactgtcactacaatattacattctgcaaatgttattctgttgtatcagatacaaaattttagtgaggtatctctaaggcacatagtagaaaacaaaattggttaattactcaagttcctttcactgtgatttggaaatgatttaatctttatagaatgagaaccttttttggactagcttttttattaaaatggctcaatttgtgttgataaggattgcattaatatttaatagtgcttgcttttcctctgggcacaccattttgatcattaaccagagtacctctactcttagcaaactctagtttatgacaagtatttaaaatatttaaaacaagcttatgcagttcttaaggacgaaggtaaatgagatgtaacttaaaaatagtattgggaaaatgttgatagttaacattagtggatttagactagccaaatgacatagtaggctctgaaacatcttgtcaagtatatgtattttgtgcatgaatttttgctggaaagctgtctttctctgaaaaacacaacgttcttagaatgaaaagaacaattataaaataattatcctatatgtgtttttcattctttttagtgtcatggcttcaaaaatgaaacatttattttaattgccgtaaaggaactgtatttttgttttgttttttaacacagcactttaaatccagtttgtgttttgtcaacttgaactggaatctcttttgttactttggaggtgataaatagttttcaaatctgctgatttgtatactgtggcacaagtatctttgaactttgatagtgaaaggagaccttcaacaatttttagtctaggcgagaggaatattaggaatgtgacttctaaattttacaatagagcagttattttaaggtcatggttaacatttcttaaggttcaactaaaattcagttaaaatttcagagctacgaggaacttaaatcttagctaaaaattacctgttgtagatagtattaattagattgtttgcagctattaattcatcataaagataaaatgaagaaactctccctttttttaaacaaaaaaaattatttctagattaataggctagtagttatttctgcagaaacaacgtatggaactgaaagccacctatttttattttagactaatttaaaccacttggaatggattctaggaaacatcttaagcttgtgtgttgcctgtggtggttttttgtttgggggtgttttttggttttggtttgattttctgtattttgttatctggggattttttgtttgtttgttttggtttggttttggttttatatttttggcatgtctatggcagttaaaagtggtatattttgctttagatagggaatcaggttataatcattgttcttcctctaaactgcctcttgggctttacatcaggtcaaggatttttagggtttctcaaaaataggattcttgtcagtgtatgcatgctgagtaagtcacctttctggctctaatttctgggtggccatctgttgtccagctctgctgccaactggactttccgaaagccatgtcaactaattttttatatgctaagacaaatcgaatatgaaaagaggaagaatattctagatattctaagacatttcttaatttggcatctcagaggaggtaggtggaaagtaaaggaagagataattttgggggaaaatttgtggaaacatacaaaacgttttgctttgtatagatgctaaacagagtgggaggcagcatatttgtaacaacaaccattctgaccttttgaaacacaagcttttggagaagtcagggagagacacagtatgaataaaagcaattaacattttctttaatgtatatttttcaaagaggaccacggaatcctgttctctaacccaaggggcagtgtaggtggttttaagcccacagaatattgagatatttctcttgtggttttggtggggtggtgggatgcagaaggttattaaagatcaatttaagcatcagatagactatcccttttatttttttaacttttaggttcaggggtacatgtgcaggttgttatataggtaaactcatgtcaagtggttttgttgtacagattattttgtcacccaggtgctaagcctagtacccagtagttattttccctgctcttctccctcctcccaccctccaccctcaagtaggccccagtgtctgttgttcctttctttgtgtccttgagttctcatcatttagctcctacttctaaatgagaacatgtatttggttttctgttctgtgttagtttgctaaggataatggcctccagctcagatggaatatctctatcatatagacctgttgttacagggcaggatcggatgatggacactgaagtcctcagcttgctaagttcagttgctctccctagcctccttttggcttcagagtcttttgattccatctatcctggtattttttgtgtgctgatgtttagttctggattggcttcagctgtgctaataggaagggcgttgtcttttcaagcaatcttaaaaggtggtcaatcaaaaggccagagtctgaatcccttctgtggcttaaataatttgaggatcaagtccagtgtcttgttaatccctgttctactgtgccagacactatcttgaatgcttttatatgttcaggttcaaaatcgctctttcataccaggggatgatagtaacgtgtaacttgcaatagattccttcatcttagtaataagatgatcagtctagttaggacaaaatagagattgaataaattaacttttccaagtttacagagtaaaaatgagcagatctctgcctggttttgtgaaaaagagttagcactggtaaatagaatatttctactcctacaccattctttcagtatatcatcactgaagacaggaagataggcacacagattcttcctcgtagtaattcatagtgcactaggtgaaagagatgaagtatgtattaaaagtacaatgtgatggcatttattattcagataatcccaggattctagaagaaaataaagaagagtgacagttcagttagggtgtgaacttccagaggagcactgcttaagctgaacttgagagcattgtgcaaaagcacagtagtctgttaagaactagaaataacctagcttgtgccacttcgggagtattaagacataagcctagaaaggtaggcaaaggttagatcttagactgtcttgtatttttctcattcctgttgattacctacctcaaaattgaatatgtttttcctcctgcctaacacaaaactactcaagggcagaaatttaaattcttccttggtgtatgtgcaaagaaggttgaatatattcatgcctaccttattttggactaggaatacagtagtatactttccgaagacttgcctgaatagtatataaggtggaggcaactgactagttaggtcagtatttttagaaactcttaatagctcatactcttgataccaaaagcagccctgattgttaaagcacacacctgcacaagaagcagtgatggttgcatttacatttcctgggtgcacaaaaaaaaattctcaaaaagcaaggacttacgctttttgcaaagcctttgagaagttactggatcataggaagcttataacaagaatggaagattcttaaataactcactttctttggtatccagtaacagtagatgttcaaaatatgtagctgattaataccagcattgtgaacgctgtacaaccttgtggttattactaagcaagttactactagcttctgaaaagtagcttcataattaatgttatttatacactgccttccatgacttttactttgccctaagctaatctccaaaatctgaaatgctactccaatatcagaaaaaaagggggaggtggaattatatttcctgtgattttaagagtacagagaatcatgcacatctctgattagttcatatatgtctagtgtgtaataaaagtcaagatgaactctcaa

SEQ ID NO: 7322 - DNA, 2798 bp, Homo sapiens
tcggcccttgctcctgcgtactacggcttcttccagtcacctcggcccggatcgggaagtgtcaagcgggcgctcccccatctccgccgctattaccactgaacccggaccccctacccaggtccagggccagccgccatgacgaacgtgtactccttggatgggattctggtgtttggtttgctctttgtttgcacctgtgcctacttcaagaaagtacctcgtctcaaaacctggctgctatcagagaagaagggtgtttggggtgtgttttacaaagccgctgtgattggaaccaggctgcatgctgctgtggcaattgcttgtgttgtaatggccttttacgtcctgtttataaaatgaattccaaagcacccaagtcatcaactgccaaccaaggggacggggatgaagaacctgttggagacctgaacccagtgtaggagagttcagctgaaatcatcggtccccaggatgacaccacagcatctgcccctgctatatgtggggaaaactcatggtcacgaacattatttatgcttcaggggactacagaaagccagcttcctttgatctatgtgtaaatcagtccttggcagagtgcatataatgtccggataaattacacccctcggtgataagattacatacctccttcataaaaacctgtcatcctgttttgttcttcagctcctcatcaggatcttttcaaactgaggctcattagggaaggaactaggctgtgttcagacttcttttgaagagagagaattttcaagacttcttttcactctttgatttggatctggcaaattggggaggggatgctgggtgggaaacagttatgaaatgccaagaaattctttggctttagaaatttatctttcatgtacccatccgggaacataaaagagaggcatagtgctcattgcaaaaagagaacagatgaagtagctgtgttatgtgctggtatcttgagagttttgccaagaaaatctgggcctacataaaatttgagaattatctgtgtgatgagaccagaaagcagtggcttagacaagaaaaaatctttctgttcaccagtatcctcaaatggagacttcacttgatcagatggtatatgaaaaatgaatcaactattgctatttcgtaaaacctttttatattttctaaatttacttagtgctaaatactgttactcagttttaaatgccacgactaggggaaaaagaaactattgaagaaataattgtttagtatatttgcagttggggtagaagaaagaaatctagtatattgattcatatactagtaaattcatctagtataagaacttgtgatgttagattgaagttttgtcatcttataaaagacaacaaacttattttctgtttaagtctgagtgttatggcaatttttagttgattacttatttttcttagccaaattttaattttcttcatattgcattgctctttagttgtctctggaaattctatttactttaaggacatgagaaattcaaatgagagaagttgctgatattcatcagtgtgtttggacagttcatagggtccacaaatcaaatgaggttgtttcctgaagtagaagaaaacagaactttgcaattgatactgaagtactttgccatggagttagtaactcctgagcagaccattttagatggctcagcatttggcaggaagacttctccattccctgcttatatctatggaaggatcagctgttggatgtctagaacttctctatttaaaaaaaaagagtaggtctaaaattaaattattataagcaagcatagacatgggtcttccagttgaattgtccattaccgtaaaacttaatggtggacaagttagctgtggttgattcctgtgtggcagtaaattgtcttctgtctgcttactccaaataataaaagctgctaggaagtttagattttgaaataggcagtttaatgctttgagggtttctagaaatacagaaagtcatcaagtaaacactgcatgtctaatcatctcagagttgtggctgttatctcttcaggaattggtccacagggtaaatttcaacaattcatacgttttccattgtcatttctgaggacctttgagatgagagaaaggaaatctagtggaacaggaaagagagttacaccttgtgggtgtgagtttgggacctgttggcagaagggaatgtcactccctggaaacaggttcagcatgtttgcacttgttattttgtagctttaatgatttttgttttctaatagggcaaatgtctctaagcttggtgtttagagctgcttcatattttaaactagttccattccacagttctagttcaaaccagtttttacagcctcctgggtgggtcgtcttgacccaaactcttgtgttgttacattttgagaggttttcataccagaatgtaccaaaaagtgcacaaggtaaaggtaatttacagccagaaacaaatatacatttgtttcatttcttgactttccctaagcagataagcagaaacttgtttaactcattactttgtttgatgtgtcttacatatttttgactaaaagttatagaatgttattcctctgggggaatcttttacaggtggaggaatggggatagcagtattgcctcagattcaaactggcatcaccataaaccctgtaggccagggtggaatgaagtcagctcctttttatagttgaaatacaattttttattcaccattgtctgcacaaatccttgaaaataaacctttttttccctaca

SEQ ID NO: 7323 - DNA, 4120 bp, Homo sapiens
gttctcagctgctgattccaggtcccaggagtcgactttggcttgaggaaggcaggcgccttaggtggggcagttgacactcgcgcagcgccttgctcacctgagtgtgtggcggcgcgcgggtttgggcggggagggggccgggcctcgggaaggaggcgcgccgcgcagtttgaccccggcggcgttccgtaccgtcgcggatttcggcggcggaaacatggcggtcgcggccgggccggtaacggagaaagtttacgccgacactggcctgtattagcgcgtatggcctcgggccctcgttccccaaggcgtgccgcctccctgttctcagtcgcaggctgaagccttgtctgctctcctcctttttggtttggttttggaactgactccgagggttgggagagcgcgttggtggcgacggccgagtcagatcactataaacaaaatttccacaagagaaaatgttgaaataggagttgcggatacattggatatactggatgaaatacaagcggttaatttttgtaacgtgagggaaaagcccacattgctggttacatgtgtaaatcactgcgttattgctttagtcattgtctctatttagcaatgacaagactggaagaagtaaatagagaagtgaacatgcattcttcagtgcggtatcttggctatttagccagaatcaatttattggttgctatatgcttaggtctatacgtaagatgggaaaaaacagcaaattccttaattttggtaatttttattcttggtctttttgttcttggaatcgccagcatactctattactatttttcaatggaagcagcaagtttaagtctctccaatctttggtttggattcttgcttggcctcctatgttttcttgataattcatcctttaaaaatgatgtaaaagaagaatcaaccaaatatttgcttctaacatccatagtgttaaggatattgtgctctctggtggagagaatttctggttatgtccgtcatcggcccactttactaaccacagttgaatttctggagcttgttggatttgccattgccagcacaactatgttggtggagaagtctctgagtgtcattttgcttgttgtagctctggctatgctgattattgatctgagaatgaaatctttcttagctattccaaacttagttatttttgcagttttgttatttttttcctcattggaaactcccaaaaatccgattgcttttgcgtgtttttttatttgcctgataactgatcctttccttgacatttattttagtggactttcagtaactgaaagatggaaaccctttttgtaccgtggaagaatttgcagaagactttcagtcgtttttgctggaatgattgagcttacattttttattctttccgcattcaaacttagagacactcacctctggtattttgtaatacctggcttttccatttttggaattttctggatgatttgtcatattatttttcttttaactctttggggattccataccaaattaaatgactgccataaagtatattttactcacaggacagattacaatagccttgatagaatcatggcatccaaagggatgcgccatttttgcttgatttcagagcagttggtgttctttagtcttcttgcaacagcgattttgggagcagtttcctggcagccaacaaatggaattttcttgagcatgtttctaatcgttttgccattggaatccatggctcatgggctcttccatgaattgggtaactgtttaggaggaacatctgttggatatgctattgtgattcccaccaacttctgcagtcctgatggtcagccaacactgcttcccccagaacatgtacaggagttaaatttgaggtctactggcatgctcaatgctatccaaagattttttgcatatcatatgattgagacctatggatgtgactattccacaagtggactgtcatttgatactctgcattccaaactaaaagctttcctcgaacttcggacagtggatggacccagacatgatacgtatattttgtattacagtgggcacacccatggtacaggagagtgggctctagcaggtggagatacactacgccttgacacacttatagaatggtggagagaaaagaatggttccttttgttcccggcttattatcgtattagacagcgaaaattcaaccccttgggtgaaagaagtgaggaaaattaatgaccagtatattgcagtgcaaggagcagagttgataaaaacagtagatattgaagaagctgacccgccacagctaggtgactttacaaaagactgggtagaatataactgcaactccagtaataacatctgctggactgaaaagggacgcacagtgaaagcagtatatggtgtgtcaaaacggtggagtgactacactctgcatttgccaacgggaagcgatgtggccaagcactggatgttacactttcctcgtattacatatcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatattaataagcactcatactaccaattatcactaacttgccattttttgtatgctgtatttttatttgtggaaaataccttgctacttctgtagctgctctcactttgtcttttcttaagtaattatggtatatataaggcgttgggaaaaaacattttataatgaaagtatgtagggagtcaaatgcttactgtaaatgcataagagacgttaaaaataacactgcactttcaggaatgtttgcttatggtcctgattagaaagaaacagttgtctatgctctgcaatggtcaatgatgaattactaatgccttattttctaggcatataataatagtttagagaatgtagaccagataaatttgtttactgttttaagaaaactaccagtttacttacagaagattcttttttccaaacagtaggtttcatccaagaccatttgaagaactgcaaactctttctcttagaaaagaaagagggcagcctaaaataaacgcaaaatttgcttatactccatcacattcagatgtcttggttgtgacttattaccagtgtggcagagaacccaagttacattttagatcaaaatattctttatgtaggtattgttaaaaggctagagcctacaagttgctcttccatgcgttggtcagggggccctgaaaacactggtaatattaagagtctttctcagggtaacttaatgttttcttaatgaacagtgtttccagctacaaattcttccaataaattgtcttcctttttgaaaagtactctcatagaagaaatttagcaatttctcgttgactgactcagtctattttaagtattcagaaaagattttgatccccattgagttaatgctctgccttgaaaattatttttctgatccttgttagtgataacattttttttctactgaaggtcagaggataggaaacaagtatttctcttctggtatacatgtaatgtattctgtaaaaaagtattcatattggcaattttagttaggcataatattgtggttgtaatttttaaaacttagtgttttgtctgattaaagcaggcactgatcagggtatctcctaagaggtaattcacttcttattcctttccaataattattacattctaaattttcatctatgagaaataacaaacaagaagggaatagaattaaattggggtataatctaatcttcattgtttaaatggtttgccttctcaccattgaagccatttttttatagcctcagaaagaggaaataatgcctccaccattttctacctggtgacttgaaaattgaacttttaagttaggaagaagttagagtcagggaacttgtataccactatctatgcagcattgttatagtctgattatttctgtgttttgaatatgattttcctaatgctctaaataaaattttgttaaaaattaa

SEQ ID NO: 7324 - DNA, 1291 bp, Homo sapiens
agtttgaccccggcggcgttccgtaccgtcgcggatttcggcggcggaaacatggcggtcgcggccgggccggtaacggagaaagtttacgccgacactggcctgtattagcgcgtatggcctcgggccctcgttccccaaggcgtgccgcctccctgttctcagtcgcaggctgaagccttgtctgctctcctcctttttggtttggttttggaactgactccgagggttgggagagcgcgttggtggcgacggccgagtcagccaacaaatggaattttcttgagcatgtttctaatcgttttgccattggaatccatggctcatgggctcttccatgaattgggtaactgtttaggaggaacatctgttggatatgctattgtgattcccaccaacttctgcagtcctgatggtcagccaacactgcttcccccagaacatgtacaggagttaaatttgaggtctactggcatgctcaatgctatccaaagattttttgcatatcatatgattgagacctatggatgtgactattccacaagtggactgtcatttgatactctgcattccaaactaaaagctttcctcgaacttcggacagtggatggacccagacatgatacgtatattttgtattacagtgggcacacccatggtacaggagagtgggctctagcaggtggagatacactacgccttgacacacttatagaatggtggagagaaaagaatggttccttttgttcccggcttattatcgtattagacagcgaaaattcaaccccttgggtgaaagaagtgaggaaaattaatgaccagtatattgcagtgcaaggagcagagttgataaaaacagtagatattgaagaagctgacccgccacagctaggtgactttacaaaagactgggtagaatataactgcaactccagtaataacatctgctggactgaaaagggacgcacagtgaaagcagtatatggtgtgtcaaaacggtggagtgactacactctgcatttgccaacgggaagcgatgtggccaagcactggatgttacactttcctcgtattacatatcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatattaataagcactcatactaccaattatcactaacttgcca

SEQ ID NO: 7325 - DNA, 2659 bp, Homo sapiens
gcggatttcggcggcggaaacatggcggtcgcggccgggccggtaacggagaaagtttacgccgacactggcctgtattagcgcgtatggcctcgggccctcgttccccaaggcgtgccgcctccctgttctcagtcgcaggctgaagccttgtctgctctcctcctttttggtttggttttggaactgactccgagggttgggagagcgcgttggtggcgacggccgagtcaggctgtcttttgaagaagatcagaatggggaagagttttgtaaattagccatttaaaaacaatctgccatgttgattttggtccataggaagatcactataaacaaaatttccacaagagaaaatgttgaaataggagttgcggatacattggatatactggatgaaatacaagcggttaatttttgtaacgtgagggaaaagcccacattgctggttacatgtgtaaatcactgcgttattgctttagtcattgtctctatttagcaatgacaagactggaagaagtaaatagagaagtgaacatgcattcttcagtgcggtatcttggctatttagccagaatcaatttattggttgctatatgcttaggtctatacgtaagatgggaaaaaacagcaaattccttaattttggtaatttttattcttggtctttttgttcttggaatcgccagcatactctattactatttttcaatggaagcagcaagtttaagtctctccaatctttggtttggattcttgcttggcctcctatgttttcttgataattcatcctttaaaaatgatgtaaaagaagaatcaaccaaatatttgcttctaacatccatagtgttaaggatattgtgctctctggtggagagaatttctggttatgtccgtcatcggcccactttactaaccacagttgaatttctggagcttgttggatttgccattgccagcacaactatgttggtggagaagtctctgagtgtcattttgcttgttgtagctctggctatgctgattattgatctgagaatgaaatctttcttagctattccaaacttagttatttttgcagttttgttatttttttcctcattggaaactcccaaaaatccgattgcttttgcgtgtttttttatttgcctgataactgatcctttccttgacatttattttagtggactttcagtaactgaaagatggaaaccctttttgtaccgtggaagaatttgcagaagactttcagtcgtttttgctggaatgattgagcttacattttttattctttccgcattcaaacttagagacactcacctctggtattttgtaatacctggcttttccatttttggaattttctggatgatttgtcatattatttttcttttaactctttggggattccataccaaattaaatgactgccataaagtatattttactcacaggacagattacaatagccttgatagaatcatggcatccaaagggatgcgccatttttgcttgatttcagagcagttggtgttctttagtcttcttgcaacagcgattttgggagcagtttcctggcagccaacaaatggaattttcttgagcatgtttctaatcgttttgccattggaatccatggctcatgggctcttccatgaattgggtaactgtttaggaggaacatctgttggatatgctattgtgattcccaccaacttctgcagtcctgatggtcagccaacactgcttcccccagaacatgtacaggagttaaatttgaggtctactggcatgctcaatgctatccaaagattttttgcatatcatatgattgagacctatggatgtgactattccacaagtggactgtcatttgatactctgcattccaaactaaaagctttcctcgaacttcggacagtggatggacccagacatgatacgtatattttgtattacagtgggcacacccatggtacaggagagtgggctctagcaggtggagatacactacgccttgacacacttatagaatggtggagagaaaagaatggttccttttgttcccggcttattatcgtattagacagcgaaaattcaaccccttgggtgaaagaagtgaggaaaattaatgaccagtatattgcagtgcaaggagcagagttgataaaaacagtagatattgaagaagctgacccgccacagctaggtgactttacaaaagactgggtagaatataactgcaactccagtaataacatctgctggactgaaaagggacgcacagtgaaagcagtatatggtgtgtcaaaacggtggagtgactacactctgcatttgccaacgggaagcgatgtggccaagcactggatgttacactttcctcgtattacatatcccctagtgcatttggcaaattggttatgcggtctgaaccttttttggatctgcaaaacttgttttaggtgcttgaaaagattaaaaatgagttggtttcttcctactgtgctggacacaggacaaggcttcaaacttgtcaaatcttaatttggaccccaaagcgggatattaataagcactcatactaccaattatcactaacttgccattttttgtatgctgtatttttatttgtggaaaataccttgctacttctgta

SEQ ID NO: 7326 - DNA, 3342 bp, Homo sapiens
ggcaaagccgcatcctcccggagcagaaccgctccccgccggctgtccgcaacctccgccagcgtcggtccctgggcaggtgtggaatgcatccttgggacatctttgcatagccccatctaggaagaagttctgtgatgtgtgaactgtgagtttactcaaacaagtccaactctttataagacataggtagacgtcaggtctggaatggaagagccaacagcagtagaaggccaggtccagcttccaagcccccaccagggctctctcaggaaggctgtggctgctgccctggcgctggatggggaatccacaatggggcacaggaaaaagaagaggaaagagtcacgcccagaatccatcatcatctaccgctcagacaatgagaaaacagatgaggagcccggagaatcagaaggtggagatcagcctaaagaggaggagggagatgatttcctagactatcctgtggatgatgatatgtggaacctgcctctggacagccgctacgtcaccttaactgggaccatcacacgagggaagaaaaagggtcagatggtggacatccatgtcacattgacagagaaagagctgcaggaactgaccaaacctaaagagtcatcaagggaaacgacgcctgaaggaagaatggcctgccagatgggagctgaccgtgggccccatgtggtcctctggacgctgatctgcctgcctgtggttttcatcctttcttttgttgtctctttctactacggcactatcacctggtacaacatcttcctcgtgtataatgaggaaaggaccttctggcacaagatctcgtattgcccttgcctcgttctcttctatccagtgctcatcatggccatggcttcttccctcggcctctacgctgctgtggtccagctctcgtggtcctgggaagcatggtggcaagctgcccgggacatggagaaaggcttctgtggctggctctgcagcaagctgggtctggaggactgttctccctacagcattgtggagttgcttgaatccgacaatatctcaagcactctctccaacaaggaccccatccaagaagtagaaacctccacggtctaaactcccaacaacttactccctcctctggccccagtagcctatatatcatcttaaaattccagcagattatttctttaaattaccccctactctccgcagttcttctgggaaatcagagtccatactgatcagttttaccatcttgagggttccaggagggcatggagcagacaagcaattgtgccaaagcagttcacccaatggacaaactctttttgattccctgccctaaaatcaccatttatttaggacaatggaactctgctgtgtgtcgttttgggagcctggaagtgttactggtgcctggaactgaggggagtatgtgactaaatgtgtcagggagaataaagaacctcggggtaaccaaatccaccaagataatagacagggatggagtgagacatttaggaagctggactaccacagtgtagcagaaggtaaagatttgtgtgtatcatttagatttagatttagctgcatagaattaaaaccctaaaatatcagtggcttaaacaagatagaagtgtatttctttcttgtgcagaagaagtctggaggcagaccatcctgggaccctgtgaagtaatccaggtcccaggcttcttctatttctctaccattagtaggatgtgacccttctcacccttatccccaacatcccagtgctgattacatcttcagccatcacatccatgtttctgataaaatagaggaaagggcagagaagcacacacccttcctgttcaaggagacttcccagaagtcccactcgattcttcttatatctcattggcaagacctcagtcacatgatgtcatgagcaaaagaggctggaaatgtagttgtttggctgggtagctatattctcagctaaatactgggttcacgctaattggcaagaaaaaggaagaatggttatttgggttttgttttgttttgttttgtttcgctttagagacggagtctcactctgttgccgaggctggagtgcagtggcactatctcggctcactgcaaccttcgcctcctgggttcaagcaattcttgtgccttggcctccccagtagctgggattacaggtgcgtgccaccatacccggctaatttttgtattttttttttagtagagatggggtttcaccatgtgcccaggctggtcttgaactcctgacctcaggtgatccgcctgcctcggcctcccaaaatgctgggattgtaggcaagaatggttatcttggtaggcaagtcagaatctttgcctcacaatgatcatttaaatacattcagaacccccaaactgctaatatggttttatttatttatttattcattcatttgtttattcatttatttatttaggcctgaatcttacacagagaatttatatatagatattagctacatatactttgaatatgctatacatcgatattagcacctcacgtactttgcaattaagcttctgtaatgtcatgtgatttgtttttggaaaggaatagtggacaggagagtacaatttataatagtagcataactctttgtcctggtggtggaggtgggacgaggtggtgatatttaacctagattaaagaccaggaagggaggaattgcatctgccaaagtttcctccaacagcgatcagtagccctaagtacaaagaagccagatttagccttctgttgtttggcaaaacctcactcagagctttactccctcagacctttctgagtttaaccacagacatgatctttgctgtgctgagaaacttgtgtctacctggcctgtagggagtgtaaactagattaatacagattaacagactctgaacttaaaaaaaaaaatcactcctaagggtgtccttctaatttcaaaatatcaactcctaagaggtcagcagaatttggagatttgggtccttataagaatagctggtgctcttttcttgttcatgtctcaaaacaaagctgttgagagaactgctgcgatgaatcaaaccagaggagtttgtcatgctccccacagagagcccaggacatttgcctgatgtatggtgctgagctccaccttcagaggaactctctcttttttttttttttaaataactattattagcttgacaagaaaaaaaaagtgcccaacagttttagtgttaatcttggtgctctatggtgcattagcagagatatgaacaattaaatgaagacaaagaaaataaaaataaagtctgattaacttttgctca

SEQ ID NO: 7327 - DNA, 3174 bp, Homo sapiens
agaaccgctccccgccggctgtccgcaacctccgccagcgtcggtccctgggcaggtgtgggtgagactgctcgttcgtttctttaaatttcgatgccattggggagggtggaagggaaatgcaaaaaaaaaaaaagaagaagaaagaaacaagcagggtgtgctctatttcaaaaattcaatcctcagggctgaagctctcacgattaattaaaattaaatctccagtgcagctggaaaaagaaaggctgctgctcggcgccctcgctgcgcccgcctgccggggtcggacgtcggcgatgctgtggctccaggtggaatgcatccttgggacatctttgcatagccccatctaggaagaagttctgtgatgtgtgaactgtgagtttactcaaacaagtccaactctttataagacataggtagacgtcaggtctggaatggaagagccaacagcagtagaaggccaggtccagcttccaagcccccaccagggctctctcaggaaggctgtggctgctgccctggcgctggatggggaatccacaatggggcacaggaaaaagaagaggaaagagtcacgcccagaatccatcatcatctaccgctcagacaatgagaaaacagatgaggagcccggagaatcagaaggtggagatcagcctaaagaggaggagggagatgatttcctagactatcctgtggatgatgatatgtggaacctgcctctggacagccgctacgtcaccttaactgggaccatcacacgagggaagaaaaagggtcagatggtggacatccatgtcacattgacagagaaagagctgcaggaactgaccaaacctaaagagtcatcaagggaaacgacgcctgaaggaagaatggcctgccagatgggagctgaccgtgggccccatgtggtcctctggacgctgatctgcctgcctgtggttttcatcctttcttttgttgtctctttctactacggcactatcacctggtacaacatcttcctcgtgtataatgaggaaaggaccttctggcacaagatctcgtattgcccttgcctcgttctcttctatccagtgctcatcatggccatggcttcttccctcggcctctacgctgctgtggtccagctctcgtggtcctgggaagcatggtggcaagctgcccgggacatggagaaaggcttctgtggctggctctgcagcaagctgggtctggaggactgttctccctacagcattgtggagttgcttgaatccgacaatatctcaagcactctctccaacaaggaccccatccaagaagtagaaacctccacggtctaaactcccaacaacttactccctcctctggccccagtagcctatatatcatcttaaaattccagcagattatttctttaaattaccccctactctccgcagttcttctgggaaatcagagtccatactgatcagttttaccatcttgagggttccaggagggcatggagcagacaagcaattgtgccaaagcagttcacccaatggacaaactctttttgattccctgccctaaaatcaccatttatttaggacaatggaactctgctgtgtgtcgttttgggagcctggaagtgttactggtgcctggaactgaggggagtatgtgactaaatgtgtcagggagaataaagaacctcggggtaaccaaatccaccaagataatagacagggatggagtgagacatttaggaagctggactaccacagtgtagcagaaggtaaagatttgtgtgtatcatttagatttagatttagctgcatagaattaaaaccctaaaatatcagtggcttaaacaagatagaagtgtatttctttcttgtgcagaagaagtctggaggcagaccatcctgggaccctgtgaagtaatccaggtcccaggcttcttctatttctctaccattagtaggatgtgacccttctcacccttatccccaacatcccagtgctgattacatcttcagccatcacatccatgtttctgataaaatagaggaaagggcagagaagcacacacccttcctgttcaaggagacttcccagaagtcccactcgattcttcttatatctcattggcaagacctcagtcacatgatgtcatgagcaaaagaggctggaaatgtagttgtttggctgggtagctatattctcagctaaatactgggttcacgctaattggcaagaaaaaggaagaatggttatttgggttttgttttgttttgttttgtttcgctttagagacggagtctcactctgttgccgaggctggagtgcagtggcactatctcggctcactgcaaccttcgcctcctgggttcaagcaattcttgtgccttggcctccccagtagctgggattacaggtgcgtgccaccatacccggctaatttttgtattttttttttagtagagatggggtttcaccatgtgcccaggctggtcttgaactcctgacctcaggtgatccgcctgcctcggcctcccaaaatgctgggattgtaggcaagaatggttatcttggtaggcaagtcagaatctttgcctcacaatgatcatttaaatacattcagaacccccaaactgctaatatggttttatttatttatttattcattcatttgtttattcatttatttatttaggcctgaatcttacacagagaatttatatatagatattagctacatatactttgaatatgctatacatcgatattagcacctcacgtactttgcaattaagcttctgtaatgtcatgtgatttgtttttggaaaggaatagtggacaggagagtacaatttataatagtagcataactctttgtcctggtggtggaggtgggacgaggtggtgatatttaacctagattaaagaccaggaagggaggaattgcatctgccaaagtttcctccaacagcgatcagtagccctaagtacaaagaagccagatttagccttctgttgtttggcaaaacctcactcagagctttactccctcagacctttctgagtttaaccacagacatgatctttgctgtgctgagaaacttgtgtctacctggcctgtagggagtgtaaactagattaatacagattaacagactctgaacttaaaaaaaaaaa

SEQ ID NO: 7328 - DNA, 584 bp, Homo sapiens
ggcccggccccgccccgcccgccggccgcggcaaagccgcatcctcccggagcagaaccgctccccgccggctgtccgcaacctccgccagcgtcggtccctgggcaggtggaatgcatccttgggacatctttgcatagccccatctaggaagaagttctgtgatgtgtgaactgtgagtttactcaaacaagtccaactctttataagacataggtagacgtcaggtctggaatggaagagccaacagcagtagaaggccaggtccagcttccaagcccccaccagggctctctcaggaaggctgtggctgctgccctggcgctggatggggaatccacaatggggcacaggaaaaagaagaggaaagagtcacgcccagaatccatcatcatctaccgctcagacaatgagaaaacagatgaggagcccggagaatcagaaggtggagatcagcctaaagaggaggagggagatgatttcctagactatcctgtggatgatgatatgtggaacctgcctctggacagccgctacgtcaccttaactgggaccatcacacgagggaagaaaaagggtcagat

SEQ ID NO: 7329 - DNA, 1634 bp, Homo sapiens
ggccgcggcaaagccgcatcctcccggagcagaaccgctccccgccggctgtccgcaacctccgccagcgtcggtccctgggcaggtgtgggtggaatgcatccttgggacatctttgcatagccccatctaggaagaagttctgtgatgtgtgaactgtgagtttactcaaacaagtccaactctttataagacataggtagacgtcaggtctggaatggaagagccaacagcagtagaaggccaggtccagcttccaagcccccaccagggctctctcaggaaggctgtggctgctgccctggcgctggatggggaatccacaatggggcacaggaaaaagaagaggaaagagtcacgcccagaatccatcatcatctaccgctcagacaatgagaaaacagatgaggagcccggagaatcagaaggtggagatcagcctaaagaggaggagggagatgatttcctagactatcctgtggatgatgatatgtggaacctgcctctggacagccgctacgtcaccttaactgggaccatcacacgagggaagaaaaagggtcagatggtggacatccatgtcacattgacagagaaagagctgcaggaactgaccaaacctaaagagtcatcaagggaaacgacgcctgaaggaagaatggcctgccagatgggagctgaccgtgggccccatgtggtcctctggacgctgatctgcctgcctgtggttttcatcctttcttttgttgtctctttctactacggcactatcacctggtacaacatcttcctcgtgtataatgaggaaaggaccttctggcacaagatctcgtattgcccttgcctcgttctcttctatccagtgctcatcatggccatggcttcttccctcggcctctacgctgctgtggtccagctctcgtggtcctgggaagcatggtggcaagctgcccgggacatggagaaaggcttctgtggctggctctgcagcaagctgggtctggaggactgttctccctacagcattgtggagttgcttgaatccgacaatatctcaagcactctctccaacaaggaccccatccaagaagtagaaacctccacggtctaaactcccaacaacttactccctcctctggccccagtagcctatatatcatcttaaaattccagcagattatttctttaaattaccccctactctccgcagttcttctgggaaatcagagtccatactgatcagttttaccatcttgagggttccaggagggcatggagcagacaagcaattgtgccaaagcagttcacccaatggacaaactctttttgattccctgccctaaaatcaccatttatttaggacaatggaactctgctgtgtgtcgttttgggagcctggaagtgttactggtgcctggaactgaggggagtatgtgactaaatgtgtcagggagaataaagaacctcggggtaaccaaatccaccaagataatagacagggatggagtgagacatttaggaagctggactaccacagtgtagcagaaggtaaagatttgtgtgtatcatttagatttagatttagctgcatagaattaaaaccctaaaatatcagtggcttaaacaagatagaa

SEQ ID NO: 7330 - DNA, 3460 bp, Homo sapiens
ggcccggccccgccccgcccgccggccgcggcaaagccgcatcctcccggagcagaaccgctccccgccggctgtccgcaacctccgccagcgtcggtccctgggcaggtgtggtgcagctggaaaaagaaaggctgctgctcggcgccctcgctgcgcccgcctgccggggtcggacgtcggcgatgctgtggctccaggtggaatgcatccttgggacatctttgcatagccccatctaggaagaagttctgtgatgtgtgaactgtgagtttactcaaacaagtccaactctttataagacataggtagacgtcaggtctggaatggaagagccaacagcagtagaaggccaggtccagcttccaagcccccaccagggctctctcaggaaggctgtggctgctgccctggcgctggatggggaatccacaatggggcacaggaaaaagaagaggaaagagtcacgcccagaatccatcatcatctaccgctcagacaatgagaaaacagatgaggagcccggagaatcagaaggtggagatcagcctaaagaggaggagggagatgatttcctagactatcctgtggatgatgatatgtggaacctgcctctggacagccgctacgtcaccttaactgggaccatcacacgagggaagaaaaagggtcagatggtggacatccatgtcacattgacagagaaagagctgcaggaactgaccaaacctaaagagtcatcaagggaaacgacgcctgaaggaagaatggcctgccagatgggagctgaccgtgggccccatgtggtcctctggacgctgatctgcctgcctgtggttttcatcctttcttttgttgtctctttctactacggcactatcacctggtacaacatcttcctcgtgtataatgaggaaaggaccttctggcacaagatctcgtattgcccttgcctcgttctcttctatccagtgctcatcatggccatggcttcttccctcggcctctacgctgctgtggtccagctctcgtggtcctgggaagcatggtggcaagctgcccgggacatggagaaaggcttctgtggctggctctgcagcaagctgggtctggaggactgttctccctacagcattgtggagttgcttgaatccgacaatatctcaagcactctctccaacaaggaccccatccaagaagtagaaacctccacggtctaaactcccaacaacttactccctcctctggccccagtagcctatatatcatcttaaaattccagcagattatttctttaaattaccccctactctccgcagttcttctgggaaatcagagtccatactgatcagttttaccatcttgagggttccaggagggcatggagcagacaagcaattgtgccaaagcagttcacccaatggacaaactctttttgattccctgccctaaaatcaccatttatttaggacaatggaactctgctgtgtgtcgttttgggagcctggaagtgttactggtgcctggaactgaggggagtatgtgactaaatgtgtcagggagaataaagaacctcggggtaaccaaatccaccaagataatagacagggatggagtgagacatttaggaagctggactaccacagtgtagcagaaggtaaagatttgtgtgtatcatttagatttagatttagctgcatagaattaaaaccctaaaatatcagtggcttaaacaagatagaagtgtatttctttcttgtgcagaagaagtctggaggcagaccatcctgggaccctgtgaagtaatccaggtcccaggcttcttctatttctctaccattagtaggatgtgacccttctcacccttatccccaacatcccagtgctgattacatcttcagccatcacatccatgtttctgataaaatagaggaaagggcagagaagcacacacccttcctgttcaaggagacttcccagaagtcccactcgattcttcttatatctcattggcaagacctcagtcacatgatgtcatgagcaaaagaggctggaaatgtagttgtttggctgggtagctatattctcagctaaatactgggttcacgctaattggcaagaaaaaggaagaatggttatttgggttttgttttgttttgttttgtttcgctttagagacggagtctcactctgttgccgaggctggagtgcagtggcactatctcggctcactgcaaccttcgcctcctgggttcaagcaattcttgtgccttggcctccccagtagctgggattacaggtgcgtgccaccatacccggctaatttttgtattttttttttagtagagatggggtttcaccatgtgcccaggctggtcttgaactcctgacctcaggtgatccgcctgcctcggcctcccaaaatgctgggattgtaggcaagaatggttatcttggtaggcaagtcagaatctttgcctcacaatgatcatttaaatacattcagaacccccaaactgctaatatggttttatttatttatttattcattcatttgtttattcatttatttatttaggcctgaatcttacacagagaatttatatatagatattagctacatatactttgaatatgctatacatcgatattagcacctcacgtactttgcaattaagcttctgtaatgtcatgtgatttgtttttggaaaggaatagtggacaggagagtacaatttataatagtagcataactctttgtcctggtggtggaggtgggacgaggtggtgatatttaacctagattaaagaccaggaagggaggaattgcatctgccaaagtttcctccaacagcgatcagtagccctaagtacaaagaagccagatttagccttctgttgtttggcaaaacctcactcagagctttactccctcagacctttctgagtttaaccacagacatgatctttgctgtgctgagaaacttgtgtctacctggcctgtagggagtgtaaactagattaatacagattaacagactctgaacttaaaaaaaaaaatcactcctaagggtgtccttctaatttcaaaatatcaactcctaagaggtcagcagaatttggagatttgggtccttataagaatagctggtgctcttttcttgttcatgtctcaaaacaaagctgttgagagaactgctgcgatgaatcaaaccagaggagtttgtcatgctccccacagagagcccaggacatttgcctgatgtatggtgctgagctccaccttcagaggaactctctcttttttttttttttaaataactattattagcttgacaagaaaaaaaaagtgcccaacagttttagtgttaatcttggtgctctatggtgcattagcagagatatgaacaattaaatgaagacaaagaaaataaaaataaagtctgattaacttttgctc

SEQ ID NO: 7331 - DNA, 578 bp, Homo sapiens
agaaccgctccccgccggctgtccgcaacctccgccagcgtcggtccctgggcaggtgtggtgcagctggaaaaagaaaggctgctgctcggcgccctcgctgcgcccgcctgccggggtcggacgtcggcgatgctgtggctccaggtggaatgcatccttgggacatctttgcatagccccatctaggaagaagttctgtgatgtgtgaactgtgagtttactcaaacaagtccaactctttataagacataggtagacgtcaggtctggaatggaagagccaacagcagtagaaggccaggtccagcttccaagcccccaccagggctctctcaggaaggctgtggctgctgccctggcgctggatggggaatccacaatggggcacaggaaaaagaagaggaaagagtcacgcccagaatccatcatcatctaccgctcagacaatgagaaaacagatgaggagcccggagaatcagaaggtggagatcagcctaaagaggaggagggagatgatttcctagactatcctgtggatgatgatatgtggaacctgcctctggacagccgctacgt

SEQ ID NO: 7332 - DNA, 1797 bp, Homo sapiens
gcgcggctccctgggcctggaacgcgctctgagcgcgccggtcccttccaggttgcgcgggctccggacgagacccagcccagccgggcagccccgcgcgctcccgggtcccgccggcctcgcgccgcccggttgccgtgggaaccacggagcctcggagcgcccgcagactagcccgtgtctgagggggtgagggatactgaggcccaggcatggagctgccggatccggtgcgccagcggctgggaaacttcagccgggccgtgttcagtgattccaatcggaccggtccagagtccaatgagggtccggaaaatgaaatggtctccagtttggcactgcagatgtcactttattttaatacctactatttcccactgtggtgggtgagcagcattatgatgcttcacatgaagtattcaatcttacctgactactacaaattcattgtgatcactgttatcatcctaataaccttaattgaagccatccggttgtatctgggctacgtgggtaacctacaggagaaggttcctgagttggctggcttttggcttttgagccttctattgcagttacctttaattcttttcttgctctttaatgaaggcctaacaaatctgcccttggaaaaagcgatacatatcatcttcactctcttccttgctttccaagttgttgcagcatttcttaccttaaggaaaatggttaatcagttggcagttcgtttccacctccaagactttgaccggctctctgcaaacagaggagacatgagaaggatgaggtcatgtatagaagagatctgatccagtgttgttgagtgaaaatctgacagatcattctagagactgtaagagttaggaaaatatcagagctctgagaaaagggacaaagcaagtgttttgaattgtatatgctctcactctgaaattccaaggttgggggcaatgatgaaactttgtacagtatatgaaacagtatattaaccctaaaacctagatgttgtccacctgatgccaaatttcttaattttttttgatgttgttgtctttttcaggagtgtagaaatctatgtattggtggttgtcatttgccagctctctcgtagcatttctggttagaatctttaactagagatgtatacatttctttaaaacttgttggttatccatgtcttgtctgtacatatgaccatgtttcttgacatggaaataccagtcagtgttcctatgtatttgtctatatttgtaaaccaagagaccggctgggtgtggtggctcacgcctgtaatcccagcactttgggaggccgaggtgggcagatcatgaggtcagaagatcgagaccatcctggctaacacggtgaaacccagcctctactaaaaatacaaaaaaaaaaaaaattagctaggcgtggttgcaggcacctgtagtcccagctacttgggaggctgaggcaggagaatggtgtgaacccaggaggcagagcttgcagtgagccgagatcaagccactgtactccatcctgggtgacagagcaagactccatctcaaaaaaataaataaataaaaaataaaacaagagaccaaattttcatgtctgctagggttaaattctaaccctaatattagctgttatactgagatgaagaagaaaacaggtggattgccttggtatttaggaaatatttttgttataaaattacaactttcataaaaccatattcagtatttgtaatggtggtatacaaaatgcttttacaataaattattaaatatttaaggtatcagcagc

SEQ ID NO: 7333 - DNA, 5025 bp, Homo sapiens
gctgaggcggcgagggtgagtcggcgccggccgctaccgcacttcgggcgctcgtccctcatttctctgtggtgaatggcgacgggatggagcgcgaggggagcggcggcagcggcgggtcggccgggctcctgcagcagatcctgagcctgaaggttgtgccgcgggtgggcaacgggaccctgtgccccaactctacttccctctgctccttcccagagatgtggtatggtgtattcctgtgggcactggtgtcttctctcttctttcatgtccctgctggattactggccctcttcaccctcagacatcacaaatatggtaggttcatgtctgtaagcatcctgttgatgggcatcgtgggaccaattactgctggaatcttgacaagtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaaagggaagcaacttggatgaacaggaacatgaaggacaacacatctcagccttttcttcattttgaagctcctagaattgaagacttatgtggactcctattgttctcaaccaaaacaagtcttttggctttcttttttgtagatatttgatttaagcagttttcatgtgtacctttacccaagccaagtcaacagtgtctctggggtggcatcctttgcactgaaatttacagtattctgtgagatgtcgcatattttgaagaaaccgtggaagatactggtttatttcaaatgagcagagtatgttgtattaaaatcttatctaatcttgattaaaatttggcaaactcttttctttgctacatcttagtgacaataaatgccaaataggttttggttgagtatagttttgaaaacaaatttggtgaaataaagcaggaaaaaaaatttaagtataactcaagtagtggctttggttccactgtttataaataaaaagtagataacaatgaataatgtgacattttctggacaactgtcttgacttctgattaagatattttaagagatgtgaatttgttattttgtatgttttatcaaaataagctagctaatttagactttttagattttctgtaccacctttccctatcacttttaattctcttaattttatttcatttaattggaaacatacataccctattaaatggcttgagttggaaattttaagccagatttgtttggacattgaggcacacataagatactttaggcattctgtcatagtttttcttagtgactttggtatactaatgacccttgagaaactatagaagtgcatctgaaactagagttagtggttattgattttttagcttaatgtgtttacctagtggtaactcttcagcccacttttacagtattgggtatcaactcccagaaagtgcctaaagtttaatgttcagatatgtacccactctcccctttacatttttattcaaaagaatttatatctttaaagagatttaaatatcaagagtttttttaaaacttaattttagctatttaaatttttattctactgcctaactttctttttcattaaaaggcctgaaaactgtgactctttgagagggaaagaatcgcagaaattaagtatttaatgtgatcctttccacctaaactgttttgtatggaatacaatcagtgtggtggtagtggtggtggttatctgcaaaatagtttctggtgattaaatctgacttttttttttttttttcttttaaatgagacggagcctcactgtgttgcccaggctggagtgcagtggtgcaatctcagctcactccaacctctgccacccgggttcaagcgattctcctgcctcagtttcctgagtagctgggattacaggcacctgccaccgtgcccggctaatttttgtatttttagtagagataggtttcaccatcttgcccaggctggtcttgaactcctgaccttgtgatccacccgcctcggcctcccaaagtgctgggattacaggcgtgagccaccgcgcctggccataaatctgacatctttaaaggaaagttttcattgtgagattaaggcttaacagcccatgaggtcatatacacatgaacgtatctattccatttaaagcaatacacactctggcttctgattaaaaatagccaggaggagagtctctgaatctactgtgattctggagtctgcccaatttggaaaaaaaaaaaaaagaaaaaagtcaggaggaccaatttgccagggaaactcatagaaaagaattacaaagagatcacaaaaactggacatattcttttgactaattagaccacttatggctgggcgcagtggctcacacctataatcccagcactttgggaggtcgatgtgggaggattgcttgagcccaagagttcaagactggcctgggcaacatagtgagaccttgtctctactacaaaataaaaaaaaattagctgggcgtggcctcagctacccaagaggctaaagtgggaggatcacttgtgcctgggaggttcaggctgctgtgagccgagaccacgccactgaactccagcttaggccacagggcaagaccctgtcttaaaataatattactaattttggtaattaacttatcaaaactatagtgacatatacacgggcagaaacttataagtagagttgtaatgcagccaaatattcttacaaattccctaacaagaagctcaaatctttctcacaggcaaattgtaaaaattctagttttttgtttaaagagctgtgattttcaaaagtatcccttcagtttaagaaatctggggaattggtaacttttcttatgggaaatgattgccatcatctctactgaaggatgcctcttactgaaaaatgtcttttgaaggagttcttgcctaaagcattctttggatgtaatttcatacactaaacatatagaccagtagttagtgggcccctcctcttaaacagtaacttttgaagtactgatacatgattaaaatgttagatatttttcactggagctaagacttaaaattagggcattttgaaaggtgtatttgtttctgtttcttgtttgatatattttggttatctactcttttaaaaaactaaacgtataaaaggtatcttcaaattactgagtgtttcatccatcccagtaggtgaagtattctccagtgaataaatctatatatatatatagattttaaatagcttgagcggtgtagcttgaaatgttttcagggaaagactatttgaatcataaggaatagctttgattttcttttttatgtctcaaatatagaattatttgggggtggtcactcagatggaagaatattggcaattgtgttgaacattttaccttatatagttttgagaatttttgccaaaaactgatttcttagaaatatcctcccccagctgtgctttggttttttggtttttttgttttgagacggagtcttgctctgtcgcccaggctggagtgcagtggcatgatctcggctcactgcaagctctgcctcccgggttcacgccattctcctgcctcagcctcccgagtagctgggactacggacgtccaccaccatgcccagctaattttttgtatttttagtagagacggggtttcaccgtgttagccaggatggtctcaatctcctgacccgcctccacctcccaaagtgctgggattacaggcatgagccaccacacccggcctctgctttgttttttaaaaaaaaagaaatgcaagagagggagggaggcagcctcctgaccataaaagctgatttcttgatttttttttcttttttttttgaaatggagtcttgctctgtctccaaggctggagtgcagtggcatggtctcagctcactgcagcctccgtttcctgggttcaagtgattgtcctgccttggccgctgagtagctaggattactggcacccgccacaaggcccagctaatttttgtatttttagtagagacagggtttgattatgttggacaggctggtctcaaactcctgacttcaagtgatccacccgcctcggcctcccaacgtgatgggactatagacatgagccatcatgcttggccttcttgattcttgaatacggggttttgaggtgaaagcatttcatgaaaacttaagttcatacacaagagcatcatgaatattctaaaagaggtatctgtgctttttttgtgaccacaaaatattacttcttatgaaatgtttacactaggtgaggaaaagttcattaattacctttaaaccgttccttattttttttaagattttaaattgtattttggcttttgcctccagtatcctttctggttgctctggtttgaattaagttcctattatgctgcagcacatatcaaccttccctaagtaaccatttcctggaatgtgaagcatcggtgccattagcagaccatatgcagaaatgtcgtgtacttgcatttcttttttgtgcactctataaggctggttgtgactcagatcagcttaactttttatattatgttatttcactaactgctacagtcaaaatgatcaaatctttgtacaatagaaaattatttaaattttatttttctactgacatttctaattctagtgtaaatgtttatcaataaaaaattactttcaattctgagttggaattatatttctttttggtggctaatgagtttaatcttttgtaataaaattgacttcagttttcattttttaaataacttaatatctagcatgtgtaactttttttatgttctacttcttactaatttatgataaaattcttgttcaaagttgtgattaaaccgtacttaacatgtgaa

SEQ ID NO: 7334 - DNA, 1072 bp, Homo sapiens
gctggaggtgacgctgaggcggcgagggtgagtcggcgccggccgctaccgcacttcgggcgctcgtccctcatttctctgtggtgaatggcgacgggatggagcgcgaggggagcggcggcagcggcgggtcggccgggctcctgcagcagatcctgagcctgaaggttgtgccgcgggtgggcaacgggaccctgtgccccaactctacttccctctgctccttcccagagatgtggtatggtgtattcctgtgggcactggtgtcttctctcttctttcatgtccctgctggattactggccctcttcaccctcagacatcacaaatatggtaggttcatgtctgtaagcatcctgttgatgggcatcgtgggaccaattactgctggaatcttgacaagtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaaagggaagcaacttggatgaacaggaacatgaaggacaacacatctcagccttttcttcattttgaagctcctagaattgaagacttatgtggactcctattgttctcaaccaaaacaagtcttttggctttcttttttgtagatatttgatttaagcagttttcatgtgtacctttacccaagccaagtcaacagtgtctctggggtggcatcctttgcactgaaatttacagtattctgtgagatgtcgcatattttgaagaaaccgtggaagatactggtttatttcaaatgagcagagtatgttgtattaaaatcttatctaatcttgattaaaatttggcaaactcttttctttgctacatcttagtgacaataaatgccaaataggttttggttgagtatagttttgaaaacaaatttggtgaaataaagcaggaaaaaaaa

SEQ ID NO: 7335 - DNA, 8362 bp, Homo sapiens
atgaaggcggaggggggcgaccactccatgatcaacctgtcggtgcagcaggtcctgagcctctgggcccacgggacggtgctgaggaacctcacggagatgtggtactggatcttcctctgggctctcttctcttctctgtttgtccatggtgctgcaggagtgttgatgtttgtgatgctgcagaggcataggcagggaagagtcatctctgtcattgcagtcagcattggatttctggcttctgtaactggagcgatgattaccagtgcagcagtagcgggcatttacagagtagctgggaagaacatggcccctttggaagcgctggtatggggcgttggacagactgtactgacattaatcatctccttttcaaggatcctcgctacactttgaggtttctgtgggaatgtcttacttcacataaggaaacagatgtacagattccctgaaaacggcattgttaacaagtggaaatgaaattgtgcaagaatgtggactgagcaggtcaaagcataaggaagaccttgagctgtgtggaaggattgccctctggtgttcaagtgattgcactaccgcactgcaccttatgtgcctctgtctcaggcaaggtgcattaagacactatgtaaagttacaagaaaaagcaccttgtttagctgcctatcaggttaacattggtgttgaaatcatcgttcctaacagtgttatgttaagttacagggacgttttgaggtattgatatatgtgccaaactcttttctttttgttaacattgatcatgtgacaatttgcaagtgtagatgtagctgagtgctgtgaacatatttgacatgaattcaggtaatgtactaagatttttgttcggtaacactaaatcccgtatgagtgctaaatactgaattgtttaatatgagagaaattatttggtttttaatgttgcgcgtttctgggatttagggcttcaatatgtttaggtattattgttatttaattgatgtggaagataagtcttcttaactgaagactagctcaactgttttaagaactcagagtagctctatagggtgcatacttttcaccaacttaagtaacacccttttaatagcttctctcatgcatccatattctgtttatacaaattcagaaacttgaagggtcatacacattgattgtagtttgtgcgtcataaaaatgtaatttgaagattttcttaaaaatttttgtaagaaaaaagtctgaaatgcatgttgcattctttgacccttctaaagaaagtttttgccttgtatctcatggacaaaacatctttataactagtatctcagtgggattgtattacgtgttgcatatatcttgatttttgacaaaacataaacagtctttcattctggagtattaactgtttttagagactggcctaaattaggctctggaaataaagacctcatttgtagaaataagtaacaagtaagttatataggaagagtaatgaactattttactttggacatgtggcaacatcataattttgctaagtaaaaattggggaatatagtagataattttaaaatttggcaattagtctcagcatatcaatgcagtactgagcgtgtattagagtaattcagttgttcagttcttgatttatgatatgaagttatgatttaagtttagtagaagaatctgtgagggcatatagcaaaagtggaaatgtcctttatataaaacattttaagaggttctggcaatacgtaattgtaagagtataggaagtagggttgaactggtctcctaatgagattttttttggcaccagatacaattataatgtgctaactcaaaggagacattgcagagaatatgaagttaaggataatccaaaaataacctggtagccttgctgtttaatccaatttgctataaaagtaggcctttgttatattacattcaaatttaagaactttgttacccataccactttttctctatccagaagcagagtatatccacaacttaccaatgagaagttggagaggcagtacttttctcagtatggaagccaatttgggagatttactaacactggcttggaaatttgttttaaaaaaataataagcaactatgcatggatctttgaagtaaatcttaaaattgattatttttattatgtacaggcctgaaattgttttcatgtgttctttatattcctgatgtttttacaaattaaatttaggcataacttttccaagtcaatctgattttttcttttctgccagacttgaattgtgttcttcttttactttggctattctgtcaataatttaaagcattcgtattcttccagaggaattaccaatagcatgtggaaattgtttcagatctccagaatgaatacttattttaacatatgtttattttatgatttaagaaagttatggtaaagtaatatggagcatgattcataatccaaaattaacaagaaaataacttggatacattaaatgtactaatgtgtggaccaaagagatttaaactattgtttttactctagaatgaaagtataattgaacggttaataattagtttgtagagtgtcctgcagttattatcaagttgctttacattatcaattgtgtgtgtatgtgtatacttttaattttaggggttatttttggtttctttgctgttttcagttatttccattgagattttgtgcaactgtctctcttttgatgttttgagatgcagttgaatagtttgagtttgtgaattgtcttaatagctatttatatgctgaaatttttaaaaagttagtagctttcctatagacacaagaaatgtttaatgatatatatacacacacgtatatatcattatataggtatatagagagctgctatatatgaatacagtctacttggaaagctttttttcagtgaacactttcatgttctagtggaaaatttgttcagtgtaatgatcttttaaataggtttgaggatgtttgaaaattttgaattttgggaaaattttcttcacttaatagagctggagacccttgtttgggacatgacaaaagtccttattgatgtatttgggttatatactttgttaaaattcgtatgtgatttagcagtacattttcttcgtgacaaatgcaagaagggagggaggatcctctatagtggacactcctttatttaaaaaatgtttaataaaatattgtttatagtgaaatcagctccccaaagaaggaactcctacatgcccaaactaattacagttgaacatactgattaaaaatgccatagatcacagctagtcaggaggcctcaaataaactgcaaataatgcttaaaactttaaaagaaggagaaccagcagtcttccgaaccatgggacagttccaaggtaatagcctaccttgcctaggataagtgaagtcctaaatgatggctatcttcagggcctggagcagaattattctttagatcttaatgtttaccaaacagtgttacagtttgttacccaatatactttcttagtatttgcagcatacatttcactgctcaaaaaagtataagggttttgtttgtactttaaatgagagaaataaagaaatgagttggcctgtatatcttgtatttgtgatatgagcaacgggataatttgaaatcacagaatgttgtgggaaaggtctttaaagaacctctaatgaagaaaatgtggctgccacattgatgtacctaggctgccactcatacagcaaataattctattttgtaaacacttcgtgtggatccactatgtaaagtgctctaccaagtattttctctagtaagaagtacaagaattaccaagatggaattctttaccttgagtacaccaagagctagcaagatgatttttaaatcctaaaaagtttgggacaacattttgcttcctgattttagttgagagttagcctgttatccctccaaattctcattttcctggttcatccactaaatagaatttccataactgagatatcatggctgtgacatagtgaagagaatacgagactccaagccagcaacacagattgaattaagactctgtcacttgtcaactttttgaccttgagcaaatcacttaacttctctgagcctcagttcatactccgtaaaatgtgactaatacctcatgtagttattgtgaggattacgtgagattgtttatgaatggcaaagcagtatgtatttcacagtaaatgatcaactgatagtctctagaatttttttaaattacattttgcaattgcattaccaattgaatatgttgttttgtaaaattcatcaattttgtttcatttctatattttccttacatatgctttaggaaagaaactaaaaacgttttcttataatcttgcttcatctccttttcactttttctttttaaaatcagcagatctttaagaaccttttgtgaattggtggtggtggaaatggccagtgcaagcaggattaaattaggagttctgttgaccactggttaaaataggaaaagggtagagaggtagtcagccttgactcccttatctattcccacttacttcccttggattcattcagccatgttgatttattgactttctgctatttgctaattattcttcttgaaaagtaagagcgatatataacccttcagtcttctatatgtctgtttcttctgccggccctgggcccttggctctacagtgtagtgccaattctgtagaaaaatagaacgatattcagtgtctaccaagttctttcttccacaggccaagggtgcttaagccctagctgttattttgtttcttttatttatttattttttgagacggagtttcgctcttgttgcccaggctgcagtgcaatggcatgatctcagctcaccgcaacctctgcctcccaggttcaagcgattctccttcctcagcctcccgagtagctgggattacaggcgtgcaccaccatgcctggccagttttgtatttttagtagagacagatttctctatgttggtcaggctggtctcaaactcccgacctcaagggatccacccaccttggcctcccaaagtgctgggattacaggtgtaagctgccgtgcccagcctatttttttttaacttcaaatactattattttaaatttatgttcattatgtaattcagggagtaacgatgcctggagcaatttctgaaatattctcaaaccacttcactcttgacactacagatttttctctcagtctcaatcagaatctctgcagtcattatttgtttttaagatgtgagggacgaggaaaattactgaagaaattctagcagatttcgattgcagagaaatttggtaacactttttgggtaactgggtaaattactatttcttttaataatcgggtgaaactctgaattgttaaaacggaccaataatcaaatggttttataatctttcttaacttcccgtccttgttataacatcttggaagaagactcttcaggataaaaaggatattatttgattaaaaattatagcatttggagaggtaacacacaaaaacaaaaacatatttgacaaagcgccctacatcctgtgttttgttaggactagaaactatactggatgagtatgtatactgcatgtttacacatgctgtgtttctttatatgtgaggcttcactgaccaccgtgcattttgaaattgtattgcattttgtgtgtgtgtgtggtgacaggtttgctcttctcacttaaggagctctggtctgtgtaggcagtacagtgttgttagggaggttgctgaattatctaaaaatgtatccatgaatttgggggaaataatgcttaatatctgaagtattttcagtaaatgtggagatatatcagataatacttttaaattagtggaaacacatttctgagtgaactgagctatgaactataatcatctcttcccctgagtttagggaagttgttttcacattctttacatttattgcacatatactgaacttacataataactcttccctgattttgagaacgaatttagcaatttcctaaaaatcttcctcctctttccatacagatgtcgtatgttatagtttaaacatatgtacaatttgttgatagaatccaaggagctggtttaggaaagaatactcttaacccctacagttatgcagctctaatcttactgaaaagtaaatactttaggcaagtcaggagagcatgaacctcatacatacatttttacgattatgtactgcacccacatgtatctactcttggtagtaacatgactccaccctttttgggaatgtatttaggtggataactgaaacggaaaagcagtttgacacaaatacacagaaagaggaattgcggtgcataatcaatcgtctgagtcccataactgtaacactttttctcttataaattggtagttcctaaaaatcaccactttaaaaattttattctgtcttgctgaattaagcagaaatcactttttttagagccttgtttaaaggaacgttaactcgagagtactactgatgatgacgcttctcttgtttttaaagtatttacacatcattgttaagtatttttggaatggaacattttaaagttttctccatagaaagcaacatagtggcacttgttgagtaaatgatcataaaaatgacttgcttttaatagcagatgagttgatagtttaactgttgacactttcttaatgtttttgatgttggatgcatttacaatggaagaatttttttgaaagatttggccctctcaccaatacacacattcagacttgagctgcacgcatttagatgaacaaataggaaattcacggtattttttgttttagccatccaaaattcataggattctaccaaaaatattagcccctgactctagttattctgagatgagggaatcaactttatcttgaaagttaactagctaaaatgtctttatttaaatagcaaaaatatagtttacctgacaagtattaaaagtctcactttcaaattgtgttaactctcagaccactgatgaatcttttggtaaatcacaggcagattttaaaagctaaatgaagccttagtgccttgaaagttaagatacttgtgcaaaatggatttagcaagattcaggattggcaccagtgagttggctagatacacatcaccagtgactgggaattcaaagtttagaaagcctaacgaatagtagctactaacttcatatggttcaatgtaaatcagttacttagtcattgactgtgacagatgacagctactttcactatattttcatgatgtggtatttttctctattttttctttttccaagtatgaaatggaaaaaaatgtagttaagaaaattaagtgtgagactttaaaatttagttttgttgtaaactagagattctagtgaacagtgttagttttatactgtagtacagggcacacactttaacctttagaaatatgtttaccatcagggatttatttttactatagaaatactaaatgtactgtgaagcttaaagacaggagaataaatgttggaggggtaatacacaaaaacaaaggcatatttgatgaagtaccctgtgttatgtgaacacaatttccccttctgttaagactataaactatatgagtatgtgtactgcatgtttacataaaacagtttaattttgaaggattattttaaaaactatgtttatatataatacctaacaagctgtaaatattgtatattattgatttttaattttatataagcaattttttatttcccaattcatgtacaaatctcattatgtatatagcataatttcctggagaacacaaattttgcagtgaattttaagtaattttaattgcagtaagcatcagtttagcctagagatgttgatctttattttaaattatttttcaccattctcattttcttcaaagggcagcaataaacatatgcaagttatttttaattatagaaagtaggtctacaaagataagatctaggttccaattcattgctttaaggaaaagatgcacaattactatcattcagtgtctaatcacaggaccatttctgaggtccacatgtggctctcctctttgtaatatacagggtgaactctttactgatacacacaagacaactgttaaaaagtgaatccagcacttaaatgtcattacacagaatttattggattaaaaatttgtaatatacagtattttaataaagtttctgtattcaatttcatgcacttatatataaataaacctgtctttgaaagcttta

SEQ ID NO: 7336 - DNA, 545 bp, Homo sapiens
gtgcacgagtggcccgccgccgcccggcacccgaggagagggcggcgggcgcccctcggggaagatgaaggcggaggggggcgaccactccatgatcaacctgtcggtgcagcaggtcctgagcctctgggcccacgggacggtgctgaggaacctcacggagatgtggtactggatcttcctctgggctctcttctcttctctgtttgtccatggtgctgcaggagtgttgatgtttgtgatgctgcagaggcataggcagggaagagtcatctctgtcattgcagtcagcattggatttctggcttctgtaactggagcgatgattaccagtgcagcagtagcgggcatttacagagtagctgggaagaacatggcccctttggaagcgctggtatggggcgttggacagactgtactgacattaatcatctccttttcaaggatcctcgctacactttgaggtttctgtgggaatgtcttacttcacataaggaaacagatgtacagattccctgaaaacggcattgttaacaagtggaaat

SEQ ID NO: 7337 - DNA, 1247 bp, Homo sapiens
cgcaccaggacgcgcggtgggtagggtgcagggcggccggcgcagccgaggccgcgtgcggaggcggacgccgcgcccagccagtgcccacagcagcgcggtcagccaggcgccggacccagcttcagagctgctgaaatcttggagggaagaaaacacatcccaccctgcctccgggaaggggcctctcctggacatgtctcctgcagctgctgctgagccagatggggaccagcaggacagacacgtcagcaaactcatcttctgcttctttgtcttcggcgccgtcttgttgtgtgtgggagtcctgctctccatctttgggttccaggcatgccaatataagcccctcccagactgccccatggtgctcaaggtggcggggcctgcatgtgccgtggttggacttggggctgtgatcctggcccgctcccgggcgcaacttcagctccgtgcagggctgcagagaggtcagcagatggaccccgaccgagccttcatctgtggagagagccgccagtttgcccagtgccttatctttgggtttctgttcttgacaagcggcatgctcatcagcgtcctgggcatttgggtccctggatgtggctccaactgggcgcaggaaccgctaaacgagacagacactggcgactcagagccccggatgtgtgggttcctttctctgcagatcatggggcccttgattgtgcttgtgggattgtgtttcttcgtggttgcccatgttaagaagagaaacacgctgaatgctggccaggatgcctctgagagagaagagggacagatccagattatggagcctgtccaggtcactgtaggtgactcggtaataatatttccaccccctccaccaccttactttcctgaatcttcagcttctgcggtcgctgagagtcctggaactaacagtctgcttccgaatgaaaaccccccttcatattacagtattttcaactatgggaccccaacttcagagggtgcagcctctgaaagagactgtgaatctatatataccatttctgggacgaattcatcttctgaggcctcacacactccacatcttccatctgaattgcctcctagatatgaagaaaaagaaaatgctgcagctacattcttgcctctatcttctgagccttccccaccgtaaactatggactctagttcagttttatatgcaatggatcactattttatttaattttttttaaataaaaaatacaatagca

SEQ ID NO: 7338 - DNA, 1535 bp, Homo sapiens
gccggccccgccaggtgtgcgggccaggcagccgtggaaggtgcccatttctcccagattcctcgcgcgcacggccacgagcgcggaggctgccaaacccgccagccctgggttccgaagccgcccctggctctccattccctcgcgggcgcgccccgggcccccagtggcggccagctcccaccggtcgctcctgcactgccctgccctgccctccccgggccgccgcgcccgcgcagcaccgcctccttctctaaatactgccgggtccgccctccgcaccaggacgcgcggtgggtagggtgcagggcggccggcgcagccgaggccgcgtgcggaggcggacgccgcgcccagccagtgcccacagcagcgcggtcagccaggcgccggacccagcttcagagctgctgaaatcttggagggaagaaaacacatcccaccctgcctccgggaaggggcctctcctggacatgtctcctgcagctgctgctgagccagatggggaccagcaggacagacacgtcagcaaactcatcttctgcttctttgtcttcggcgccgtcttgttgtgtgtgggagtcctgctctccatctttgggttccaggcatgccaatataagcccctcccagactgccccatggtgctcaaggtggcggggcctgcatgtgccgtggttggacttggggctgtgatcctggcccgctcccgggcgcaacttcagctccgtgcagggctgcagagaggtcagcagatggaccccgaccgagccttcatctgtggagagagccgccagtttgcccagtgccttatctttgggtttctgttcttgacaagcggcatgctcatcagcgtcctgggcatttgggtccctggatgtggctccaactgggcgcaggaaccgctaaacgagacagacactggcgactcagagccccggatgtgtgggttcctttctctgcagatcatggggcccttgattgtgcttgtgggattgtgtttcttcgtggttgcccatgttaagaagagaaacacgctgaatgctggccaggatgcctctgagagagaagagggacagatccagattatggagcctgtccaggtcactgtaggtgactcggtaataatatttccaccccctccaccaccttactttcctgaatcttcagcttctgcggtcgctgagagtcctggaactaacagtctgcttccgaatgaaaaccccccttcatattacagtattttcaactatggcaggaccccaacttcagagggtgcagcctctgaaagagactgtgaatctatatataccatttctgggacgaattcatcttctgaggcctcacacactccacatcttccatctgaattgcctcctagatatgaagaaaaagaaaatgctgcagctacattcttgcctctatcttctgagccttccccaccgtaaactatggactctagttcagttttatatgcaatggatcactattttatttaattttttttaaataaaaaatacaatagcattggctat

SEQ ID NO: 7339 - DNA, 1759 bp, Homo sapiens
tctcacaatcctctccactctaagaagcagggtgagcccacaaggagcaatggagcagggcagcggccgcttggaggacttccctgtcaatgtgttctccgtcactccttacacacccagcaccgctgacatccaggtgtccgatgatgacaaggcgggggccaccttgctcttctcaggcatctttctgggactggtggggatcacattcactgtcatgggctggatcaaataccaaggtgtctcccactttgaatggacccagctccttgggcccgtcctgctgtcagttggggtgacattcatcctgattgctgtgtgcaagttcaaaatgctctcctgccagttgtgcaaagaaagtgaggaaagggtcccggactcggaacagacaccaggaggaccatcatttgttttcactggcatcaaccaacccatcaccttccatggggccactgtggtgcagtacatccctcctccttatggttctccagagcctatggggataaataccagctacctgcagtctgtggtgagcccctgcggcctcataacctctggaggggcagcagccgccatgtcaagtcctcctcaatactacaccatctaccctcaagataactctgcatttgtggttgatgagggctgcctttctttcacggacggtggaaatcacaggcccaatcctgatgttgaccagctagaagagacacagctggaagaggaggcctgtgcctgcttctctcctcccccttatgaagaaatatactctctccctcgctagaggctattctgatataataacacaatgctcagctcagggagcaagtgtttccgtcattgttacctgacaaccgtggtgttctatgttgtaaccttcagaagttacagcagcgcccaggcagcctgacagagatcattcaaggggggaaaggggaagtgggaggtgcaatttctcagattggtaaaaattaggctgggctggggaaattctcctccggaacagtttcaaattccctcgggtaagaaatctcctgtataaggttcaggagcaggaatttcactttttcatccaccaccctcccccttctctgtaggaaggcattggtggctcaattttaaccccagcagccaatggaaaaatcacgacttctgagactttgggagtttccacagaggtgagagtcgggtgggaaggaagcagggaagagaaagcaggcccagctggagatttcctggtggctgtccttggccccaaagcagactcactaatcccaaacaactcagctgccatctggcctctctgaggactctgggtaccttaaagactataaaacaaaacaaaacaaaaacatcaaaccaatgaaataaaataaatcatgtctcctgctagaatagtattggatacctgactaaattacacaaaatagaccataataggatagcgctgtgaatacatccttcccgatcactgagtcacagtgacccttggctgctgctgttctcttctgcaaggttgaagcttgacgtgtgatgaacatgggtgggctcttggtccaccccaggctggggcctgcgccaagcatgaactagctgggaccagtggctgacagaacacaggacttccctaagtacccgtaggtctgtggagcaagacagagcagagttgccatgtcaacacatggggaatgatatgatagaaacaatctttatgactaaaagaaactcatcttcttcattaaaaaaactttggtgtccttaa

SEQ ID NO: 7340 - DNA, 1860 bp, Homo sapiens
acttcctggctgcgcgcgcaggcgcggaggtctgacggagacagcgcgtgcgcggcgtcgccgggcttgcgatgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagtcacgggcaggccgcagtggttcttgcgtggcctggttttattttcattgtgaaatatcatgctcttatttcagtcctcaaa

SEQ ID NO: 7341 - DNA, 2012 bp, Homo sapiens
atgaacttccggctgtcaagctcccggccgggctgactcaagcggaggcgcgcggaacagtcgccgaggcgattcccgcccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacaggtaacggggcaggctgtgctctgcgtggtgtggccctgcgaagatatagggtccccgaggctcgacctggcacagggtgctgaccctgcacgcctcgaagcttctgaggcttaggaggcagaggcgggaggcgggggcctccttggaaagggagggagccaacaagtcctgctcagcctgtgctcaccccggcggaggtcctggcctcctgggagggtgggagactgggctcctagggctctgtttccgagttcagtggacaaaggcagcaccctggaagtgagccagaggacaggttggaagaggaaggttccgggcctgccccaaggacagaagtttcctctgcgggagggcagctgccccagcaggcaggccccttacgtagctgctctgagtaaacgcggccagcgccccgtctcagcggggacactcccaccccggctgctcctgcaggcctggagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgtgccccccatcgcttcgcagcccctcctgctccctttggctggctgttgcttccttccagcgtctgctcctccgcggcctcatctgcctcttcgtctgttagagcgcgcgtctcgtctcagtcgtcacgtttttggtttttgtggggttttttttttttttttttgagacagtcctgctgtgtcgcccaggctggagtatagtggctcaagctcagctcactgcaacctccgcctcccaggttcaagcaattctcctgcctcagcctcccaagtagttgggattacaagcacccaccaccatgcccagctaactttttgcatttttaatagagatgaggtttcaccaagttggccaggctggtcttgaactcctgacctcaggtgatctgcccacctcggcctcccaaagtgctgggattacaggtgtaagccaccgtgcccggccatcgtaatgtttgaatttgcttttttacatcttccatccttttggagtgtcttgttccctcgtcatagttcagcactgtgaccaccttggggttagacactatggttttatatcctgtacttgatattctcgagtccaagtctcctgat

SEQ ID NO: 7342 - DNA, 619 bp, Homo sapiens
cggccgggctgactcaagcggaggcgcgcggaacagtcgccgaggcgattcccgcccagctcccctgccctgagacagcctccggtgcttctgctgtgtcccaggaaacaagcctgaagcaagcactcaccatccctcaagaatgtgccctgacctaccttcctcaccacggtggcatcagggccaggctcctgtaaccgccaggcagcggccccgccatgtcccagccccggaccccagagcaggcactggatacaccgggggactgccccccaggcaggagagacgaggacgctggggaggggatccagtgctcccaacgcatgctcagcttcagtgacgccctgctgtccatcatcgccaccgtcatgatcctgcctgtgacccacacggagatctccccagaacagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggcctgcatgatgaccatcaccttcctgccttacacgttttcgttaatggtgaccttccc

SEQ ID NO: 7343 - DNA, 1514 bp, Homo sapiens
tccggctgtcaagctcccggccgggctgactcaagcggaggcgcgcggaacagtcgccgaggcgattcccgcccagcagttcgacagaagtgtacagaggcttctggcaacacggattgccgtctacctgatgacctttctcatcgtgacagtggcctgggcagcacacacaaggttgttccaagttgttgggaaaacagacgacacacttgccctgctcaacctggccgcatcatggctgtgatgccctccctccctccaggcctgcatgatgaccatcaccttcctgccttacacgttttcgttaatggtgaccttccctgatgtgcctctgggcatcttcttgttctgtgtgtgtgtgatcgccattggggtcgtgcaggcactgattgtggggtacgcattccacttcccgcacctgctgagcccgcagatccagcgctctgcccacagggctctgtaccgacgacacgtcctgggcatcgtcctccaaggcccggccctgtgctttgcagcggccatcttctctctcttctttgtccccttgtcttacctgctgatggtgactgtcatcctcctcccctatgtcagcaaggtcaccggctggtgcagagacaggctcctgggccacagggagccctcggctcacccagtggaagtcttctcgtttgacctccacgagccactcagcaaggagcgcgtggaagccttcagcgacggagtctacgccatcgtggccacgcttctcatcctggacatctgcgaagacaacgtcccggaccccaaggatgtgaaggagaggttcagcggcagcctcgtggccgccctgagtgcgaccgggccgcgcttcctggcgtacttcggctccttcgccacagtgggactgctgtggttcgcccaccactcactcttcctgcatgtgcgcaaggccacgcgggccatggggctgctgaacacgctctcgctggccttcgtgggtggcctcccactagcctaccagcagacctcggccttcgcccggcagccccgcgatgagctggagcgcgtgcgtgtcagctgcaccatcatcttcctggccagcatcttccagctggccatgtggaccacggcgctgctgcaccaggcggagacgctgcagccctcggtgtggtttggcggccgggagcatgtgctcatgttcgccaagctggcgctgtacccctgtgccagcctgctggccttcgcctccacctgcctgctgagcaggttcagtgtgggcatcttccacctcatgcagatcgccgtgccctgcgccttcctgttgctgcgcctgctcgtgggcctggccctggccaccctgcgggtcctgcggggcctcgcccggcccgaacaccccccgccagcccccacgggccaggacgacccacagtcccagctcctccctgccccctgctagcagccacagagcccactcccagccgtcctcaccagagatggaccagggaggacaggatgctgggcaggggaagccaagt

SEQ ID NO: 7344 - DNA, 1261 bp, Homo sapiens
gcacgccggccctggccgggcggggctggaggcgagaacgaccccacgggctttcccagggccgtccgcccgcggaccctcccagctccccagagcccagtgaccctcgcgcagcaggagaaccccagacggaccccaggccctgcagcctgtcatgaacccgaggggctgaagttcagccccacccccgcctcccctccccgcctccccctccaactctcaacccacttctccagccagcgccccagccctcccgccgcccgctcgcaggtcccgaggagcgcagactgtgtccctgacaatgggaacagccgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctaacgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctgacccctctgtggctgtactgctggagaatgttcccaaccaaagggaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgttattgttcccagg

SEQ ID NO: 7345 - DNA, 1530 bp, Homo sapiens
ggccccgcccaggctgcgcggtttcccgaaaccagctgcggcccgggggcccggcaaagggggttccgcccggaggagcggaccgggcgggagaagaccgagcccccgcgcgccccctgcgctcccactcgcgcacacttgcacgccggccctggccgggcggggctggaggcgagaacgaccccacgggctttcccagggccgtccgcccgcggaccctcccagctccccagagcccagtgaccctcgcgcagcaggagaaccccagacggaccccaggccctgcagcctgtcatgaacccgaggggctgaagttcagccccacccccgcctcccctccccgcctccccctccaactctcaacccacttctccagccagcgccccagccctcccgccgcccgctcgcaggtcccgaggagcgcaggtgaggcggcaccccactcccggcggcccccgggcctccttccgcacgcaccccgagctgcctccgcacagttggaggagcgtaggagggacccccacccagggatgacactccaggaaggggactgcagaggaagccagactgtgtccctgacaatgggaacagccgacagtgatgagatggccccggaggccccacagcacacccacatcgatgtgcacatccaccaggagtctgccctggccaagctcctgctcacctgctgctctgcgctgcggccccgggccacccaggccaggggcagcagccggctgctggtggcctcgtgggtgatgcagatcgtgctggggatcttgagtgcagtcctaggaggatttttctacatccgcgactacaccctcctcgtcacctcgggagctgccatctggacaggggctgtggctgtgctggctggagctgctgccttcatttacgagaaacggggtggtacatactgggccctgctgaggactctgctaacgctggcagctttctccacagccatcgctgccctcaaactttggaatgaagatttccgatatggctactcttattacaacagtgcctgccgcatctccagctcgagtgactggaacactccagcccccactcagagtccagaagaagtcagaaggctacacctatgtacctccttcatggacatgctgaaggccttgttcagaacccttcaggccatgctcttgggtgtctggattctgctgcttctggcatctctgacccctctgtggctgtactgctggagaatgttcccaaccaaagggaaaagagaccagaaggaaatgttggaagtgagtggaatctagccatgcctctcctgattattagtgcctggtgcttctgcaccgggcgtccctgcatctgactgctggaagaagaaccagactgaggaaaagaggctcttcaacagccccagttatcctggccccatgaccgtggccacagccctgctccagcagcacttgcccattccttacaccccttccccatcctgctccgcttcatgtcccctcctgagtagtcatgtgataataaactctcatgtta

SEQ ID NO: 7346 - DNA, 1129 bp, Homo sapiens
gtcgctcccctgctcggggtcagctagtgtccgctctgctcggccgcgggctcccggaggactgcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgagtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagctgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagttttgcccagaaa

SEQ ID NO: 7347 - DNA, 1206 bp, Homo sapiens
cccacctcagcctcccaaagcactgggattacaggcgtgagctattgtgcccagctgggatcttgacaaagacactatttctctcctttcacctgtgctgtgtatttttccctcgcctagttcccagacctcactgctatatgtcttctccctggcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgagtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagctgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagca

SEQ ID NO: 7348 - DNA, 1303 bp, Homo sapiens
cgagtgggagcgcagggggcgcgcgggggctcggtcttctcccgcccggtccgctcctccgggcggaaccccctttgccgggcccccgggccgcagctggtttcgggaaaccgcgcagcctgggcggggccgcagcccccacccgtgcatctgccgtctccgccctcccgtcgctcccctgctcggggtcagctagtgtccgctctgctcggccgcgggctcccggaggactgcaggtgaggccaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgagtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagctgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagttttgccc

SEQ ID NO: 7349 - DNA, 1430 bp, Homo sapiens
gctgaccatgctggaactgcggcgactacagagcctgcgggaacctcccctttcgcccaagatctgctctgtccccctcatcctcctcccagggccctggcgtctgggtcaagcagcgccccacacctcgacccctcaccccctcctcccgggctcttcctgcggcctcccctccacagtccgcaggctctgggacaggaccgagtccttggctgcctgtggagctcctgtgccagcagctgcgccccggctgcgctccggatacccccatccccgccaccgccgacctcccgctccaccgactgctgctcacgcccgacgggttcacgccgcccctgccccgtgaaggaccgcgctgcggtgcggaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgagtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagctgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagttttgcccagaaa

SEQ ID NO: 7350 - DNA, 1006 bp, Homo sapiens
cccgtcgctcccctgctcggggtcagctagtgtccgctctgctcggccgcgggctcccggaggactgcaggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagctgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagc

SEQ ID NO: 7351 - DNA, 1265 bp, Homo sapiens
ctcggggtcagctagtgtccgctctgctcggccgcgggctcccggaggactgcaggaggactcacgtaggagggagggacagctgggtgcaggtgtttctccccagaaaaacggctggagagcgggaggagaggcctggggctggcgcgtcccgtccaccttctgccgcctgcacgcctggaccctggctggagccctacggcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgagtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagctgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagcagttttgcccagaaaga

SEQ ID NO: 7352 - DNA, 2252 bp, Homo sapiens
gtgctgaccatgctggaactgcggcgactacagagcctgcgggaacctcccctttcgcccaagatctgctctgtccccctcatcctcctcccagggccctggcgtctgggtcaagcagcgccccacacctcgacccctcaccccctcctcccgggctcttcctgcggcctcccctccacagtccgcaggctctgggacaggaccgagtccttggctgcctgacgctttccccagccccggggcacgggaagagctggacagaggaaagtgttcggggcagccgggaagagcccaccacctaccaggcgtcgggcggcccgcaggggaatctccgtggtgccggcctggttcagatccgactcttcaggcgggggcgaggcagatctaggggttggcgtggggcgggggaagcggtggtcctgggggcccggaggtagctggaacccgaggtgccctcagggcgaggcctgggccgtcaagggaaggtctggctggaatctggggctgggctggaagcagtctgaagctcctttgtacgtgtgcggaattgtctaactcctgtcctttctaaccccaaggaggccaggtgggtgaaagagtgaaactgctttgaaaagtaggtagagtacgaatgggaggtgttattagaattgttaataatatttgatttaaactgtgatacttagccaggatgtccattagaattgcctatgcaggatttattttagagccaggcaagctgattctaaagtgcatgtgaagaagtagtctagcaaaaatggccatgacaattctgaaagaaaaaccacacgaggggatcatgaaacagcccaattagcattaagctccatgttaaaattgtggtaatgatgcctagcccatgagacatgccaatgggcagaatataaggactagaataggcctacattcctaggggaacttcatttctgctcaggagagaattttaaatcactgagaaaaagaggatgtattttccgcaaatggaacgtatctttcagaagttaaacatctgaatgacagcaacagaacttggatccgtgtctcccaacggcgaaggttggtcacccagctcccaaattccagatggtcggcatttaaaagtgaaaactgaaagcataaaggcacttagaagaaaatgtggaagattattttataatctcgaaacggggaagtcctttaaaagtgcaggatgacgcaaaacacggtgattgtgaatggagttgctatggcctctaggccatcccagcccacccacgtcaacgtccacatccaccaggagtcagctttgacacaactgctgaaagctggaggttctctgaagaagtttctttttcaccctggggacactgtgccttccacagccaggattggttatgagcagctggctctaggggtgactcagatattgctgggggttgtgagttgtgttcttggagtgtgtctcagcttggggccctggactgtgctgagtgcctcaggctgtgccttctgggcggggtctgtggtgatcgcagcaggagctggggccattgtccatgagaagcacccgggcaaacttgctggctatatatccagcctgctcaccctggcaggctttgctacagctatggctgctgttgtcctctgcgtgaatagcttcatctggcaaactgaaccctttttatacatcgacactgtgtgtgatcgctcagaccctgtcttccctaccactgggtacagatggatgcggcgaagtcaagagaaccaatggcagaaggaggagtgtagagcttacatgcagatgctgaggaagttgttcacagcaatccgtgccctgttcctggctgtctgtgtcttgaaggtcattgtgtccttggtttccttgggagtaggtcttcgaaacttgtgtggccagagctcccagcccctgaatgaggaaggatcagagaagaggctactgggggagaattcagtgcccccttcgccctctagggagcagacctccactgccattgtcctgtgagctgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatgctgattaaacataataaacaatccagaaaagc

SEQ ID NO: 7353 - DNA, 1394 bp, Homo sapiens
gtgctttgcggccgccctgccgcgcgcacatgtaggcgttccgagcggcggcggaggtgagcgcacggacgagcgggagggacccttctccggcctgatgcgacccgattgtccgcagtgactacactcatggcaggtcccctgtggcggaccgcagcatttgtgcagagacacaggacaggcctcttggtgggttcctgtgcaggcctgtttggagttccaatctcgtaccacctcttcccggatcccgtggtccaatggctctaccagtactggcctcagggccagccagctccgctccctccacagctgcagagcctcttccaagaggtgctacaggacataggtgttccttcaggccattgctacaagcccttcaccaccttcaccttccaacctgtgagtgcaggcttcccaagactccctgctggggctgtggtgggcatccctgccagtttcttgggagacctagtgatcaacactaaccatcccgtggtcatacatgggcatacagtggactggcggagcccagcaggcgcccggctgagagcttccctgaccttgtcccgtgaagcccagaagttcgccttggccagggaagtggtgtacctggaaagcagtaccactgccgtgcacgccctgctggccccagcttgcctggcagggacctgggcactgggcgtgggtgccaagtacaccctggggctccatgcaggccccatgaatttacgggctgccttcagcttggtggcagcagtggcaggctttgtggcctacgccttctcccaggattctctcactcatgccgtggagtcctggctggaccgccgcacggcctccctctctgcagcctatgcctgtggtggagtggagttctatgagaagcttctgtcgggcaacctggccctgcgcagtctcttgggcaaagacggggagaagctgtatacacccagcgggaacatcgtccccagacacttgttccgaatcaaacatttaccctacaccacccgccgggactctgtgctgcagatgtggagggggatgctcaatccgggccgctcctgatgggctcatcacaaggacacttccagcttgtgcagacaccaccctgccattgagtctggagggccctgttggagcctttggacctatagctcacggccagaaaaatcactggctttggaattaaatagcttagattgtactataaccactacttatgaactcagggactatgagggactattcaggggctatgaatctgagcctttgtttcttgaactgtaaagtggagatgatgtaaaccgccttgcaagattgtagagttgggtaaggtcatgaacataagggcctggcacaaagggtgcactgtaaataaacagacatccctcctt

SEQ ID NO: 7354 - DNA, 1346 bp, Homo sapiens
ggcgtgctttgcggccgccctgccgcgcgcacatgtaggcgttccgagcggcggcggagattgtccgcagtgactacactcatggcaggtcccctgtggcggaccgcagcatttgtgcagagacacaggacaggcctcttggtgggttcctgtgcaggcctgtttggagttccaatctcgtaccacctcttcccggatcccgtggtccaatggctctaccagtactggcctcagggccagccagctccgctccctccacagctgcagagcctcttccaagaggtgctacaggacataggtgttccttcaggccattgctacaagcccttcaccaccttcaccttccaacctgtgagtgcaggcttcccaagactccctgctggggctgtggtgggcatccctgccagtttcttgggagacctagtgatcaacactaaccatcccgtggtcatacatgggcatacagtggactggcggagcccagcaggcgcccggctgagagcttccctgaccttgtcccgtgaagcccagaagttcgccttggccagggaagtggtgtacctggaaagcagtaccactgccgtgcacgccctgctggccccagcttgcctggcagggacctgggcactgggcgtgggtgccaagtacaccctggggctccatgcaggccccatgaatttacgggctgccttcagcttggtggcagcagtggcaggctttgtggcctacgccttctcccaggattctctcactcatgccgtggagtcctggctggaccgccgcacggcctccctctctgcagcctatgcctgtggtggagtggagttctatgagaagcttctgtcgggcaacctggccctgcgcagtctcttgggcaaagacggggagaagctgtatacacccagcgggaacatcgtccccagacacttgttccgaatcaaacatttaccctacaccacccgccgggactctgtgctgcagatgtggagggggatgctcaatccgggccgctcctgatgggctcatcacaaggacacttccagcttgtgcagacaccaccctgccattgagtctggagggccctgttggagcctttggacctatagctcacggccagaaaaatcactggctttggaattaaatagcttagattgtactataaccactacttatgaactcagggactatgagggactattcaggggctatgaatctgagcctttgtttcttgaactgtaaagtggagatgatgtaaaccgccttgcaagattgtagagttgggtaaggtcatgaacataagggcctggcacaaagggtgcactgtaaataaacagacatccctcctt

SEQ ID NO: 7355 - DNA, 753 bp, Homo sapiens
atggcaggtcccctgtggcggaccgcagcatttgtgcagagacacaggacaggcctcttggtgggttcctgtgcaggcctgtttggagttccaatctcgtaccacctcttcccggatcccgtggtccaatggctctaccagtactggcctcagggccagccagctccgctccctccacagctgcagagcctcttccaagaggtgctacaggacataggtgttccttcaggccattgctacaagcccttcaccaccttcaccttccaacctgtgagtgcaggcttcccaagactccctgctggggctgtggtgggcatccctgccagtttcttgggagacctagtgatcaacactaaccatcccgtggtcatacatgggcatacagtggactggcggagcccagcaggcgcccggctgagagcttccctgaccttgtcccgtgaagcccagaagttcgccttggccagggaagtggtgtacctggaaagcagtaccactgccgtgcacgccctgctggccccagcttgcctggcagggacctgggcactgggcgtgggtgccaagtacaccctggggctccatgcaggccccatgaatttacgggctgcctccctctctgcagcctatgcctgtggtggagtggagttctatgagaagcttctgtcgggcaacctggccctgcgcagtctcttgggcaaagacggggagaagctgcagatgtggagggggatgctcaatccgggccgctcctga

SEQ ID NO: 7356 - DNA, 1738 bp, Homo sapiens
ggcgtgctttgcggccgccctgccgcgcgcacatgtaggcgttccgagcggcggcggaggtgagcgcacggacgagcgggagggacccttctccggcctgatgcgacccggtaacgcgttcagactgcggagtagcctaggggcccagagtggaagcgtagcgaggacccctctgcggggctcctgcagcccctcctcccccagccaccggcgggctgcatggtactgtgttctaggcccaccccgcagcgcgatggccctagggacgttggactttggtccagacctttcctttcttagcctcactttccgcattgggaaaaaaaaaaagcccgaatgataatgattcttataggagttcttgattaagataggccaagcggtaccctgcgtttttgtttgcggcaactcattcgttgctcattaagcacttttcacggacaggaatacaattgtccgcagtgactacactcatggcaggtcccctgtggcggaccgcagcatttgtgcagagacacaggacaggcctcttggtgggttcctgtgcaggcctgtttggagttccaatctcgtaccacctcttcccggatcccgtggtccaatggctctaccagtactggcctcagggccagccagctccgctccctccacagctgcagagcctcttccaagaggtgctacaggacataggtgttccttcaggccattgctacaagcccttcaccaccttcaccttccaacctgtgagtgcaggcttcccaagactccctgctggggctgtggtgggcatccctgccagtttcttgggagacctagtgatcaacactaaccatcccgtggtcatacatgggcatacagtggactggcggagcccagcaggcgcccggctgagagcttccctgaccttgtcccgtgaagcccagaagttcgccttggccagggaagtggtgtacctggaaagcagtaccactgccgtgcacgccctgctggccccagcttgcctggcagggacctgggcactgggcgtgggtgccaagtacaccctggggctccatgcaggccccatgaatttacgggctgccttcagcttggtggcagcagtggcaggctttgtggcctacgccttctcccaggattctctcactcatgccgtggagtcctggctggaccgccgcacggcctccctctctgcagcctatgcctgtggtggagtggagttctatgagaagcttctgtcgggcaacctggccctgcgcagtctcttgggcaaagacggggagaagctgtatacacccagcgggaacatcgtccccagacacttgttccgaatcaaacatttaccctacaccacccgccgggactctgtgctgcagatgtggagggggatgctcaatccgggccgctcctgatgggctcatcacaaggacacttccagcttgtgcagacaccaccctgccattgagtctggagggccctgttggagcctttggacctatagctcacggccagaaaaatcactggctttggaattaaatagcttagattgtactataaccactacttatgaactcagggactatgagggactattcaggggctatgaatctgagcctttgtttcttgaactgtaaagtggagatgatgtaaaccgccttgcaagattgtagagttgggtaaggtcatgaacataagggcctggcacaaagggtgcactgtaaataaacagacatccctcctt

SEQ ID NO: 7357 - DNA, 791 bp, Homo sapiens
gcgcgcacatgtaggcgttccgagcggcggcggaggtgagcgcacggacgagcgggagggacccttctccggcctgatgcgacccggtaacgcgttcagactgcggagtagcctaggggcccagagtggaagcgtagcgaggacccctctgcggggctcctgcagcccctcctcccccagccaccggcgggctgcatggtactgtgttctaggcccaccccgcagcgcgatggccctagggacgttggactttggtccagacctttcctttcttagcctcactttccgcattgggaaaaaaaaaaagcccgaatgataatgattcttataggagttcttgattaagataggccaagcggtaccctgcgtttttgtttgcggcaactcattcgttgctcattaagcacttttcacggacaggaatacaattgtccgcagtgactacactcatggcaggtcccctgtggcggaccgcagcatttgtgcagagacacaggacaggcctcttggtgggttcctgtgcaggcctgtttggagttccaatctcgtaccacctcttcccggatcccgtggtccaatggctctaccagtactggcctcagggccagccagctccgctccctccacagctgcagagcctcttccaagaggtgctacaggacataggtgttccttcaggccattgctacaagcccttcaccaccttcaccttccaacctgtgagtgcaggcttcccaagactccctgctggggctgtggtgggcatccctgccagtttcttgggagaccta

SEQ ID NO: 7358 - DNA, 1662 bp, Homo sapiens
attgtgtctggcggcggcgcgcgagcccaccggcggctgcggcggggcgggaagccatggagccgcgggcgctcgtcacggcgctcagcctcggcctcagcctgtgctccctggggctgctcgtcacggccatcttcaccgaccactggtacgagaccgacccccggcgccacaaggagagctgcgagcgcagccgcgcgggcgccgaccccccggaccagaagaaccgcctgatgccgctgtcgcacctgccgctgcgggactcgcccccgctggggcgccggctgctcccgggcggcccggggcgcgccgaccccgagtcctggcgctcgctcctggggctcggcgggctggacgccgagtgcggccggcccctcttcgccacctactcgggcctctggaggaagtgctacttcctgggcatcgaccgggacatcgacaccctcatcctgaaaggtattgcgcagcgatgcacggccatcaagtaccacttttctcagcccatccgcttgcgaaacattccttttaatttaaccaagaccatacagcaagatgagtggcacctgcttcatttaagaagaatcactgctggcttcctcggcatggccgtagccgtccttctctgcggctgcattgtggccacagtcagtttcttctgggaggagagcttgacccagcacgtggctggactcctgttcctcatgacagggatattttgcaccatttccctctgtacttatgccgccagtatctcgtatgatttgaaccggctcccaaagctaatttatagcctgcctgctgatgtggaacatggttacagctggtccatcttttgcgcctggtgcagtttaggctttattgtggcagctggaggtctctgcatcgcttatccgtttattagccggaccaagattgcacagctaaagtctggcagagactccacggtatgactgtcctcactgggcctgtccacagtgcgagcgactcctgaggggaacagcgcggagttcaggagtccaagcacaaagcggtcttttacattccaacctgttgcctgccagccctttctggattactgatagaaaatcatgcaaaacctcccaacctttctaaggacaagactactgtggattcaagtgctttaatgactatttatgcgttgactgtgagaatagggagcagtgccatgggacatttctaggtgtagagaaagaagaaactgcaatggaaaaatttgtatgatttccatttatttcagaaagtttgtatgtaacaattacccgagagtcatttctacttgcaaaaggattcgtaacaaagcgagtataattttcttgtcattgtatcatgcttgttaaattttaatgcagcatcttcagaacttgtcctgatggtgtcttattgtgtcagcaccaaatatttgtgcattatttgtggacgttccttgtcacaggaagattcttcttctgttgccttattgtttttttttttttaagtctcttctctgtctttgtactggaatcgaaatcataagataaacagatcaaacgtgcttaagagctaactcgtgacactatgcagtattgtttgaagacctgttgttcaacctctgtctctttatgttaactggatttctgcattaaatgactgcccccttgttaa

SEQ ID NO: 7359 - DNA, 1467 bp, Homo sapiens
atggagccgcgggcgctcgtcacggcgctcagcctcggcctcagcctgtgctccctggggctgctcgtcacggccatcttcaccgaccactggtacgagaccgacccccggcgccacaaggagagctgcgagcgcagccgcgcgggcgccgaccccccggaccagaagaaccgcctgatgccgctgtcgcacctactcgggcctctggaggaagtgctacttcctgggcatcgaccgggacatcgacaccctcatcctgaaaggtattgcgcagcgatgcacggccatcaagtaccacttttctcagcccatccgcttgcgaaacattccttttaatttaaccaagaccatacagcaagatgagtggcacctgcttcatttaagaagaatcactgctggcttcctcggcatggccgtagccgtccttctctgcggctgcattgtggccacagtcagtttcttctgggaggagagcttgacccagcacgtggctggactcctgttcctcatgacagggatattttgcaccatttccctctgtacttatgccgccagtatctcgtatgatttgaaccggctcccaaagctaatttatagcctgcctgctgatgtggaacatggttacagctggtccatcttttgcgcctggtgcagtttaggctttattgtggcagctggaggtctctgcatcgcttatccgtttattagccggaccaagattgcacagctaaagtctggcagagactccacggtatgactgtcctcactgggcctgtccacagtgcgagcgactcctgaggggaacagcgcggagttcaggagtccaagcacaaagcggtcttttacattccaacctgttgcctgccagccctttctggattactgatagaaaatcatgcaaaacctcccaacctttctaaggacaagactactgtggattcaagtgctttaatgactatttatgcgttgactgtgagaatagggagcagtgccatgggacatttctaggtgtagagaaagaagaaactgcaatggaaaaatttgtatgatttccatttatttcagaaagtttgtatgtaacaattacccgagagtcatttctacttgcaaaaggattcgtaacaaagcgagtataattttcttgtcattgtatcatgcttgttaaattttaatgcagcatcttcagaacttgtcctgatggtgtcttattgtgtcagcaccaaatatttgtgcattatttgtggacgttccttgtcacaggaagattcttcttctgttgccttattgtttttttttttttaagtctcttctctgtctttgtactggaatcgaaatcataagataaacagatcaaacgtgcttaagagctaactcgtgacactatgcagtattgtttgaagacctgttgttcaacctctgtctctttatgttaactggatttctgcattaaatgactgcccccttgtt

SEQ ID NO: 7360 - DNA, 2510 bp, Homo sapiens
aataaaacaaaaatattttttaatgcttgcaacaaaaatgctgatggaattttaaaccaggaggagcaatgttaaggcttcctcactctgggaattggactaaaggtgacttagtcttaaaggcaactagaaaaggcattaattctattaattaatgcctcagcgatttccatctcagcaaagatgtcttaatgaggcgctcgggacacccattatttatcttacaaatgcagctccagggtcctgcccatgtcaggcagtgtaacacacgtccccgcggagggctggcgctgcagaagctcccggtccaccccctcctgcccacacctggcctcaccctccccatctcttcgaggatgacctctgtcccagtcccttggaccccgactcctccacgatctggcccctcccctcatacattgcatttcgggacccccgcaaaggaatcacttcagcctggactgcaaaccgcactcctacacctcactatgagcaccttgggggtgtcctccaacaccccccgccccgccctctctctcctggtctcctttcgttcgagctgatgaggaactgacgacccagagtcggcctgtgtgaggcccgtacaggtggctcccgaagtctttagcggcacagggtcggtccctccaggccgacctggtaaaattcccgcatctcccgcaggccgcccttctctggcccctggaccccgggctcctggcccgcgcgcaccaggagctgtccgcggtgctgaccgcaggcgcttcccgcgctcggccgatgcgcacgcgtcccgggaggggcgcgcgggacctgccggcgccgccactgcgcagcctcccgcggcctccccgcccggcgcagcctcccgcggccttcccgccgccgctctcgcccgggccggccatggcgctcaacaatttccttttcgctcagtgcgcctgctacttcttggccttcctgttcagcttcgtggtggtggtcccgctgtccgagaacggccacgacttccgcggccgctgcctgctcttcaccgagggcatgtggctgagcgccaacctcacggtgcaggagcgcgagcgcttcacggtgcaggagtggggcccgccggccgcctgccgcttcagcctgctcgccagcctcctgtctctgctgctggccgccgcgcacgcctggcgcacgctcttcttcctctgcaagggacacgagggctccttcttctccgccttcctgaacctcctggtcagcgccttcgtggtcttcctggtcttcattgccagcaccatcgtgagcgtgggcttcaccatgtggtgcgacaccatcaccgagaagggcaccgtaccccacagctgtgaagagctccaggacatcgacttggagctgggcgtggacaactccgccttctacgatcagtttgcaattgcccaggtagggggctctgggcaagaagggaggcttgcaatgctgggagggggccatttactgctggacatttgctgagctctcccccatccagaggaggaggcaggctcctgtgtggataaggtagttagcaatgggaccaggcagtgggagcagtcgggaaggcttcctgcaggaggtgggggagagctgggcttttgtaggtgggtttggggaggagatggccacagtgagttagaatcaggaagtggcaaggccctggggtctggggtgggaagtgtgggggtgtggggggaggtggtgccagaaacgaaaccaggcatcagatcctgggggtccagtgtagggacaagggctttggactttggtgctggcgctgggtgggcctgttcagatcagagctggaggcttagaggagtcccctagccagggggaagctgatacagagtccaaggaaggaggcaggggatcccacttgtgaattcagatttgccaccctgcccttgtataagctgcgtcccccgccccctaggagacttggtggagggcgatggtggcccccactctgagggacgctatttgctgaaatgcaggcatgtggggacacatcagtggcccgtgagggccggagggggaaccctggaattgggtttgccccttgaaatctgcagatgtgccccagacggagatgaggcagatgaggggtgccgggtgggggtggctgagaccagacacctggctcctgccagcactgatcagggcccgctggcttcaggtccaattccggaccccaggctggcctctgaaggctcttgctggccgtggctggcctgaggacgcttctcctggccaggagccctccaagggtgctggacatgggtgggcctgaatgctctttgccgagatgaactggacctgtcaaagacaccttcatgcaaatttagtgagtggaagaggcctcaggcctaatttgtgccagttggattaaggtgtgagtgcagtctgatggcaaatacgctcaaatgagaatcagcttaatgtagctcaggcctggttctgattaaattgtttctccttcaactgtttgg

SEQ ID NO: 7361 - DNA, 1430 bp, Homo sapiens
aattcccgcatctcccgcaggccgcccttctctggcccctggaccccgggctcctggcccgcgcgcaccaggagctgtccgcggtgctgaccgcaggcgcttcccgcgctcggccgatgcgcacgcgtcccgggaggggcgcgcgggacctgccggcgccgccactgcgcagcctcccgcggcctccccgcccggcgcagcctcccgcggccttcccgccgccgctctcgcccgggccggccatggcgctcaacaatttccttttcgctcagtgcgcctgctacttcttggccttcctgttcagcttcgtggtggtggtcccgctgtccgagaacggccacgacttccgcggccgctgcctgctcttcaccgagggcatgtggctgagcgccaacctcacggtgcaggagcgcgagcgcttcacggtgcaggagtggggcccgccggccgcctgccgcttcagcctgctcgccagcctcctgtctctgctgctggccgccgcgcacgcctggcgcacgctcttcttcctctgcaagggacacgagggctccttcttctccgccttcctgaacctcctggtcagcgccttcgtggtcttcctggtcttcattgccagcaccatcgtgagcgtgggcttcaccatgtggtgcgacaccatcaccgagaagggcaccgtaccccacagctgtgaagagctccaggacatcgacttggagctgggcgtggacaactccgccttctacgatcagtttgcaattgcccagtttggcctctgggcctcatggctggcctggctggccatcaccacgctggccttcctgaaggtctaccacaactaccgtcaggaggacctgctggacagcctgatccacgagaaggagctgctgctggcccggccgtccccacgcacctccttccaagaggagaagagcgctgtcatttaggcacagtgcaggcagggggagctggccccgacctccctgctgcgctcgggggcacgggcctgcctggggaagcagctggggggctctgcctgggccctggccacatgcagccctgcgtgtgtcccctcgacgccacgtgtagtgaggtgagcgccccagtgcccacctgtgagcctggcagtggactgggtgggtgccggctccctgatgaggatggtgcagagagactatgggtgtggggcgggggcggggggcacctccaggcctcgcacagggccccttggctgtcccagtaggacctgactggccagcctatgtggagggcgtccagcttgtctcccccaaccctggccggatgctgtctccatgccagctggcccaggggtggccagatgtcacttagccctgaacgaattctgcatgaattctgccatccaggcagaggctgcgtgtggggaggagctcacggcaccttccagcctctgg

SEQ ID NO: 7362 - DNA, 864 bp, Homo sapiens
gcgccatggcgctgtcctggctgcagcgcgtcgagcttgcgctctttgctgccgccttcctgtgcggggccgtggcggccgcggcgatgactcggacccagggctccttcagtggtagatgtcccctgtatggtgtggccaccctgaatggctcctccctggccttatcccgtccctcagcaccatccctgtgctactttgtagctggggcctctggcctcttggccctctactgcctcctgcttttgctcttctggatctacagcagctgcatcgaggactcccacagaggtgctatagggctgcgcattgcactggccatctcagctatagccgtcttcctggtcttggtgtctgcctgtatccttcgatttggcaccaggtctctctgcaactccatcatctccttgaacactacaattagctgttctgaagcccagaaaattccatggacaccccctggaactgctctgcagttttactccaacctacacaatgctgaaacctcttcttgggtgaatttggtattgtggtgtgtggtcttggtgctccaggtcgtgcagtggaagtctgaagccaccccataccggcctctggagaggggtgaccctgagtggagctctgagacagatgctctcgttgggtcacgcctttcccattcctgaagaataagcggagtgcttcctgcagccgaagactccatgcccaagtgcctgtaatcccccccctcaaggccctgtttatgttgggagtcttagttttcctttcgttggggggtgggggggaaacataatgacaggcccccctccacctcttcctgcagctgtttttgtaccaaaatattatattactgtcttcatctta

SEQ ID NO: 7363 - DNA, 2834 bp, Homo sapiens
gccagccgtgggattaggcttcgccggctacgattgcggcccccatcttctgacttttcctcgtgtgacccatcttttcaaattcccttacctgaggaaggagcccgattacaaggatatttacctgctcctaccctgatctagggacgaggatgggaagaccgcctgtggccatgagccctccccggtgctcctggggctaaggctggggctgcagccatggggctgggtcagccccaggcctggttgctgggtctgcccacagctgtggtctatggctccctggctctcttcaccaccatcctgcacaatgtcttcctgctctactatgtggacacctttgtctcagtgtacaagatcaacaaaatggccttctgggtcggagagacagtgtttctcctctggaacagcctcaatgaccccctcttcggttggctcagtgaccggcagttcctcagctcccagccccggtcaggcgccgggctctcctcaagggctgtggtgctggcccgggtgcaggccctgggctggcatgggccgctgctggcgctgtcgttcctggcgttctgggtgccctgggccccagctggcctgcagttcttgctgtgcctgtgcctctatgatggcttcctgacgctcgtggacctgcaccaccatgccttgctggccgacctggccctctcagcccacgaccgcacccacctcaacttctactgctccctcttcagcgcggccggctccctctctgtctttgcatcctatgccttttggaacaaggaggatttctcctccttccgcgctttctgcgtgacactggctgtcagctctgggctgggctttctgggggccacacagctgctgaggcggcgggttgaggcggcccgaaaggacccagggtgctcaggcctggttgtggatagcggcctgtgtggagaggagctgcttgtaggcagtgaggaggcggacagcatcaccttgggccggtatctccggcagctggcacgccatcggaacttcctgtggttcgtgagcatggacctggtgcaggtcttccactgccacttcaacagcaacttcttccctctcttcctggagcatctgttgtccgaccatatctccctttccacgggctccatcctgttgggcctctcctatgtcgctccccatctcaacaacctctacttcctgtccctgtgccggcgctggggcgtctacgcggtggtgcgggggctcttcctgctcaagctgggacttagcctgctcatgttgttggccggcccggaccacctcagcctgctgtgcctcttcattgccagcaaccgcgtcttcactgagggcacctgtaagctgctgaccttggtggtcactgacctggtagacgaggacctggtgctgaaccaccgcaagcaggcagcctcggcactcctctttggcatggttgccttggtgaccaagccaggccagacctttgccccgctgctgggcacctggctgctctgtttctacacaggtcatgacctcttccagcagtccctcataacccctgtggggagtgcccatccctggccagagcccccagctccagcccctgcacaggccccgacgctccgccagggctgcttctacctgctggtgctggtgcccatcacctgtgctctgctgcagctcttcacctggtcccagttcacgctgcatgggagacgcctgcacatggtcaaggcccagcgccagaacctgtcacaggcccaaaccctggatgttaagatggtgtgagagctgtggcaaggtcaccccactgaggatgctgctggcagcctggggaaggagccagttttttttggttttttttttaaggatttcatagttttttttttttttttttggagctgttgcccaaaaaaatggatctgttgcagtggtgcaatctgggctcactgaaaccaccacccaggttcaagcaattatcctgcctcagcctcccgagtaggtgggattataggagcgtgccaccatgcccggctactttttgtatttttagtagagacagggtttcatcatgttggccaggctagtctcaaacccctgaccttaggtgatcagcccgcctcggcctcccagagtgctgggattacaggcgtgagccactgtggccaacctaatttttgtattatttagtagagacagggtttcaccacattggccaggctggtctcgaactcctgacctcaagtgatctgcctgccttggtctcccaaagtgctgggaatacaggcatgagccaccgcactcggccaggagctagttttaccagcaccctgctccactgccttcctctagtgcagcctggaagacatggcagcgggtagctcctggggctgagccagaagcatcactgcagtgaaagtctctgcttacctgtctggctcagcttgggcaagggctgggccatatgtgctcagggacgtgcttctcttgtaaggcaggaggacagaagaggaccaagaagggagggggctgccctgtggtgcacacaggcctgccatggggcgtgggagcccatcccgctgcctgactggagctggccgctgtggtggactcaggaaccacttttaatactgcaactgctcccttttgcccagtcagggaaagctgactgtaagtcccacctcccactccgtccacccttctagtggtttctctgagaggtttctctgcttcagctgtgcttgaagtggcatgcctcctctgctgcagggctcccccacccccacacggcctctaaagatgtttatttccttatagactgattaaagtcagccattctttttcctcaa

SEQ ID NO: 7364 - DNA, 1897 bp, Homo sapiens
attggctcgcacctggctcccgccagccgtgggattaggcttcgccggctacgattgcggcccccatcttctgacttttcctcgtgtgacccatcttttcaaattcccttacctgaggaaggagcccgattacaaggatatttacctgctcctaccctgatctagggacgaggatgggaagaccgcctgtggccatgagccctccccggtgctcctggggctaaggctggggctgcagccatggggctgggtcagccccaggcctggttgctgggtctgcccacagctgtggtctatggctccctggctctcttcaccaccatcctgcacaatgtcttcctgctctactatgtggacacctttgtctcagtgtacaagatcaacaaaatggccttctgggtcggagaggctggagtgcaatggcgcaatctcagctcactgcaacctccgccttcgtggttcaagtgattctcctgtctcaacctcatgagtagatgggattacaagcacccgccaccacgcccggctaatttttgtatttttagtagagacggggtttcgccatgttggccaggctggtctcaaactcctgacctcaggtgatccacctgcctcggcctcccaaagtgctggtgtgagccaccagcgcctggccagagtgggttttagcagaggaactgacaccagcaaaggtttgcagacagtgtttctcctctggaacagcctcaatgaccccctcttcggttggctcagtgaccggcagttcctcagctcccagccccgcctgtgtggagaggagctgcttgtaggcagtgaggaggcggacagcatcaccttgggccggtatctccggcagctggcacgccatcggaacttcctgtggttcgtgagcatggacctggtgcaggtcttccactgccacttcaacagcaacttcttccctctcttcctggagcatctgttgtccgaccatatctccctttccacgggctccatcctgttgggcctctcctatgtcgctccccatctcaacaacctctacttcctgtccctgtgccggcgctggggcgtctacgcggtggtgcgggggctcttcctgctcaagctgggacttagcctgctcatgttgttggccggcccggaccacctcagcctgctgtgcctcttcattgccagcaaccgcgtcttcactgagggcacctgtaagctgctgaccttggtggtcactgacctggtagacgaggacctggtgctgaaccaccgcaagcaggcagcctcggcactcctctttggcatggttgccttggtgaccaagccaggccagacctttgccccgctgctgggcacctggctgctctgtttctacacaggtcatgacctcttccagcagtccctcataacccctgtggggagtgcccatccctggccagagcccccagctccagcccctgcacaggccccgacgctccgccagggctgcttctacctgctggtgctggtgcccatcacctgtgctctgctgcagctcttcacctggtcccagttcacgctgcatgggagacgcctgcacatggtcaaggcccagcgccagaacctgtcacaggcccaaaccctggatgttaagatggtgtgagagctgtggcaaggtcaccccactgaggatgctgctggcagcctggggaaggagccagttttttttggttttttttttaaggatttcatagttttttttttttttttttggagctgttgcccaaaaaaatggatctgttgcagtggtgcaatctgggctcactgaaaccaccacccaggttcaagcaattatcctgcctcagcctcccgagtaggtgggattataggagcgtgccaccatgcccggctactttttgtattttta

SEQ ID NO: 7365 - DNA, 2039 bp, Homo sapiens
cgcgctttctgcgtgacactggctgtcagctctgggctgggctttctgggggccacacagctgctgaggcggcgggttgaggcggcccgaaaggacccagggtgctcaggcctggttgtggatagcggcctgtgtggagaggagctgcttgtaggcagtgaggaggcggacagcatcaccttgggccggtatctccggcagctggcacgccatcggaacttcctgtggttcgtgagcatggacctggtgcaggtcttccactgccacttcaacagcaacttcttccctctcttcctggagcatctgttgtccgaccatatctccctttccacgggctccatcctgttgggcctctcctatgtcgctccccatctcaacaacctctacttcctgtccctgtgccggcgctggggcgtctacgcggtggtgcgggggctcttcctgctcaagctgggacttagcctgctcatgttgttggccggcccggaccacctcagcctgctgtgcctcttcattgccagcaaccgcgtcttcactgagggcacctgtaagctgctgaccttggtggtcactgacctggtagacgaggacctggtgctgaaccaccgcaagcaggcagcctcggcactcctctttggcatggttgccttggtgaccaagccaggccagacctttgccccgctgctgggcacctggctgctctgtttctacacaggtcatgacctcttccagcagtccctcataacccctgtggggagtgcccatccctggccagagcccccagctccagcccctgcacaggccccgacgctccgccagggctgcttctacctgctggtgctggtgcccatcacctgtgctctgctgcagctcttcacctggtcccagttcacgctgcatgggagacgcctgcacatggtcaaggcccagcgccagaacctgtcacaggcccaaaccctggatgttaagatggtgtgagagctgtggcaaggtcaccccactgaggatgctgctggcagcctggggaaggagccagttttttttggttttttttttaaggatttcatagttttttttttttttttttggagctgttgcccaaaaaaatggatctgttgcagtggtgcaatctgggctcactgaaaccaccacccaggttcaagcaattatcctgcctcagcctcccgagtaggtgggattataggagcgtgccaccatgcccggctactttttgtatttttagtagagacagggtttcatcatgttggccaggctagtctcaaacccctgaccttaggtgatcagcccgcctcggcctcccagagtgctgggattacaggcgtgagccactgtggccaacctaatttttgtattatttagtagagacagggtttcaccacattggccaggctggtctcgaactcctgacctcaagtgatctgcctgccttggtctcccaaagtgctgggaatacaggcatgagccaccgcactcggccaggagctagttttaccagcaccctgctccactgccttcctctagtgcagcctggaagacatggcagcgggtagctcctggggctgagccagaagcatcactgcagtgaaagtctctgcttacctgtctggctcagcttgggcaagggctgggccatatgtgctcagggacgtgcttctcttgtaaggcaggaggacagaagaggaccaagaagggagggggctgccctgtggtgcacacaggcctgccatggggcgtgggagcccatcccgctgcctgactggagctggccgctgtggtggactcaggaaccacttttaatactgcaactgctcccttttgcccagtcagggaaagctgactgtaagtcccacctcccactccgtccacccttctagtggtttctctgagaggtttctctgcttcagctgtgcttgaagtggcatgcctcctctgctgcagggctcccccacccccacacggcctctaaagatgtttatttccttatagactgattaaagtcagccattctttttcctcaa

SEQ ID NO: 7366 - DNA, 823 bp, Homo sapiens
gccagccgtgggattaggcttcgccggctacgattgcggcccccatcttctgacttttcctcgtgtgacccatcttttcaaattcccttacctgaggaaggagcccgattacaaggatatttacctgctcctaccctgatctagggacgaggatgggaagaccgcctgtggccatgagccctccccggtgctcctggggctaaggctggggctgcagccatggggctgggtcagccccaggcctggttgctgggtctgcccacagctgtggtctatggctccctggctctcttcaccaccatcctgcacaatgtcttcctgctctactatgtggacacctttgtctcagtgtacaagatcaacaaaatggccttctgggtcggagagacagtgtttctcctctggaacagcctcaatgaccccctcttcggttggctcagtgaccggcagttcctcagctcccagccccgcctgtgtggagaggagctgcttgtaggcagtgaggaggcggacagcatcaccttgggccggtatctccggcagctggcacgccatcggaacttcctgtggttcgtgagcatggacctggtgcaggtgcagtggctcacgcctgtaatcccagcacttcgggacgccaaggtggaaagaccgcttgagcccaggagttcgaggctgcaatgagttatgattgcaccactgcactccagcctgggcggcagagaaaggctccatctctaaaaaaagaagagctaagtgctgtacctaaaacatgcagtatataaactggctgaacttagaaataaactgttttcatgttatgaaa

SEQ ID NO: 7367 - DNA, 1211 bp, Homo sapiens
cctggctcccgccagccgtgggattaggcttcgccggctacgattgcggcccccatcttctgacttttcctcgtgtgacccatcttttcaaattcccttacctgaggaaggagcccgattacaaggatatttacctgctcctaccctgatctagggacgaggatgggaagaccgcctgtggccatgagccctccccggtgctcctggggctaaggctggggctgcagccatggggctgggtcagccccaggcctggttgctgggtctgcccacagctgtggtctatggctccctggctctcttcaccaccatcctgcacaatgtcttcctgctctactatgtggacacctttgtctcagtgtacaagatcaacaaaatggccttctgggtcggagagacagtgtttctcctctggaacagcctcaatgaccccctcttcggttggctcagtgaccggcagttcctcagctcccagccccgcctgtgtggagaggagctgcttgtaggcagtgaggaggcggacagcatcaccttgggccggtatctccggcagctggcacgccatcggaacttcctgtggttcgtgagcatggacctggtgcaggtcttccactgccacttcaacagcaacttcttccctctcttcctggagcatctgttgtccgaccatatctccctttccacgggctccatcctgttgggcctctcctatgtcgctccccatctcaacaacctctacttcctgtccctgtgccggcgctggggcgtctacgcggtggtgcgggggctcttcctgctcaagctgggacttagcctgctcatgttgttggccggcccggaccacctcagcctgctgtgcctcttcattgccagcaaccgcgtcttcactgagggcacctgtaagctgctgaccttggtggtcactgacctggtagacgaggacctggtgctgaaccaccgcaagcaggcagcctcggcactcctctttggcatggttgccttggtgaccaagccaggccagacctttgccccgctgctgggcacctggctgctctgtttctacacaggctgggacttgggctatgctctggcccactccctccttaaccaagcaggtccaaggtcaagaatggcacaagatcagcccagagggggccttcccacctctacaacctagtcccctggtcagctacagtggcaaaaggcaactt

SEQ ID NO: 7368 - DNA, 3112 bp, Homo sapiens
agagagagggggcgggtgctacctggcagctccgcgggtgcgtggccggtgctggctgggagttctggtctcaggcaaggtggggactgggcacatcatcaatacgatagagaacgtcacttttcaccatgaagggttcttctggaggtgttggtttaatgggattgtggaagagaatgactccaatatttggaagttctggtacaccaatcagccaccgtccaagaactgcacacatgcttacctgtctccgtaccccttcatgagaggcgagcacaactcgacctcctatgactctgcagttatttaccgtggtttctgggcagtcctgatgctcctgggggtagttgctgtagtcatcgcaagctttttgatcatctgtgcagcccccttcgccagccattttctctacaaagctgggggaggctcatatattgctgcaggcatcctattttcattggtggtgatgctgtatgtcatctgggtccaggcagtggctgacatggaaagctaccgaaacatgaaaatgaaggactgcctggatttcaccccttctgttctgtatggctggtcatttttcctggccccagctgggatatttttttctttgctagctggattactatttctggttgttggatggcatattcagatacatcactaaatcaactgttgccacaagtattttcttgagagattttaaaacaaggaatactttttttccattttgtttcattgatcccagcataaagttagtagatataactttttagttgctattcaaattaatcattttactaaaattttcttcagtaagaaggtcctagaatctctccagacaccagcaagcctctatcttgtctaagtgctgtcaaggacctagttctttagggaataggtaaacaggtctccctttcattgaacatgttagagttcatgcaggtcgcaaaggcctgataatagcttaataccatgacatggggaaaatctcgatagatttggcttaaagtctccttggcattcacttctgctaattaaaaaaaatccttgaagaataattaagaatgggcaaggttgtcagagaatttattttgtttcttgcccacacagataatatccacatacacattcactggctcttgtgagcaaatgaatttaaaaatagacagcagttgttctaattagtgggagccatgtactcaccagttaaaatgggccacaacaaacaagactgagagcatgtacttatcttgctttttcaccaacagtggtttggttacctagttttattcacttaattgtgcatgcttacataaactttaaactacatttaaaactagcaaatctgcataccaaattatgtataacgtagattgaatttttatgaacttaaagtgagttaattgtataatgtaatattgtttaaaatatgtaaaaaccaagcatttccgcttggtccataattctatttgatattttaaaattctcatttaaaaattatattgctatcattcagcatgtgaaaatttattgataaaatgtgattttaatattttttagatataaactttcaacgtacttccatatgaggattataatagccctgctttattaaagaccataaaatattaactttccccaagatgttatgggttccagttcttctgatcatttgattcctttaattactgtccctcaatttcttcatctttacaatagatatattaacatttacagatcgactatttcctttaacctcctagaagaaagtttttgtggggaaagatgattctgtattattcagtagcatagacattttgcatatcaaagatgttcatttggcactaatgttgattgaaatcaaatccatctgagatgcctagctcgtatttgcattctggaagcctccatcgcaggggagctcggcagggtatgtgagctttgttggaggtgcggtgtttcattctgcagctgttgtgaggacagagaggcatggcccacaggcaaaaaaagtcaccacccagaagatgctctgggatagaggaactgctccttttcatcagctcttccaatgccgtgggagaggtgatcccagtcttctctgtacatcttgtgcttttccattaagacttgttccagtgggaaggagctttggaaaaattgcaaaggtctgaatcttcagggcattttcatgacaggacttgccaataataataataataataataataataataataataaagctccagaggcctaactggtttctcaagtcatttcagtgatatcattgaaacgtttttgtggtacttccctttgtctttcactgtttcatttttatattgcttcatttacttctttgcttttggctttgttattagaaaaaataattatgaggtctgttgtgcatgttgactgtgatattaagttatggcatgccattaagttttccagacgatgttggatgtatctgattagttcatgtcatctgtaaatacaattcttttttgtagtactttggaatggagcctttttctggtgtactgtatgccatttaagtttcacatacaagctgctttcggcaaaggcttgaatatttataaatttcagatggttatcctcactttatagtacacttaagtggctaccatatattttttatatgacaattggctgaatagctgatgtgtatgacacttttacacagatttgcactttggaactattttatagttgtaatgcatcaatcaaatacatttcaagcacatttcttgatcaatttaccagcaaccctctgaaggaatgaaggagagttgtgattgctatgtcaatgagtgaaatatacttaaaaatggcagagttatatagtacattattgtagcaaccttatatctgatttgagatactgtgttgccaaatgtccatgttatgtttatttctctattggttgtatttattaatttttagaagcctttaaactgtgttagaatctttttgaaaaatgttgattttgcatcataaagtttcaatttatcaaggatatcttttcagttacacttttagaaagagtgaataaaaagggcagtgagttatgctcttggacttggtgaaa

SEQ ID NO: 7369 - DNA, 3593 bp, Homo sapiens
ggcgagcaaagggaatatgaatctgccggtggggcgtgagcgagaagccaccaaaacatgagctaggacagccttctcaagaagattctgccaactcaaaaatattattcttttttttttttttttgctgttgtttctgagaaactaggtgtcttaccattttaaaatttcatattttatttaaaaggaaaccagtgaattgaaaatgagactaaatatcgctatcttctttggagctctctttggtgctttgggggtgttactctttttggtggcttttggatcggattattggcttcttgcaactgaagtggggagatgttcaggtgaaaagaatatagagaacgtcacttttcaccatgaagggttcttctggaggtgttggtttaatgggattgtggaagagaatgactccaatatttggaagttctggtacaccaatcagccaccgtccaagaactgcacacatgcttacctgtctccgtaccccttcatgagaggcgagcacaactcgacctcctatgactctgcagttatttaccgtggtttctgggcagtcctgatgctcctgggggtagttgctgtagtcatcgcaagctttttgatcatctgtgcagcccccttcgccagccattttctctacaaagctgggggaggctcatatattgctgcaggcatcctattttcattggtggtgatgctgtatgtcatctgggtccaggcagtggctgacatggaaagctaccgaaacatgaaaatgaaggactgcctggatttcaccccttctgttctgtatggctggtcatttttcctggccccagctgggatatttttttctttgctagctggattactatttctggttgttggatggcatattcagatacatcactaaatcaactgttgccacaagtattttcttgagagattttaaaacaaggaatactttttttccattttgtttcattgatcccagcataaagttagtagatataactttttagttgctattcaaattaatcattttactaaaattttcttcagtaagaaggtcctagaatctctccagacaccagcaagcctctatcttgtctaagtgctgtcaaggacctagttctttagggaataggtaaacaggtctccctttcattgaacatgttagagttcatgcaggtcgcaaaggcctgataatagcttaataccatgacatggggaaaatctcgatagatttggcttaaagtctccttggcattcacttctgctaattaaaaaaaatccttgaagaataattaagaatgggcaaggttgtcagagaatttattttgtttcttgcccacacagataatatccacatacacattcactggctcttgtgagcaaatgaatttaaaaatagacagcagttgttctaattagtgggagccatgtactcaccagttaaaatgggccacaacaaacaagactgagagcatgtacttatcttgctttttcaccaacagtggtttggttacctagttttattcacttaattgtgcatgcttacataaactttaaactacatttaaaactagcaaatctgcataccaaattatgtataacgtagattgaatttttatgaacttaaagtgagttaattgtataatgtaatattgtttaaaatatgtaaaaaccaagcatttccgcttggtccataattctatttgatattttaaaattctcatttaaaaattatattgctatcattcagcatgtgaaaatttattgataaaatgtgattttaatattttttagatataaactttcaacgtacttccatatgaggattataatagccctgctttattaaagaccataaaatattaactttccccaagatgttatgggttccagttcttctgatcatttgattcctttaattactgtccctcaatttcttcatctttacaatagatatattaacatttacagatcgactatttcctttaacctcctagaagaaagtttttgtggggaaagatgattctgtattattcagtagcatagacattttgcatatcaaagatgttcatttggcactaatgttgattgaaatcaaatccatctgagatgcctagctcgtatttgcattctggaagcctccatcgcaggggagctcggcagggtatgtgagctttgttggaggtgcggtgtttcattctgcagctgttgtgaggacagagaggcatggcccacaggcaaaaaaagtcaccacccagaagatgctctgggatagaggaactgctccttttcatcagctcttccaatgccgtgggagaggtgatcccagtcttctctgtacatcttgtgcttttccattaagacttgttccagtgggaaggagctttggaaaaattgcaaaggtctgaatcttcagggcattttcatgacaggacttgccaataataataataataataataataataataataataaagctccagaggcctaactggtttctcaagtcatttcagtgatatcattgaaacgtttttgtggtacttccctttgtctttcactgtttcatttttatattgcttcatttacttctttgcttttggctttgttattagaaaaaataattatgaggtctgttgtgcatgttgactgtgatattaagttatggcatgccattaagttttccagacgatgttggatgtatctgattagttcatgtcatctgtaaatacaattcttttttgtagtactttggaatggagcctttttctggtgtactgtatgccatttaagtttcacatacaagctgctttcggcaaaggcttgaatatttataaatttcagatggttatcctcactttatagtacacttaagtggctaccatatattttttatatgacaattggctgaatagctgatgtgtatgacacttttacacagatttgcactttggaactattttatagttgtaatgcatcaatcaaatacatttcaagcacatttcttgatcaatttaccagcaaccctctgaaggaatgaaggagagttgtgattgctatgtcaatgagtgaaatatacttaaaaatggcagagttatatagtacattattgtagcaaccttatatctgatttgagatactgtgttgccaaatgtccatgttatgtttatttctctattggttgtatttattaatttttagaagcctttaaactgtgttagaatctttttgaaaaatgttgattttgcatcataaagtttcaatttatcaaggatatcttttcagttacacttttagaaagagtgaataaaaagggcagtgagttatgctcttggacttggtgaaagctatcatctctccatattgtatttgttcagctggtttaattcactcaggtggatgattgcacatacattggaattggctggagagactacacagagaagtttaatgatcgtgtacaatttgagggttgatggtagggctttctaaaaaaagtaatatcaagtgtgttgttagtattcatttagtcatttttattactaatctataaatatatttattaaatttgaagattaaatggaattataaaggaa

SEQ ID NO: 7370 - DNA, 3019 bp, Homo sapiens
agcggcctccggtgtgggatggccgcggagccgggcggagctggcttgcggctcccggggccggctctccggccggagacatggcccgggggcccggcccgctaggcaggcctcgccccgatacggtcgccatgcccaagagaggaaagcgactcaagttccgggcccacgacgcctgctccggccgagtgaccgtggcggattacgccaactcggatccggcggtcgtgaggtctggacgagtcaagaaagccgtagccaacgctgttcagcaggaagtaaaatctctttgtggcttggaagcctctcaggttcctgcagaggaagctctttctggggctggtgagccctgtgacatcatcgacagcagtgatgagatggatgcccaggaggaaagcatccatgagagaactgtctccagaaaaaagaaaagcaagagacacaaagaagaactggacggggctggaggagaagagtatcccatggatatttggctattgctggcctcctatatccgtcctgaggacattgtgaatttttccctgatttgtaagaatgcctggactgtcacttgcactgctgccttttggaccaggttgtaccgaaggcactacacgctggatgcttccctgcctttgcgtctgcgaccagagtcaatggagaagctgcgctgtctccgggcttgtgtgatccgatctctgtaccatatgtatgagccatttgctgctcgaatctccaagaatccagccattccagaaagcacccccagcacattaaagaattccaaatgcttacttttctggtgcagaaagattgttgggaacagacaggaaccaatgtgggaattcaacttcaagttcaaaaaacagtcccctaggttaaagagcaagtgtacaggaggattgcagcctcccgttcagtacgaagatgttcataccaatccagaccaggactgctgcctactgcaggtcaccaccctcaatttcatctttattccgattgtcatgggaatgatatttactctgtttactatcaatgtgagcacggacatgcggcatcatcgagtgagactggtgttccaagattcccctgtccatggtggtcggaaactgcgcagtgaacagggtgtgcaagtcatcctggacccagtgcacagcgttcggctctttgactggtggcatcctcagtacccattctccctgagagcgtagttactgcttcccatcccttgggggcagcctcgagtgtagtccattagtaatcagattccagtttggacagggtggctggattgtatatctcgttagtaatgtacatgctcttcaggttctagggctcctgttaggggagggagaaatgttgaatcaagagggaaaacaactactatgatttataaacatattttaatgtaaaaatttgcatttaaaaggagtggccctgttttctgtgttaaaaccccatttggtgctattgagtttgttctttattcttttatcccagtgaaaattgttgatcttgctgtagggaaaaattaaactctttgaatctccaaacaaggaagtttcagcattcccttatggatcagaggaaccttagaggcctgaaattgttgcttccagtttagctgcccctcaaattcaagtgaatattttcccttctccctttacccttctccagaaataaagcaggtgacagggttttcagaatcttaccatattgacttgtgtatcttttttaaaaaataatttgtgatatttattgcatacattttcttttggcagttttggattttaggtatttttttgcatgaggctgataatggtgatgatgactttatacccttggtactatactaggaactttacatagtatctctacttctcacagtcttgcaaagtaggtgatattattcccattttatagttgagaaaacggaattagtgactgtacctataacaccagtaaatgcagagccaagattctgacccaggtctttttgttgtaccataagtttaaaagatgagtctcatttttcttgtggtagatggtggtaaaaaggagtaggcagagtgtacatagataaaaaaaagtaaaagggtaagtaaaaaattgattgtggtatatgttattctaatcagccaaaaaagtttagaagattgatgaaatgatcttttaaatatgtatttctgaataaaatgtaaaaccaagaaagttatttcaggaaggatagtgaccctttccttgaactgttagaagggcatttattaggctaaaacgtcattaacaaaatgcattgcatgttgaaaccagcctcttgaaccataagcacttagcgactttgctctgccctgtactgtgctgcttctgctgtcatcctgtgtgcctacagaagcctggtcttccgtccatgcagaaatgcttatgtcctcctgttgtttagatgactcctattgttcaggtgtactctgagaagagaatcacgtttttctgttttgctaaggagaaaaccttgctgcttgtctctcctcccaccctccaccatccaaaattaaccagtgagctggatattacctggatattgccaggaggtgggcattaagacagtattctttaaaagtgaaaatcttgtgaggcaaactgctaaattcacatttttgtttttttttttttaccatcttccctaggaatattcctagaaagcatctgcttaattttgctgctaacagctaaccttatcccacgttgagggtggtattaaaactgttcacacagagtgagcctgggtcagtcaaaaacagaatttgggcatttgagtgataacagacaacctaaggacaatgagcactttgcagatctctacaattaaaagttgcctctttgaggcaggaggggagaagcacagtccctgccaggttgcctgaactaaagatgccatggagcaggagtgtcttggtgcattgttccccgcttaggagtacctttaaaaagggggtgaaataaatttggcttaataattgta

SEQ ID NO: 7371 - DNA, 2351 bp, Homo sapiens
ataggcaggtgagggcgccaggcggccagcaggttcctgggagccagctgccacccagcaaacaaccgggaggatagggtgtcagccgtgggaggggacaggaggggacgggcctgcagcctggggcccaggtgggccactggggacgtgaggcactggccgccccgccccagcctggcacagcccttcagatcctggccttgccgcacccacagtggggcctccagttggggccacgtggccatgagaatgaccagctaggcttccctggaggccaggcctccctggactgggccaggtgcttcctgccagcaaagatgagtaatgtctcagggatcctggagacagccggcgtccccctggtgtcagcgaactggccgcagcccagccccccaccggctgtgccagctgggccgcagatggaccacatggggaacagctcccagggggccccctggctcttcctcacctccgcactggcccgaggcgtctcggggatcttcgtgtggactgccctggtgctcacctgccaccagatctatctgcacctgcgctcctacaccgtgccacaggagcaacgttacatcatccgcctgctcctcatcgtgcccatctacgccttcgactcctggctcagcctcctcctcctcggagaccaccagtactacgtctacttcgactctgtgcgggactgctacgaagcctttgtcatttacagcttcctgagcctgtgtttccagtacctgggaggcgagggcgccatcatggctgagattcgtggaaagcccatcaagtccagctgcttgtacggcacctgctgcctccggggcatgacctactccatcgggttcctgcgcttctgtaagcaggccactctgcagttctgcctggtgaagcccgtcatggccgtcaccaccatcatcctccaggcatttggcaaataccacgacggggacttcaatgtccgcagcggctacctctatgtgaccctcatctacaacgcctccgtcagcctcgccctctacgccctgttcctcttctacttcaccaccagggagctcctgcggcccttccagcccgtcctcaagttcctcaccatcaaagccgtcatcttcctgtcgttctggcaagggctgctgctggccatcctggagcggtgcggggtcatcccggaggtggagaccagcggcgggaacaagctgggggctggcacgctggccgccggctaccagaacttcatcatctgcgtggagatgctgttcgcctccgtggccctgcgttatgccttcccctgccaggtgtacgcagagaagaaggagaattcaccagcccccccggcacccatgcagagcatctccagcggcatcagggagacagtgagcccccaggacatcgtgcaggacgccatccacaacttctcccccgcctaccagcactacacgcagcaggccacgcacgaggcgcccaggcccggcacccaccccagcggcggctccggcgggagcaggaagagccggagcctggagaagcggatgctgatcccctcggaggacctgtaggggggcctgggctgccagtgctgtagggacccaggctgcccaggcctctggggaagaacagggtccccccacccaccaactcctgccaaaggtggggcctctcctgagagcccacctgtgaggccctcggagcccacttcccatcctccctccagccagggggtcagggcacctgatggccctggcaggcacccaggtgggcccgccaccgcaggagagggcacctgagccaatcggaagagcctggggaccccctgggatcacccagccatcagccccaggagccactgtggggcggagagtgagtgtggctgcggggccttggctgcacggaccccatgggagctgtgagtgggtcagactccctggttcaggagacagacagcggacggatcccaggctgggcagctggagggaggggcgccggggcgctgggcagccgggctctgacacagtcagcagctccgggcgccgcaggccggcggggtccacacaggctggccggggctgggcctccttggagcctgctacggccctcgtgggcacgtggagaagggcccacgtgtctccacacgccagccacaggggagccctggccaggcgcccagccaggggagcgtgtgcctgggatgggtcacagaaccagcgggcacctgtgaggctggccagcaccgtggggctgtgggaatcgctcttatttatatttaaacaccttggattttctaccgggtcttggcttctgttcccgcagggcatgagcctgaggagcaggacgcggtgggggtcacagga

SEQ ID NO: 7372 - DNA, 574 bp, Homo sapiens
acctttgccctcactcctcccggtgtgtgtcctccctccctctgcagatgagtaatgtctcagggatcctggagacagccggcgtccccctggtgtcagcgaactggccgcagcccagccccccaccggctgtgccagctgggccgcagatggaccacatggggaacagctcccagggggccccctggctcttcctcacctccgcactggcccgaggcgtctcggggatcttcgtgtggactgccctggtgctcacctgccaccagatctatctgcacctgcgctcctacaccgtgccacaggagcaacgttacatcatccgcctgctcctcatcgtgcccatctacgccttcgactcctggctcagcctcctcctcctcggagaccaccagtactacgtctacttcgactctgtgcgggactgctacgaagcctttgtcatttacagcttcctgagcctgtgtttccagtacctgggaggcgagggcgccatcatggctgagattcgtggaaagcccatcaagtccagctgcttgtacggcacctgctgcctccggggcatgacctactccat

SEQ ID NO: 7373 - DNA, 579 bp, Homo sapiens
aatcatctctcagggacccaggctgcccgccgctgtgaggaggcggcagcagaggccaggaggccgggggccgagcttcaggcccaccccgccttggcccccccctcaggcccagagacctgcagccaacctgcctgacaggctgagcgccaccagggagatgagtaatgtctcagggatcctggagacagccggcgtccccctggtgtcagcgaactggccgcagcccagccccccaccggctgtgccagctgggccgcagatggaccacatggggaacagctcccagggggccccctggctcttcctcacctccgcactggcccgaggcgtctcggggatcttcgtgtggactgccctggtgctcacctgccaccagatctatctgcacctgcgctcctacaccgtgccacaggagcaacgttacatcatccgcctgctcctcatcgtgcccatctacgccttcgactcctggctcagcctcctcctcctcggagaccaccagtactacgtctacttcgactctgtgcgggactgctacgaagcctttgtcatttacagcttcctgagcctgtgttt

SEQ ID NO: 7374 - DNA, 640 bp, Homo sapiens
agcaaaggtagagctgggccctgtgaccgcagaccagagggagaggaggaggctggactgggctgcgagtgtgggagagggtggactcagggccccagcaggttagtgggagatggaacaggcacccagggctgccaagaaccccagcaaagccgggctcccagatgagtaatgtctcagggatcctggagacagccggcgtccccctggtgtcagcgaactggccgcagcccagccccccaccggctgtgccagctgggccgcagatggaccacatggggaacagctcccagggggccccctggctcttcctcacctccgcactggcccgaggcgtctcggggatcttcgtgtggactgccctggtgctcacctgccaccagatctatctgcacctgcgctcctacaccgtgccacaggagcaacgttacatcatccgcctgctcctcatcgtgcccatctacgccttcgactcctggctcagcctcctcctcctcggagaccaccagtactacgtctacttcgactctgtgcgggactgctacgaagcctttgtcatttacagcttcctgagcctgtgtttccagtacctgggaggcgagggcgccatcatggctgagattcgtggaaagcccatcaa

SEQ ID NO: 7375 - DNA, 3593 bp, Homo sapiens
gggtgtgcccgctccctttccacgccaacgtggcgggggcagctcctggagtgtaatcggacctgtccggggggcggccccgggagagggaggcggatggaccaaggcgctttgcaagagggattgtgtgctcccgggtgggtgtgctggcgactggcacggccgagctagcttgtcactttctgcaaaggtttccctcagggagcctcctgctgccaggcaccatgacagtgaggggggatgtgctggccccggatccagcgtcgcccacgaccgcagcagcctcgcccagcgtctccgtgatccccgagggcagccccactgccatggagcagcctgtgttcctgatgacaactgccgctcaggccatctctggcttcttcgtgtggacggccctgctcatcacatgccaccagatctacatgcacctgcgctgctacagctgccccaacgagcagcgctacatcgtgcgcatcctcttcatcgtgcccatctacgcctttgactcctggctcagcctcctcttcttcaccaacgaccagtactacgtgtacttcggcaccgtccgcgactgctatgaggccttggtcatctataatttcctgagcctgtgctatgagtacctaggaggagaaagttccatcatgtcggagatcagaggaaaacccattgagtccagctgtatgtatggcacctgctgcctctggggaaagacttattccatcggatttctgaggttctgcaaacaggccaccctgcagttctgtgtggtgaagccactcatggcggtcagcactgtggtcctccaggccttcggcaagtaccgggatggggactttgacgtcaccagtggctacctctacgtgaccatcatctacaacatctccgtcagcctggccctctacgccctcttcctcttctacttcgccacccgggagctgctcagcccctacagccccgtcctcaagttcttcatggtcaagtccgtcatctttctttccttctggcaaggcatgctcctggccatcctggagaagtgtggggccatccccaaaatccactcggcccgcgtgtcggtgggcgagggcaccgtggctgccggctaccaggacttcatcatctgtgtggagatgttctttgcagccctggccctgcggcacgccttcacctacaaggtctatgctgacaagaggctggacgcacaaggccgctgtgcccccatgaagagcatctccagcagcctcaaggagaccatgaacccgcacgacatcgtgcaggacgccatccacaacttctcacctgcctaccagcagtacacgcagcagtccaccctggagcctgggcccacctggcgtggtggcgcccacggcctctcccgctcccacagcctcagtggcgcccgcgacaacgagaagactctcctgctcagctctgatgatgaattctaggtgcgggctgcagtggcggaagtgctggcgccatagccacggtcaggctgtgccccacctccagcctcaccaccaggccaggaggcagctggcacagtgctcacgccgcctttatttattggaccagaaacactcacatgtcacttccagaggaacgggggacagccaggctcgcccatgggccttcaggaatatttatacatggcccagcctgcactgcccgggcgagggcagaggacactgggagcaaggcttatgcccctgctgcccgtcctgtgctgggggcatgctgggaccagccgcacccaggccccaatgcttgtgtgtggaccagcggctgcagccttctagcccctcctccccgcgagactctcaggctgaggtcggcaagccgtggctcccccacacaccgtgcaataccctgtctgacctgggctcttcccgcctgcatccctcccctgtccacctttgtccagtgctagattcacctcaccccgggcaggagtggggatgtgggcgctctgtggtcctcccctcctgacccaggcctctgtggcatgctgcaaggatcagagccagacaccaggagtcacaggccccacccaggaagggcattcagggcccctgggcaccgcttctgttgaagcaggggcttctgggcccctgggtatccccacctgtcgtggccacacctctgcctgcctcatgccccttccccctggcctaccaaggacagcccacagcccgcactgccggctcacttgggtccttcctcgatagctttgggcagagcccttgcttcctggctgcttcagggctcaggggctcccagccctccttcccaggctgatgctgggtcctctctctctttggggcttctccctcccgtttcaggggaaaggtctgagtctccacgtttcagaccagcttctgggggaaggcagtccggcagggagaccgggaggggtggccacacagtggggagctgggaggtggggggaatggtcccagactcctctcggggcccctatccacacagggcctggtgttctaccccatctggcccctggcccatctcttctgtgccttagtcacatatgaaagcgcccctccctggctccccatctgtcccacacgctccctggggctcttagttcagctgctggcactcgcaggatcctgcagtgctgggcccagagcccttggacaggcctcaggagtggtcaggaccaccaagcccctcctctccccctccacacctctagacctggggcctccggaacccccagcaggctgggcttatactagctcctgacttaggaagagcctcgtgtcacaacacgtgtccctacaggcaaagtgtcctggcatttaaaacccagattatccctgggtttgggctgcagtcacctggagaagctggtagggtaagggagagggaccctgccggtgttcactggggattctttcttttggtccttcctggaatgaacaggttccctccctgccacctgtgaggagagttggggcccagccgtcttcctggcctccttcctttcctcgtggcagaggcctgcatgtgggtgccagaggccagctctccccctccatcttgggggggcggagcagttgggcccaagctgcccgggagggtgggtgcagacacaggctgaggaccagccctggccctgccccgccatctgctttcaccaagctgtctctccaccgtggcttcccttctccctccaggccaaagtgctgctgattcccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtcttttttttttttaattttctttccaggtagagtagctctttgtacataaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatcta

SEQ ID NO: 7376 - DNA, 3611 bp, Homo sapiens
agagcgcatgcgcgccgcggctgcactccactgggcccgggacgcgccggcggcggcggagactccggggctgcggcgccgcccgccccgcccgcagagtccggctgccgcgcatcgtccgcagacgccgccaccgccatgggctcctgaggctagcttgtcactttctgcaaaggtttccctcagggagcctcctgctgccaggcaccatgacagtgaggggggatgtgctggccccggatccagcgtcgcccacgaccgcagcagcctcgcccagcgtctccgtgatccccgagggcagccccactgccatggagcagcctgtgttcctgatgacaactgccgctcaggccatctctggcttcttcgtgtggacggccctgctcatcacatgccaccagatctacatgcacctgcgctgctacagctgccccaacgagcagcgctacatcgtgcgcatcctcttcatcgtgcccatctacgcctttgactcctggctcagcctcctcttcttcaccaacgaccagtactacgtgtacttcggcaccgtccgcgactgctatgaggccttggtcatctataatttcctgagcctgtgctatgagtacctaggaggagaaagttccatcatgtcggagatcagaggaaaacccattgagtccagctgtatgtatggcacctgctgcctctggggaaagacttattccatcggatttctgaggttctgcaaacaggccaccctgcagttctgtgtggtgaagccactcatggcggtcagcactgtggtcctccaggccttcggcaagtaccgggatggggactttgacgtcaccagtggctacctctacgtgaccatcatctacaacatctccgtcagcctggccctctacgccctcttcctcttctacttcgccacccgggagctgctcagcccctacagccccgtcctcaagttcttcatggtcaagtccgtcatctttctttccttctggcaaggcatgctcctggccatcctggagaagtgtggggccatccccaaaatccactcggcccgcgtgtcggtgggcgagggcaccgtggctgccggctaccaggacttcatcatctgtgtggagatgttctttgcagccctggccctgcggcacgccttcacctacaaggtctatgctgacaagaggctggacgcacaaggccgctgtgcccccatgaagagcatctccagcagcctcaaggagaccatgaacccgcacgacatcgtgcaggacgccatccacaacttctcacctgcctaccagcagtacacgcagcagtccaccctggagcctgggcccacctggcgtggtggcgcccacggcctctcccgctcccacagcctcagtggcgcccgcgacaacgagaagactctcctgctcagctctgatgatgaattctaggtgcgggctgcagtggcggaagtgctggcgccatagccacggtcaggctgtgccccacctccagcctcaccaccaggccaggaggcagctggcacagtgctcacgccgcctttatttattggaccagaaacactcacatgtcacttccagaggaacgggggacagccaggctcgcccatgggccttcaggaatatttatacatggcccagcctgcactgcccgggcgagggcagaggacactgggagcaaggcttatgcccctgctgcccgtcctgtgctgggggcatgctgggaccagccgcacccaggccccaatgcttgtgtgtggaccagcggctgcagccttctagcccctcctccccgcgagactctcaggctgaggtcggcaagccgtggctcccccacacaccgtgcaataccctgtctgacctgggctcttcccgcctgcatccctcccctgtccacctttgtccagtgctagattcacctcaccccgggcaggagtggggatgtgggcgctctgtggtcctcccctcctgacccaggcctctgtggcatgctgcaaggatcagagccagacaccaggagtcacaggccccacccaggaagggcattcagggcccctgggcaccgcttctgttgaagcaggggcttctgggcccctgggtatccccacctgtcgtggccacacctctgcctgcctcatgccccttccccctggcctaccaaggacagcccacagcccgcactgccggctcacttgggtccttcctcgatagctttgggcagagcccttgcttcctggctgcttcagggctcaggggctcccagccctccttcccaggctgatgctgggtcctctctctctttggggcttctccctcccgtttcaggggaaaggtctgagtctccacgtttcagaccagcttctgggggaaggcagtccggcagggagaccgggaggggtggccacacagtggggagctgggaggtggggggaatggtcccagactcctctcggggcccctatccacacagggcctggtgttctaccccatctggcccctggcccatctcttctgtgccttagtcacatatgaaagcgcccctccctggctccccatctgtcccacacgctccctggggctcttagttcagctgctggcactcgcaggatcctgcagtgctgggcccagagcccttggacaggcctcaggagtggtcaggaccaccaagcccctcctctccccctccacacctctagacctggggcctccggaacccccagcaggctgggcttatactagctcctgacttaggaagagcctcgtgtcacaacacgtgtccctacaggcaaagtgtcctggcatttaaaacccagattatccctgggtttgggctgcagtcacctggagaagctggtagggtaagggagagggaccctgccggtgttcactggggattctttcttttggtccttcctggaatgaacaggttccctccctgccacctgtgaggagagttggggcccagccgtcttcctggcctccttcctttcctcgtggcagaggcctgcatgtgggtgccagaggccagctctccccctccatcttgggggggcggagcagttgggcccaagctgcccgggagggtgggtgcagacacaggctgaggaccagccctggccctgccccgccatctgctttcaccaagctgtctctccaccgtggcttcccttctccctccaggccaaagtgctgctgattcccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtcttttttttttttaattttctttccaggtagagtagctctttgtacataaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatctatatatgagataatatagattgtattgaaatctc

SEQ ID NO: 7377 - DNA, 570 bp, Homo sapiens
attctcctaacttcctggtgaggtagctgcctaactaaacagagcagcagtggtgctgcctctgtttaccagatgggaggaggaggcacaacctgaggacatccctgcagccactcggccaggaagtgtgtccacccgccatagcatctacatgcacctgcgctgctacagctgccccaacgagcagcgctacatcgtgcgcatcctcttcatcgtgcccatctacgcctttgactcctggctcagcctcctcttcttcaccaacgaccagtactacgtgtacttcggcaccgtccgcgactgctatgaggccttggtcatctataatttcctgagcctgtgctatgagtacctaggaggagaaagttccatcatgtcggagatcagaggaaaacccattgagtccagctgtatgtatggcacctgctgcctctggggaaagacttattccatcggatttctgaggttctgcaaacaggccaccctgcagttctgtgtggtgaagccactcatggcggtcagcactgtggtcctccaggccttcggcaagtaccgggatggggactttga

SEQ ID NO: 7378 - DNA, 3667 bp, Homo sapiens
actccactgggcccgggacgcgccggcggcggcggagactccggggctgcggcgccgcccgccccgcccgcagagtccggctgccgcgcatcgtccgcagacgccgccaccgccatgggctcctgaggctagcttgtcactttctgcaaaggtttccctcagggagcctcctgctgccaggcaccatgacagtgaggggggatgtgctggccccggatccagcgtcgcccacgaccgcagcagcctcgcccagcgtctccgtgatccccgagggcagccccactgccatggagcagcctgtgttcctgatgacaactgccgctcaggccatctctggcttcttcgtgtggacggccctgctcatcacatgccaccagcccagggctcggctgggccaagtgtgatgtcatgagagctgggacgagacacccaggggctgcctggactgaggactgtggtagagcagctcttggcatttatctacatgcacctgcgctgctacagctgccccaacgagcagcgctacatcgtgcgcatcctcttcatcgtgcccatctacgcctttgactcctggctcagcctcctcttcttcaccaacgaccagtactacgtgtacttcggcaccgtccgcgactgctatgaggccttggtcatctataatttcctgagcctgtgctatgagtacctaggaggagaaagttccatcatgtcggagatcagaggaaaacccattgagtccagctgtatgtatggcacctgctgcctctggggaaagacttattccatcggatttctgaggttctgcaaacaggccaccctgcagttctgtgtggtgaagccactcatggcggtcagcactgtggtcctccaggccttcggcaagtaccgggatggggactttgacgtcaccagtggctacctctacgtgaccatcatctacaacatctccgtcagcctggccctctacgccctcttcctcttctacttcgccacccgggagctgctcagcccctacagccccgtcctcaagttcttcatggtcaagtccgtcatctttctttccttctggcaaggcatgctcctggccatcctggagaagtgtggggccatccccaaaatccactcggcccgcgtgtcggtgggcgagggcaccgtggctgccggctaccaggacttcatcatctgtgtggagatgttctttgcagccctggccctgcggcacgccttcacctacaaggtctatgctgacaagaggctggacgcacaaggccgctgtgcccccatgaagagcatctccagcagcctcaaggagaccatgaacccgcacgacatcgtgcaggacgccatccacaacttctcacctgcctaccagcagtacacgcagcagtccaccctggagcctgggcccacctggcgtggtggcgcccacggcctctcccgctcccacagcctcagtggcgcccgcgacaacgagaagactctcctgctcagctctgatgatgaattctaggtgcgggctgcagtggcggaagtgctggcgccatagccacggtcaggctgtgccccacctccagcctcaccaccaggccaggaggcagctggcacagtgctcacgccgcctttatttattggaccagaaacactcacatgtcacttccagaggaacgggggacagccaggctcgcccatgggccttcaggaatatttatacatggcccagcctgcactgcccgggcgagggcagaggacactgggagcaaggcttatgcccctgctgcccgtcctgtgctgggggcatgctgggaccagccgcacccaggccccaatgcttgtgtgtggaccagcggctgcagccttctagcccctcctccccgcgagactctcaggctgaggtcggcaagccgtggctcccccacacaccgtgcaataccctgtctgacctgggctcttcccgcctgcatccctcccctgtccacctttgtccagtgctagattcacctcaccccgggcaggagtggggatgtgggcgctctgtggtcctcccctcctgacccaggcctctgtggcatgctgcaaggatcagagccagacaccaggagtcacaggccccacccaggaagggcattcagggcccctgggcaccgcttctgttgaagcaggggcttctgggcccctgggtatccccacctgtcgtggccacacctctgcctgcctcatgccccttccccctggcctaccaaggacagcccacagcccgcactgccggctcacttgggtccttcctcgatagctttgggcagagcccttgcttcctggctgcttcagggctcaggggctcccagccctccttcccaggctgatgctgggtcctctctctctttggggcttctccctcccgtttcaggggaaaggtctgagtctccacgtttcagaccagcttctgggggaaggcagtccggcagggagaccgggaggggtggccacacagtggggagctgggaggtggggggaatggtcccagactcctctcggggcccctatccacacagggcctggtgttctaccccatctggcccctggcccatctcttctgtgccttagtcacatatgaaagcgcccctccctggctccccatctgtcccacacgctccctggggctcttagttcagctgctggcactcgcaggatcctgcagtgctgggcccagagcccttggacaggcctcaggagtggtcaggaccaccaagcccctcctctccccctccacacctctagacctggggcctccggaacccccagcaggctgggcttatactagctcctgacttaggaagagcctcgtgtcacaacacgtgtccctacaggcaaagtgtcctggcatttaaaacccagattatccctgggtttgggctgcagtcacctggagaagctggtagggtaagggagagggaccctgccggtgttcactggggattctttcttttggtccttcctggaatgaacaggttccctccctgccacctgtgaggagagttggggcccagccgtcttcctggcctccttcctttcctcgtggcagaggcctgcatgtgggtgccagaggccagctctccccctccatcttgggggggcggagcagttgggcccaagctgcccgggagggtgggtgcagacacaggctgaggaccagccctggccctgccccgccatctgctttcaccaagctgtctctccaccgtggcttcccttctccctccaggccaaagtgctgctgattcccactcccttggttttcgcctgcccagcgttgctgtttgcgtggagggtggggggagctcagtggcagggaatcagcggtccgtggggtcgtggggacgggaacatgtgcccgaccgctccatcccctcctcctccttaggatgcataacctaccttgtcttttttttttttaattttctttccaggtagagtagctctttgtacataaagaatacttgaaaaattaattgtatgatgtatgagaagacagagtctcctagttttgtatcttgttgtatgactgccatgagttccaccagaaagccactctattttggtctctgtgacattttaaatgcgtgacagaagtgagcaaataaagtgaggaagaaatctatatatgagataa

SEQ ID NO: 7379 - DNA, 2131 bp, Homo sapiens
gtgagctcactcccgcctccatgttcccggagtcgcctggaagcgtccgcccaaggtcgcgggccgcttggggagtcagcagcgcgccaggccccttcgggccccacacgcattaggtgccttcttgatgggtacggagtgaacgcgggcggcggcgggaccgaggcagcgcccagtttgtaaccgccgcgccgcccgtgcccgcgcgcgccacaccccagcgcgcttccggccgggccacgtgaccgcgcgtgcacgtgttccggcctctccgcttcgccgctccgaacctcctcctggtcgtcccggcattcgtccacgcggagccggcttgggcggggcccgggaggcggcggccggagaagccgcggagacgcgagcgccgagcgtcgcgagggagcaggcccgggcaggcaagcggcggcctccgccatgaaccccaggggcctgttccaggacttcaaccccagtaagtttctcatctacacctgcctgctgctcttctcggtgctgctgcccctccgcctggacggcatcatccaatggagctactgggccgtctttgcccccatatggctgtggaagcttctagtcgtcgcaggcgcctccgtgggcgcgggcgtttgggcccgcaaccctcgctaccgcaccgagggagaggcctgtgtggagttcaaagccatgctgatcgctgtgggcatccacctgctgctgctcatgttcgaagtcctggtctgcgacagggtggagaggggcacccacttctggctgctggtcttcatgcctctcttcttcgtgtcccccgtgtccgtggctgcctgcgtctggggctttcgacacgataggtcgctggagctggagatcctgtgctcggtcaacatcctgcagttcatcttcatcgccctaaagctggacaggattattcactggccgtggctggtggtgtttgtgcccctgtggatcctcatgtcgttcctttgcctggtcgtcctctattacatcgtctggtccctcctgttcctgcggtccctggatgtggttgccgagcagcggagaacacacgtgaccatggctatcagttggataacgattgtcgtgcctctgctcacttttgaggtcctgctggttcacagattggatggccacaatacattctcctacgtctccatatttgtccccctttggctttccttactaactttaatggccacaacatttaggcgaaaggggggcaatcattggtggtttggcattcgcagagacttctgtcagtttctgcttgaaattttcccatttttaagagaatatgggaacatttcatatgatctccatcacgaagatagtgaagatgctgaagaaacatcagttccagaagctccgaaaattgctccaatatttggaaagaaggccagagtagttataacccagagccctgggaaatacgttcccccccctcccaagttaaatattgatatgccagattaaactcctagagaggacccaggcacacacagactccacttggccttcgcctcttgttcattcatcccaaacctggaaatggaaacaggcttcaaacactcgtctcacgccgtgtttgagatcaccgcctcatcagtatgcatcatagatggaggtggtttcagtatgtgggtgtgtgtgatgtgtacctgggtaagagacttgctttccaggttcgcactttcaggtgtagctgggggcagtaagtcgaattgttttagtaggtcctcaaaaggaataaccacacagctgtttgtttaaatgctactgtacctatcaaaactattgtttaaaaagtatttttatacactgctaatctaaaattgtatttcagattgtgcctgtcataacaatagcaaatgtaaaaagttctctttcccaccacttgtttataaacctcatagttgatatttttagtgttcctactgttaaaatactctctccttgggctttgctgatactggtctttaatattctgataggtgaatttttctaatggaatgaacccatgcatatatagtatttatatgaatattttagcagtgtaatatgttgaattctagttctctgcattaccattattacgttaaagtattttttaaagcttagg

SEQ ID NO: 7380 - DNA, 1448 bp, Homo sapiens
gtgggatttacttccggcagcaggtggtggggccatggctgcccttctccgagctgtgcgtaggtttcggggaaaagctgtgtgggaaaggcctctccatgggctgtggtgctgcagtgggcaggaggatcctaagaggtgggtgggcagcagttcacccatctcgaaggagaaactaccaaacgcagagactgagaaattctggatgttttaccgttttgatgccatcagaaccttcgggttcctgtcacgactgaagttggcacagactgccctgacagtggtagctttgccaccaggctattacttgtactcccagggcctcctcactctcaacaccgtgtgcctcatgagtgggatatcgggctttgccctgaccatgctgtgctggatgagctatttcttacggagactggttggtatcctgtatctgaatgagtctggcaccatgctgcgggtggcccatctgaacttctggggctggcggcaggacacatactgtcccatggcagatgtgattcccctgacagaaaccaaggaccggcctcaggagatgtttgtgcgtatccagcggtacagtgggaaacagaccttctacgtcaccctgcgctatggacgcatcctggacagagagcgtttcacacaggtgtttggggtacatcagatgctcaagtgaacaactgggacctggacctctgggtaaccctgggtcgcctggattaacaggaaggctgagggtgtgggcaaggctgaagaaaggggactgggtacttggagactttgcctgggcccctgggaacatgtgttttgtggtgaataaattcacaaggcaagagctggtgtacaggtttaggaaaaaggctctaagcaagttcttacagcacttgtttgtgacattcagtcagataatggccagaagtttttgttaagagccagttcttagaagaacctatgccaaggtcacccatagagtccattggtgtgaaagagaaaggcaaagaggtgtggcgggggagcgtaagatttggagtcagaagtctcagttctgtcatttgtcctggagcaggttattgagtctctttgaatcttggttttcacatctgtaaaatggaaagtcctgcttgtttcatgggatgggtgtgggaataaacaataaatgtcaaacgtgtggcagactcaacagcctacagcagatattattaagcatttggtcagaggttttagcagggagaaaggcttcgagcagtcagcagggacttccagagccctgtgctgtgcccctcacatatccagcggcagaagggtctgtcaggatgttaactacacattgacgagcagatgtcgtccaggtaggcacgaaaccccagttgagatttgttcaccacccagaggtctagaggctcttgctttggatggccctgcagtgtaataaagccaaatgcaccgga

SEQ ID NO: 7381 - DNA, 1880 bp, Homo sapiens
ccggggttggcgaacagccactgcagccgcgcctgcggccgggaagcgagcattttcgcgccctgcacacccagcagccgcaggaggcggcccgaggcgcgccgcgggggagccgggggcggggcgacagtgggaggcgacgcagccgagcgccggcgcccgggggtggagcctccgcccgctcccaggctcccaggctgcggggcccgccctcgggcgccaccgcctccgcccgcgccgcagcaaaatgagccgggccgcgcgccccagaccgccgcgcgctcggccgcccccactgccgagaggcccgcagtcgggccggtggcgcacgagccgggcgggcgaccgcgggaggcgtccgcgtcatctcgcgtcacctcgccccgcccgcttcccaggcttcgagtcccgccctgcgcgcaggcgcaccggcgctgctcggatcctcccttttcggagatttgaatttcccccagcgaggcgagtgaggcgaaatacccgtatggtgatagctggccttttcgcgccaatactgaaaaaggcagaacgttcctccgctggcgccagccaatcagcaggactcctgccttccttcggggcaaggtcgcagcatctgcctcggaaatcacgaaatcacggggcttctttctgctggctcagccgggaggcccagagtgttctgcagaggctgcgtattgaaggctgctctctgaagctccctgccccaggtcacgccgccggttccagatgaatccagagtgggggcaggccttcgtgcacgtggccgtggccggtggcctctgtgccgtggctgtgttcacgggcattttcgacagtgtttccgtgcaagtgggctatgagcactacgccgaggcgcccgtggccggcctccctgccttcctggccatgccgttcaactcactcgtgaacatggcctacacgctgctggggctgtcgtggctgcacaggggcggcgcgatggggctgggtccccgctacctgaaggacgtgttcgcagccatggccctgctctatggccccgtgcagtggctgcgcctgtggacgcagtggcgccgtgccgcggtgctggaccagtggctcacactgcccatctttgcatggcccgtggcctggtgcctctacctagaccgcggctggcggccctggctgttcctctctcttgagtgcgtctccctggccagttatggcctcgctctgctgcatccccagggcttcgaggtcgcactgggtgctcacgtggtggccgctgtggggcaggcgctgcgcacccacaggcactatggcagcaccacctcggctacctacttagctttgggggtgctctcttgcctgggctttgtggtcctcaagctgtgtgaccatcagctcgcacggtggcgtctcttccagtgcctcacaggccacttctggtccaaggtctgtgacgtgctccagttccactttgcgtttttgtttctgacgcatttcaacactcacccaagattccatccctctggcgggaagacgcgttgaacccagggaagaacctgctgaaaaccgatgacccccagcattgaaatggactctgagatggcagcgtggtgccagtgtcagacatcctgtgtgtgatgatatgcactgatcacacaagactgccctttcctgagaagctgcgggcttcggtgtggaggggtggagtgctgtgatctcgacaacttactttcaaagacataaagcacagatctccgcacaggggatgtgtgtgttcctgatgtaatttgcataacttttctgtagtttgaaatgtttccaaataaatattggcaaggggagtggaaatgacaccaagaagcccctcatgctcatggttggacagagag

SEQ ID NO: 7382 - DNA, 440 bp, Homo sapiens
actgtaagtgctcaccgcagccctgggaggaaaaaggcagaacgttcctccgctggcgccagccaatcagcaggactcctgccttccttcggggcaaggtcgcagcatctgcctcggaaatcacgaaatcacggggcttctttctgctggctcagccgggaggcccagagtgttctgcagaggctgcgtattgaaggctgctctctgaagctccctgccccaggtcacgccgccggttccagatgaatccagagtgggggcaggccttcgtgcacgtggccgtggccggtggcctctgtgccgtggctgtgttcacgggcattttcgacagtgtttccgtgcaagtgggctatgagcactacgccgaggcgcccgtggccggcctccctgccttcctggccatgccgttcaactcactcgtgaacatggcctacacgctg

SEQ ID NO: 7383 - DNA, 330 bp, Homo sapiens
taagcgattaggtcaaaggaaaaaggcagaacgttcctccgctggcgccagccaatcagcaggactcctgccttccttcggggcaaggtcgcagcatctgcctcggaaatcacgaaatcacggggcttctttctgctggctcagccgggaggcccagagtgttctgcagaggctgcgtattgaaggctgctctctgaagctccctgccccaggtcacgccgccggttccagatgaatccagagtgggggcaggccttcgtgcacgtggccgtggccggtggcctctgtgccgtggctgtgttcacgggcattttcgacagtgtttccgtg

SEQ ID NO: 7384 - DNA, 874 bp, Homo sapiens
gctgcgggccgggcgggggccgcggaagctgcgatgcggacagggcagcggcggtgacccgagctgccgcccgacatgaactcgctggagcaggcggaagatctcaaggcttttgagaggagacttactgaatatattcattgtttgcaacctgctactggacgctggagaagtgtccttcttcacatcattatggaatcacccatttttcaccattagctgtatcactctaataggcttgttctttgctggaatacacaagagagtagttgcaccatcaattatagctgctcgatgtcgaacggtattagcagaatacaatatgtcttgtgatgatacaggaaaactaattttgaaacctaggcctcatgttcaatgacaatcttcactcattgttatgggacttaaaatagcctttcttcgaataagtgatacagcaaaaagccataaaggattccttttgcggttggatatgtaaaggtcatagcagcaactgacaagaagtgtgcaatatttacctggattatcttgatgatggtgactcattatcagtgctttggtacttttgattacctgtgtttcagtattagtgtcactttagtacttcagatcctgcaaatatttttgcagatgaagtatgtatgtatgttactaagttaaacttagaaacagaacctcattcagtttttataatgtatttttgcaaactactgtaaatagcaaatcaatgccaatgttaaacaaagaggaaaacgttgtgtggactttgttctcttgcaccagtatttcaggaacatctgcttgccatccccacagctctttaaaactggctattatgtgtgcctttcattcttacatttctaatcatactgca

SEQ ID NO: 7385 - DNA, 2051 bp, Homo sapiens
gcggaagctgcgatgcggacagggcagcggcggtgacccgagctgccgcccgacatgaactcgctggagcaggcggaagatctcaaggcttttgagaggagacttactgaatatattcattgtttgcaacctgctactggacgctggagaatgcttcttatagtggtatctgtctgtacagctactggtgcctggaactggttaatagaccctgagacacaaaaggtgtccttcttcacatcattatggaatcacccatttttcaccattagctgtatcactctaataggcttgttctttgctggaatacacaagagagtagttgcaccatcaattatagctgctcgatgtcgaacggtattagcagaatacaatatgtcttgtgatgatacaggaaaactaattttgaaacctaggcctcatgttcaatgacaatcttcactcattgttatgggacttaaaatagcctttcttcgaataagtgatacagcaaaaagccataaaggattccttttgcggttggatatgtaaaggtcatagcagcaactgacaagaagtgtgcaatatttacctggattatcttgatgatggtgactcattatcagtgctttggtacttttgattacctgtgtttcagtattagtgtcactttagtacttcagatcctgcaaatatttttgcagatgaagtatgtatgtatgttactaagttaaacttagaaacagaacctcattcagtttttataatgtatttttgcaaactactgtaaatagcaaatcaatgccaatgttaaacaaagaggaaaacgttgtgtggactttgttctcttgcaccagtatttcaggaacatctgcttgccatccccacagctctttaaaactggctattatgtgtgcctttcattcttacatttctaatcatactgcaggaaaaacattggattcagcttagactgaggaaaactctccattatgttgtaagaaattatagatgttttgagagacactttttgttaaaccagatattgaactccagcaactattgtggttatatttttagttcattgttctcatttaatgctaaatatcctttatattgctttaataattttcttttttttttttttttttttagacggagtctcgctctgttgccaggctggagggcagtggcacgatcttggctttctgcaacctctgcctcccaggttcaagcgattctcctgcttcagccttctgagtagctgggactacaggcgcatgccaccatgcccagctaatttttttgtatttttagtagagacggggtttcaccacgttggccaggatggtttcgatctcctgacctcgtgatcctcctgcctcatcctcccaaaatgctgggattacaggcataagccaccgtgcctggcctctttaataatttttaaaataccctaaaggcttgtgaatatacaagtctactgataaattatgtattgtctgggaatttgatagtcattgttttagataactggattttacgctgtggtagacaggctgtgacactagtgttgcacaggtgtaattggtcatcctatgccttcaccagaataacttgggagtggtgccagaaactagagtctacaattctcactgtttagagagtgttaatgacatactgtgtatgcataatagccgcatgtactataatagcccttaaaattaaactattgggattgctgtaaatattttaaagtactggaggtgccttttacctgtttattagattttgaaaaggtttaaattatttcatgagcaatcttttaaatttcatttaacataaagctgaaaattcaataacaggataaaaaagctttttaacaaggctgccatttaacttaaatgtgttcatcttagctttcacttgtataaaatttgattctttgaactgcagcaataaaaccctcagctcctaagaagtcttaagagggtattctatatattctgctttgttttattttctgtaaattttgtaggtaaatatgtgcattaaaaataaatactttatat

SEQ ID NO: 7386 - DNA, 2102 bp, Homo sapiens
gcggaagctgcgatgcggacagggcagcggcggtgacccgagctgccgcccgacatgaactcgctggagcaggcggaagccccgcgagttgtatccctgattcctgcggtggtttccggtaactgccaagatctcaaggcttttgagaggagacttactgaatatattcattgtttgcaacctgctactggacgctggagaatgcttcttatagtggtatctgtctgtacagctactggtgcctggaactggttaatagaccctgagacacaaaaggtgtccttcttcacatcattatggaatcacccatttttcaccattagctgtatcactctaataggcttgttctttgctggaatacacaagagagtagttgcaccatcaattatagctgctcgatgtcgaacggtattagcagaatacaatatgtcttgtgatgatacaggaaaactaattttgaaacctaggcctcatgttcaatgacaatcttcactcattgttatgggacttaaaatagcctttcttcgaataagtgatacagcaaaaagccataaaggattccttttgcggttggatatgtaaaggtcatagcagcaactgacaagaagtgtgcaatatttacctggattatcttgatgatggtgactcattatcagtgctttggtacttttgattacctgtgtttcagtattagtgtcactttagtacttcagatcctgcaaatatttttgcagatgaagtatgtatgtatgttactaagttaaacttagaaacagaacctcattcagtttttataatgtatttttgcaaactactgtaaatagcaaatcaatgccaatgttaaacaaagaggaaaacgttgtgtggactttgttctcttgcaccagtatttcaggaacatctgcttgccatccccacagctctttaaaactggctattatgtgtgcctttcattcttacatttctaatcatactgcaggaaaaacattggattcagcttagactgaggaaaactctccattatgttgtaagaaattatagatgttttgagagacactttttgttaaaccagatattgaactccagcaactattgtggttatatttttagttcattgttctcatttaatgctaaatatcctttatattgctttaataattttcttttttttttttttttttttagacggagtctcgctctgttgccaggctggagggcagtggcacgatcttggctttctgcaacctctgcctcccaggttcaagcgattctcctgcttcagccttctgagtagctgggactacaggcgcatgccaccatgcccagctaatttttttgtatttttagtagagacggggtttcaccacgttggccaggatggtttcgatctcctgacctcgtgatcctcctgcctcatcctcccaaaatgctgggattacaggcataagccaccgtgcctggcctctttaataatttttaaaataccctaaaggcttgtgaatatacaagtctactgataaattatgtattgtctgggaatttgatagtcattgttttagataactggattttacgctgtggtagacaggctgtgacactagtgttgcacaggtgtaattggtcatcctatgccttcaccagaataacttgggagtggtgccagaaactagagtctacaattctcactgtttagagagtgttaatgacatactgtgtatgcataatagccgcatgtactataatagcccttaaaattaaactattgggattgctgtaaatattttaaagtactggaggtgccttttacctgtttattagattttgaaaaggtttaaattatttcatgagcaatcttttaaatttcatttaacataaagctgaaaattcaataacaggataaaaaagctttttaacaaggctgccatttaacttaaatgtgttcatcttagctttcacttgtataaaatttgattctttgaactgcagcaataaaaccctcagctcctaagaagtcttaagagggtattctatatattctgctttgttttattttctgtaaattttgtaggtaaatatgtgcattaaaaataaatactttatat

SEQ ID NO: 7387 - DNA, 2222 bp, Homo sapiens
gctgggcggtcattgggcggcgtgatctcgccgcggttccgcggccctgccgccgccgccgccagcagagcgcaccgggccgatcgggcgagtggccatggcgggcgccgagaactggccgggccagcagctggagctggacgaggacgaggcgtcttgttgccgctggggcgcgcagcacgccggggcccgcgagctggctgcgctctactcgccaggcaagcgcctccaggagtggtgctctgtgatcctgtgcttcagcctcatcgcccacaacctggtccatctcctgctgctggcccgctgggaggacacacccctcgtcatactcggtgttgttgcaggggctctcattgctgacttcttgtctggcctggtacactggggtgctgacacatggggctctgtggagctgcccattgctttcatccgacccttccgggagcaccacattgacccgacagctatcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggctggctcaactaccctctggagaagataggcttctggcgacgcctggaggacctcatccagggcctgacgggcgagaagcctcgggcagatgacatgaaatgggcccagaagatcaaataacttctccgagcctgctacctggttgccaaccttccctagcccccaaaccgaagccatctgccaaattccagcctctttgagctggcccctccagatggagaggacatctcctgggctgggcccaggtaccccagcccacccctcatgacacagaatacttgagccactgatttttcatttcttttttttttttttcctcggcccctcctcagccacctgagttgctctatctgcaagcctgactctgccagcctcccctggtagagaggaggtttacccactccctgcacgcctgccgtccctgccccgctgggcagcccttcagtgtggctggcgttggggccagtgagttgcctctttccctccttgtctggccccagtggtctggggagcccccaggcacacctaagcgtcgtggagcattgttctgccacagccctgcatactgaccccgggaggctgggcaggtggacagccccagccaccaccttcagcctagcctgtcccccaaggatggtgaagctcagcaggggtctgagggtagccggccagaagaggctggaacctcctgctcaagtctagacccctacttctctgctgcccccaccctgccagagctgatgtttccaataccaagatgtcttcacagggcacagcccctgcagagcatcttggtcatttggaagaggacacggtatcccctctggccagagtatgtcagagaaggaagagtagggcttttttgttttgtttttttttaaaggtgcttgcttgtttaatgtaaataatagaaagccttaatatcttttctgtaacacggagtaatattttaatgtcatgttttggatgtacataatatatttataacaaagcagcaagagtctacttaaccttggctgcctcgtggtgtttcctggctgggtggggtggggggtatcaaggagcctgggacgtgaggccccactctcgccccattcccagctccccccaaccctggcctcaggatgagagctgtcacctgagacagtgaattaatgttgacatctgctccaaagccttttggaggggattgggtgaggacagtggtctttcctgttgatcatgatgataaagtaatgatggctgatccctatttgtgacttccttcagcaaatattcactggcacctggtgtgtgccaggctctgtcctgtacacaggtacagcggtgaaagaaccaacaaagacctatcctggtggagctgacctcctgggaaaagagtcaataaacaaataaatgcacatggaaattcaggtggtgatttgtgaagaaaatcaaacag

SEQ ID NO: 7388 - DNA, 2198 bp, Homo sapiens
gctgggcggtcattgggcggcgtgatctcgccgcggttccgcggccctgccgccgccgccgccagcagagcgcaccgggccgatcgggcgagtggccatggcgggcgccgagaactggccgggccagcagctggagctggacgaggacgaggcgtcttgttgccgctggggcgcgcagcacgccggggcccgcgagctggctgcgctctactcgccaggcaagcgcctccaggagtggtgctctgtgatcctgtgcttcagcctcatcgcccacaacctggtccatctcctgctgctggcccgctgggaggacacacccctcgtcatactcggtgttgttgcaggggctctcattgctgacttcttgtctggcctggtacactggggtgctgacacatggggctctgtggagctgcccattgtggggaaggctttcatccgacccttccgggagcaccacattgacccgacagctatcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggctggctcaactaccctctggagaagataggcttctggcgacgcctggaggacctcatccagggcctgacgggcgagaagcctcgggcagatgacatgaaatgggcccagaagatcaaataacttctccgagcctgctacctggttgccaaccttccctagcccccaaaccgaagccatctgccaaattccagcctctttgagctggcccctccagatggagaggacatctcctgggctgggcccaggtaccccagcccacccctcatgacacagaatacttgagccactgatttttcatttcttttttttttttttcctcggcccctcctcagccacctgagttgctctatctgcaagcctgactctgccagcctcccctggtagagaggaggtttacccactccctgcacgcctgccgtccctgccccgctgggcagcccttcagtgtggctggcgttggggccagtgagttgcctctttccctccttgtctggccccagtggtctggggagcccccaggcacacctaagcgtcgtggagcattgttctgccacagccctgcatactgaccccgggaggctgggcaggtggacagccccagccaccaccttcagcctagcctgtcccccaaggatggtgaagctcagcaggggtctgagggtagccggccagaagaggctggaacctcctgctcaagtctagacccctacttctctgctgcccccaccctgccagagctgatgtttccaataccaagatgtcttcacagggcacagcccctgcagagcatcttggtcatttggaagaggacacggtatcccctctggccagagtatgtcagagaaggaagagtagggcttttttgttttgtttttttttaaaggtgcttgcttgtttaatgtaaataatagaaagccttaatatcttttctgtaacacggagtaatattttaatgtcatgttttggatgtacataatatatttataacaaagcagcaagagtctacttaaccttggctgcctcgtggtgtttcctggctgggtggggtggggggtatcaaggagcctgggacgtgaggccccactctcgccccattcccagctccccccaaccctggcctcaggatgagagctgtcacctgagacagtgaattaatgttgacatctgctccaaagccttttggaggggattgggtgaggacagtggtctttcctgttgatcatgatgataaagtaatgatggctgatccctatttgtgacttccttcagcaaatattcactggcacctggtgtgtgccaggctctgtcctgtacacaggtacagcggtgaaagaaccaacaaagacctatcctggtggagctgacctcctgggaaaagagtcaataaacaaataaatgcacatggaaa

SEQ ID NO: 7389 - DNA, 1973 bp, Homo sapiens
caagtaacaggcaggaggagtgttaagcctgaggctccatcttcagggaagaaaacatcccaactagagaagaagggacaccttcccctcctaacaaatgaatgagcgggcaattgcaggggctctcattgctgacttcttgtctggcctggtacactggggtgctgacacatggggctctgtggagctgcccattgtggggaaggctttcatccgacccttccgggagcaccacattgacccgacagctatcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggctggctcaactaccctctggagaagataggcttctggcgacgcctggaggacctcatccagggcctgacgggcgagaagcctcgggcagatgacatgaaatgggcccagaagatcaaataacttctccgagcctgctacctggttgccaaccttccctagcccccaaaccgaagccatctgccaaattccagcctctttgagctggcccctccagatggagaggacatctcctgggctgggcccaggtaccccagcccacccctcatgacacagaatacttgagccactgatttttcatttcttttttttttttttcctcggcccctcctcagccacctgagttgctctatctgcaagcctgactctgccagcctcccctggtagagaggaggtttacccactccctgcacgcctgccgtccctgccccgctgggcagcccttcagtgtggctggcgttggggccagtgagttgcctctttccctccttgtctggccccagtggtctggggagcccccaggcacacctaagcgtcgtggagcattgttctgccacagccctgcatactgaccccgggaggctgggcaggtggacagccccagccaccaccttcagcctagcctgtcccccaaggatggtgaagctcagcaggggtctgagggtagccggccagaagaggctggaacctcctgctcaagtctagacccctacttctctgctgcccccaccctgccagagctgatgtttccaataccaagatgtcttcacagggcacagcccctgcagagcatcttggtcatttggaagaggacacggtatcccctctggccagagtatgtcagagaaggaagagtagggcttttttgttttgtttttttttaaaggtgcttgcttgtttaatgtaaataatagaaagccttaatatcttttctgtaacacggagtaatattttaatgtcatgttttggatgtacataatatatttataacaaagcagcaagagtctacttaaccttggctgcctcgtggtgtttcctggctgggtggggtggggggtatcaaggagcctgggacgtgaggccccactctcgccccattcccagctccccccaaccctggcctcaggatgagagctgtcacctgagacagtgaattaatgttgacatctgctccaaagccttttggaggggattgggtgaggacagtggtctttcctgttgatcatgatgataaagtaatgatggctgatccctatttgtgacttccttcagcaaatattcactggcacctggtgtgtgccaggctctgtcctgtacacaggtacagcggtgaaagaaccaacaaagacctatcctggtggagctgacctcctgggaaaagagtcaataaacaaataaatgcacatggaaa

SEQ ID NO: 7390 - DNA, 2916 bp, Homo sapiens
agccccgattggctgtgacgcgcggccgggcgaggaccccgcccgcgccgccgccgcgcccggcgctgggcggtcattgggcggcgtgatctcgccgcggttccgcggccctgccgccgccgccgccagcagagcgcaccgggccgatcgggcgagtggccatggcgggcgccgagaactggccgggccagcagctggagctggacgaggacgaggcgtcttgttgccgctggggcgcgcagcacgccggggcccgcgagctggctgcgctctactcgccaggcaagcgcctccaggagtggtgctctgtgatcctgtgcttcagcctcatcgcccacaacctggtccatctcctgctgctggcccgctgggaggacacacccctcgtcatactcggtgttgttgcaggggctctcattgctgacttcttgtctggcctggtacactggggtgctgacacatggggctctgtggagctgcccattgtggggaaggctttcatccgacccttccgggagcaccacattgacccgacagctatcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaatttatgaaaaccgaatatacagccttaaaatagaatgtggacctaaatacccagaagcacccccctttgtaagatttgtaacaaaaattaatatgaatggagtaaatagttctaatggagtggtggacccaagagccatatcagtgctagcaaaatggcagaattcatatagcatcaaagttgtcctgcaagagcttcggcgcctaatgatgtctaaagaaaatatgaaactccctcagccgcccgaaggacagtgttacagcaattaatcaaaaagaaaaaccacaggcccttccccttccccccaattcgatttaatcagtcttcattttccacagtagtaaattttctagatacgtcttgtagacctcaaagtaccggaaaggaagctcccattcaaaggaaatttatcttaagatactgtaaatgatactaattttttgtccatttgaaatatataagttgtgctataacaaatcatcctgtcaagtgtaaccactgtccacgtagttgaacttctgggatcaagaaagtctatttaaattgattcccatcataactggtggggcacatctaactcaactgtgaaaagacacatcacacaatcaccttgctgctgattacacggcctggggtctctgccttctccccttaccctcccgcctcccaccctccctgcaacaacagccctctagcctggggggcttgttagagtagatgtgaaggtttcaggtcgcagcctgtgggactactgctaggtgtgtggggtgtttcgcctgcacccctggtttctttaagtcttaagtgatgccccttccaaaccatcatcctgtccccacgctcctccactcccgcccttggccgaagcatagattgtaacccctccactcccctctgagattggccttcggtgaggaattcagggctttccccatatcttctctcccccacctttatcgaggggtgctgctttttctccctcctcctcaagttcctttttgcaccgtcaccacccaacaccttccatgacacttccttgctttggccagaagccatcaggtaaggttggaaagagcctctgacctcccttgtttagttttggaaccatactcactcactctccaccagcctgggaaatgaatattgggtcctcagccctgccaccctctgctgtcatcagctgatgcattgtttttagctcaggttttgataaggtgaaaagaatagtcaccagggttactcagacctgccagctctcggagtccttggtggttgaacttggagaaagaccgcatgaagatacttgtaagcacacatgatccctctgaattgttttactttcctgtaactgcttttgcttttaaaaattgaagaagttttaaacagggctttcatttggtcatccttgcaatccattggggtctagtttggaatctgacaactggaacaaaaagaaccttgaatccggtgcatgccttggttttggtgctgctgctgcttcccaagatcctcagcagggattaagaaggaacccggtgtgcacagcagatccccgaaattggtgggcttgacctcctggcaaattgctgcgtctttccacttgctgttcaggaccactaaatgctgaaatgtggatgcataccgaaataaaagcaattcattgtgtactaaaggttttttttttttttttaatttagtatttgtgtaaaaccaccttttgaagcagcaactatcaagtctgaaaagcaattgatgtttccattaatctttttctggggggaaaaccttagttctaaggatttaacatcctgtaagtgaagtttaacataacagtattccataagcagcctttttattgtcagaccattgcctgattttaatataataaaaaaaaagtgtgcgttaatattt

SEQ ID NO: 7391 - DNA, 4666 bp, Homo sapiens
cacagcgggcgaggcgctagaggcgggggcgccgggaggcgcgggctttgctcctggggtctcggccttggccggctggacctgaccctagggcggcttgcgcagctgtcgggacgtgactgcgttcagccgcgtcgggcgtgcttcccagacttgcccaagttcgggtgccctagctgcccctttgcagccgctggcctacccggcccgcgggtgagaaggttgcgacgggaggtgggtggaactcgccagcgccgggaccgcggattggctgcctcggctttctcttttccccgtgggctccggcgtgaggcgctgaagcggccggcagccggcgaccggccctcaccgtccgccgggttgcgctctgcttttgcggtgaggcgttgaccacgcccatatgaattggagctctccgccagtaggagtttccggaaggagtttgaatttttgtgatttttatgcttgtttggtcggtggaatatgttgggatttatgtttgcctctgaacaagtgtcttgctcacatcgtaaatgactttctctccgaaacgctaaatattctttcccgcaggagctcatatccttattttccatgacagatcttaacgacaatatatgcaaaagatatataaagatgataactaatatagttatactgagcctgatcatttgcatttcgttagctttctggattatatcaatgactgcaagcacctattatggtaacttacgacctatttctccgtggcgttggctgttttctgttgttgttcctgttctgatcgtctctaatggccttaaaaagaaaagtctagatcacagtggggctctaggagggctagtcgttggatttatcctaaccattgcaaatttcagcttttttacctctttgctgatgtttttcttgtcttcttcgaaactcactaaatggaagggagaagtgaagaagcgtctagattcagaatataaggaaggtgggcaaaggaattgggttcaggtgttctgtaatggagctgtacccacagaactggccctgctgtacatgatagaaaatggccccggggaaatcccagtcgatttttccaagcagtactccgcttcctggatgtgtttgtctctcttggctgcactggcctgctctgctggagacacatgggcttcagaagttggcccagttctgagtaaaagttctccaagactgataacaacctgggagaaagttccagttggtaccaatggaggagttacagtggtgggccttgtctccagtctccttggtggtacctttgtgggcattgcatacttcctcacacagctgatttttgtgaatgatttagacatttctgccccgcagtggccaattattgcatttggtggtttagctggattactaggatcaattgtggactcatacttaggggctacaatgcagtatactgggttggatgaaagcactggcatggtggtcaacagcccaacaaataaggcaaggcacatagcagggaaacccattcttgataacaacgcagtgaatctgttttcttctgttcttattgccctcttgctcccaactgctgcttggggtttttggcccagggggtgaactttatttcatttccacaggttgaaactggtgagtccagctaaatttgcaattccaactttcatcctaagaataataactgtaatggcaaagcggaaatgccagttcctcctgtattccattgagatgggatttcacattttcctctcatcaactcccctgtaatagctagcgtctttctagtgaaagagaagaattcctagaacttatgcatttttttcctgctgaatggaagtcttgagcaatgaagctatattgtccctacatattactatatattgaactgaaagttcttacataatcaatgtcaagttttgtcttattttgttttgtttgtttaaaccagtgtaggaaataaaagtgatgatatttaaaatagttctcagttgaagcagagaaatgccactgtgctagttgcccaaatgttgtatctattttaaatagtttaagctgatgtgtatgggagcctaaacaagtgtagtatcctgaacttctcccattaattgctattcacaattgggaaaagtgtggagattggttcctagtgagttttgtggcctactccacatttgttcttccttcctcagggttagtgatgaaaaaaagtaaatatctttttcatatgtccattagaatgtatgaaaaaaatcattttaactaaaagcaaaagaattttatcttatatctaaaaaatatataacttactatatgtttcagttgctctctgaacaaaaattatcttcaatttaatatgtggaatgtgttttctagctttctttgaattatgtatggcaacctggtttagcactggcatcctgaacagttaagagtcactgggaaattattgtatttctttataaatttactgtcatatcaattgctggaaaatgctatgatttttctattattaccttctaagttgtattctctcttacactgtagcctcaactaaggcaattctgctatgtttgttcttcactatgatttactgtgtgccaaaggagttttgacagggtacagagtattttactaaaagtatttttaaatgtttctcatgtgatttctgtaccttcttcctcctgccccttttgcttttttaaagaaactggggaaggatttatgaatacaccaccaccagagtggataatgcttagaattctttattggtggccctactatggtgatgatctagaactgacttacttcaggacagaagaaaaaacaatcacacccttaacctttaagccagttagatcagggggttgcaacaattgggttaaactttgggtatacattggaagcaccagggcatgtttgctttttttgtttatgtgtttgttttttgagacagagtctcacactgtggcccaggctggactccagcacagtggcatgatctcagctccgcctcctgggttcacgtgattctcatgcctcagcctcccaagtagctgggatcacaggcgtgcaccatcacgcccggctaatttttgtattttcagtagagacagggtttcgccacgttggctaggctggtctcgaactcctgacctcaagtgatctgcccatctcagcctcccaaagatctattacaagatgtgagccactgtgcccagccaccagggcatgtttttaaaaaagtactgatgtctgggtttcacactgcaaaattctgatttatctgatctaaggtacagcctggatattgagactttttaaagctctgactgtacattgaatcatcatgtaaggagtttttaaaacattgttgccagggcccctttctagaccaagttagtcagaatgttggacaatgaggcccatgcatgggtatttttacaaagctctctgggagattctaatgcttaaccaaattgagaagcactgaataagaatatcctgggccgggcgcactggctcatgcctgtaatcccagcattttggaaggccgaggcgggtggatcacttgaggtcaggagttcgagaccagcctggccaacatggtgaaacaccgtctctactaaaaatacaaaaaattaggtgtggtggtgcgtgcctgtattcccagccactcaggaggctgaggcaggagaatcgctggaacctgggatgtggaggttgcagtgagccaagattgcaccactgtactccagcctgggcaacagagggagactccatctagactccatctcaaaaaaaaaaaaaaaaaaaaaaaaaaaaaaaaaaaaaaagaatattctaagcactagaactacataagaatgtcctaaagcactgtatctaagcacttgaaaagaatgggacttttcggttttagggagataactattagcaaccacacaatatgttatctttatggatgaataacttctggtaatgacacagtgtcttacagctacatcatttataaaatcatgtgtcagttttcacacagcctgcacatcgttctgacatgccctttttttccctggagatttatcctcatgacatacaaggggacaaaaatatttattgggactgtctttgaatttagtagaatcactgtatcattaacagtttggggaagtactgctttgcagtcctttatttgaaaacttaggtctagctgtgttttgcatcaaaatttttgagctattcaaaaactaataggatctgtgtaaaatatttcactcaaaactactaaaaaaaagtctgggatggcagctcattatcaaatatactcctatttttgtggtgatttatgaacatccccactaagtataactaaagatcataaagagcctcagatcaagtttggtcaggttttgtcaccaagctttgtaaataaactggttttcatagctttttggagatgagaattgaggataagaaattgtgtctctgtcctttttttttttttttgttaagtcttacatgtattttactgtaacatcttttgaattggatatttaactaattcaacatatttttcctctttgcagaatgggcagttcatgttaaaatcacttttcatggaaagagctctatgtaacagcataataaaactgcctacctagcagca

SEQ ID NO: 7392 - DNA, 3328 bp, Homo sapiens
aggcgctagaggcgggggcgccgggaggcgcgggctttgctcctggggtctcggccttggccggctggacctgaccctagggcggcttgcgcagctgtcgggacgtgactgcgttcagccgcgtcgggcgtgcttcccagacttgcccaagttcgggtgccctagctgcccctttgcagccgctggcctacccggcccgcgggtgagaaggttgcgacgggaggtgggtggaactcgccagcgccgggaccgcggattggctgcctcggctttctcttttccccgtgggctccggcgtgaggcgctgaagcggccggcagccggcgaccggccctcaccgtccgccgggttgcgctctgcttttgcggtgaggcgttgaccacgcccatatgaattggagctctccgccagtaggagtttccggaaggagtttgaatttttgtgatttttatgcttgtttggtcggtggaatatgttgggatttatgtttgcctctgaacaagtgtcttgctcacatcgtaaatgactttctctccgaaacgctaaatattctttcccgcaggagctcatatccttattttccatgacagatcttaacgacaatatatgcaaaagatatataaagatgataactaatatagttatactgagcctgatcatttgcatttcgttagctttctggattatatcaatgactgcaagcacctattatggtaacttacgacctatttctccgtggcgttggctgttttctgttgttgttcctgttctgatcgtctctaatggccttaaaaagaaaagtctagatcacagtggggctctaggagggctagtcgttggatttatcctaaccattgcaaatttcagcttttttacctctttgctgatgtttttcttgtcttcttcgaaactcactaaatggaagggagaagtgaagaagcgtctagattcagaatataaggaaggtgggcaaaggaattgggttcaggtgttctgtaatggagctgtacccacagaactggccctgctgtacatgatagaaaatggccccggggaaatcccagtcgatttttccaagcagtactccgcttcctggatgtgtttgtctctcttggctgcactggcctgctctgctggagacacatgggcttcagaagttggcccagttctgagtaaaagttctccaagactgataacaacctgggagaaagttccagttggtaccaatggaggagttacagtggtgggccttgtctccagtctccttggtggtacctttgtgggcattgcatacttcctcacacagctgatttttgtgaatgatttagacatttctgccccgcagtggccaattattgcatttggtggtttagctggattactaggatcaattgtggactcatacttaggggctacaatgcagtatactgggttggatgaaagcactggcatggtggtcaacagcccaacaaataaggcaaggcacatagcagggaaacccattcttgataacaacgcagtgaatctgttttcttctgttcttattgccctcttgctcccaactgctgcttggggtttttggcccagggggtgaactttatttcatttccacaggttgaaactggtgagtccagctaaatttgcaattccaactttcatcctaagaataataactgtaatggcaaagcggaaatgccagttcctcctgtattccattgagatgggatttcacattttcctctcatcaactcccctgtaatagctagcgtctttctagtgaaagagaagaattcctagaacttatgcatttttttcctgctgaatggaagtcttgagcaatgaagctatattgtccctacatattactatatattgaactgaaagttcttacataatcaatgtcaagttttgtcttattttgttttgtttgtttaaaccagtgtaggaaataaaagtgatgatatttaaaatagttctcagttgaagcagagaaatgccactgtgctagttgcccaaatgttgtatctattttaaatagtttaagctgatgtgtatgggagcctaaacaagtgtagtatcctgaacttctcccattaattgctattcacaattgggaaaagtgtggagattggttcctagtgagttttgtggcctactccacatttgttcttccttcctcagggttagtgatgaaaaaaagtaaatatctttttcatatgtccattagaatgtatgaaaaaaatcattttaactaaaagcaaaagaattttatcttatatctaaaaaatatataacttactatatgtttcagttgctctctgaacaaaaattatcttcaatttaatatgtggaatgtgttttctagctttctttgaattatgtatggcaacctggtttagcactggcatcctgaacagttaagagtcactgggaaattattgtatttctttataaatttactgtcatatcaattgctggaaaatgctatgatttttctattattaccttctaagttgtattctctcttacactgtagcctcaactaaggcaattctgctatgtttgttcttcactatgatttactgtgtgccaaaggagttttgacagggtacagagtattttactaaaagtatttttaaatgtttctcatgtgatttctgtaccttcttcctcctgccccttttgcttttttaaagaaactggggaaggatttatgaatacaccaccaccagagtggataatgcttagaattctttattggtggccctactatggtgatgatctagaactgacttacttcaggacagaagaaaaaacaatcacacccttaacctttaagccagttagatcagggggttgcaacaattgggttaaactttgggtatacattggaagcaccagggcatgtttgctttttttgtttatgtgtttgttttttgagacagagtctcacactgtggcccaggctggactccagcacagtggcatgatctcagctccgcctcctgggttcacgtgattctcatgcctcagcctcccaagtagctgggatcacaggcgtgcaccatcacgcccggctaatttttgtattttcagtagagacaggcctggccaacatggtgaaacaccgtctctactaaaaatacaaaaaattaggtgtggtggtgcgtgcctgtattcccagccactcaggaggctgaggcaggagaatcgctggaacctgggatgtggaggttgcagtgagccaagattgcaccactgtactccagcctgggcaacagagggagactccatctagactccatctcaaaaaaaaaaaaaaaaaaaa

SEQ ID NO: 7393 - DNA, 1772 bp, Homo sapiens
agctctccgccagtaggagtttccggaaggagtttgaatttttgtgatttttatgcttgtttggtcggtggaatatgttgggatttatgtttgcctctgaacaagtgtcttgctcacatcgtaaatgactttctctccgaaacgctaaatattctttcccgcaggagctcatatccttattttccatgacagatcttaacgacaatatatgcaaaagatatataaagatgataactaatatagttatactgagcctgatcatttgcatttcgttagctttctggattatatcaatgactgcaagcacctattatggtaacttacgacctatttctccgtggcgttggctgttttctgttgttgttcctgttctgatcgtctctaatggccttaaaaagaaaagtctagatcacagtggggctctaggagggctagtcgttggatttatcctaaccattgcaaatttcagcttttttacctctttgctgatgtttttcttgtcttcttcgaaactcactaaatggaagggagaagtgaagaagcgtctagattcagaatataaggaaggtgggcaaaggaattgggttcaggtgttctgtaatggagctgtacccacagaactggccctgctgtacatgatagaaaatggccccggggaaatcccagtcgatttttccaagcagtactccgcttcctggatgtgtttgtctctcttggctgcactggcctgctctgctggagacacatgggcttcagaagttggcccagttctgagtaaaagttctccaagactgataacaacctgggagaaagttccagttggtaccaatggaggagttacagtggtgggccttgtctccagtctccttggtggtacctttgtgggcattgcatacttcctcacacagctgatttttgtgaatgatttagacatttctgccccgcagtggccaattattgcatttggtggtttagctggattactaggatcaattgtggactcatacttaggggctacaatgcagtatactggtaagaacattccttcattcttgcaacttattggtatgttaaagaaatagggaaaagaaagaaaaaaatgttaacaatgaaaacaaatccaaagacacagggtgttgagggactagaaatgatagggcaaagtctctttcacaattttggttttcttattcttttgtattaaattaattgaaagagaattagtcccgcgcagcaatgattagaagccatgtggggaagatacaatagtgcagagaacagacgtttttgtgtgagccattacctaatcccagaaaagcaagacgtttgggatcagatcattttaatacaattccttccattcattttcctattccatttgaggagtaattgtacaaatctgactatacacacgacctactttcttactgtggtatcatgcttgctattcttgcccctgagttttttgcttcattaagatatatggtcgatgtctgggcacggtggctcacatctataatcccagcactttgggaggccaaggggggcagatcactggaggtcaggagttcgagactagcctggccaacatggtgaaaccccatctctactaaaaatacaaaaattatctggtgtagtggcgcctgcctataatcccagctacttgggaggctgaggcaggagaattgcatgaacctgggaggcggagattgcagtgagccgagatcatgccactgcactatagcctgggcaacagagcaagactccatctc

SEQ ID NO: 7394 - DNA, 739 bp, Homo sapiens
ggcgccgggaggcgcgggctttgctcctggggtctcggccttggccggctggacctgaccctagggcggcttgcgcagctgtcgggacgtgactgcgttcagccgcgtcgggcgtgcttcccagacttgcccaagttcgggtgccctagctgcccctttgcagccgctggcctacccggcccgcgggtgagaaggttgcgacgggaggagctcatatccttattttccatgacagatcttaacgacaatatatgcaaaagatatataaagatgataactaatatagttatactgagcctgatcatttgcatttcgttagctttctggattatatcaatgactgcaagcacctattatggtaacttacgacctatttctccgtggcgttggctgttttctgttgttgttcctgttctgatcgtctctaatggccttaaaaagaaaagtctagatcacagtggggctctaggagggctagtcgttggatttatcctaaccattgcaaatttcagcttttttacctctttgctgatgtttttcttgtcttcttcgaaactcactaaatggaagggagaagtgaagaagcgtctagattcagaatataaggaaggtgggcaaaggaattgggttcaggtgttctgtaatggagctgtacccacagaactggccctgctgtacatgatagaaaatggccccggggaaatcccagtcgatttttccaagcagtactccgcttcct

SEQ ID NO: 7395 - DNA, 567 bp, Homo sapiens
agacacatgggcttcagaagttggcccagttctgagtaaaagttctccaagactgataacaacctgggagaaagttccagttggtaccaatggaggagttacagtggtgggccttgtctccagtctccttggtggtacctttgtgggcattgcatacttcctcacacagctgatttttgtgaatgatttagacatttctgccccgcagtggccaattattgcatttggtggtttagctggattactaggatcaattgtggactcatacttaggggctacaatgcagtatactgggttggatgaaagcactggcatggtggtcaacagcccaacaaataaggcaaggcacatagcagggaaacccattcttgataacaacgcagtgaatctgttttcttctgttcttattgccctcttgctcccaactgctgcttggggtttttggcccagggggtgaactttatttcatttccacaggttgaaactgaatgggcagttcatgttaaaatcacttttcatggaaagagctctatgtaacagcataataaaactgcctacctagcagca

SEQ ID NO: 7396 - DNA, 593 bp, Homo sapiens
ggggtctggggaggtgacatgttgggctgtgggatcccagcgctgggcctgctcctgctgctgcagggctcggcagacggaaatggaatccagggattcttctacccatggagctgtgagggtgacatatgggaccgggagagctgtgggggccaggcggccatcgatagccccaacctctgcctgcgtctccggtgctgctaccgcaatggggtctgctaccaccagcgtccagacgaaaacgtgcggaggaagcacatgtgggcgctggtctggacgtgcagcggcctcctcctcctgagctgcagcatctgcttgttctggtgggccaagcgccgggacgtgctgcatatgcccggtttcctggcgggtccgtgtgacatgtccaagtccgtctcgctgctctccaagcaccgagggaccaagaagacgccgtccacgggcagcgtgccagtcgccctgtccaaagagtccagggatgtggagggaggcaccgagggggaagggacggaggagggtgaggagacagagggcgaggaagaggaggattaggggagtccccgggggactgctcaatacagatacggtggacg

SEQ ID NO: 7397 - DNA, 4516 bp, Homo sapiens
agccggaggcggggcggacgcaggagggggtgtgtctggggaggggcctggcaggtcccagaaggtggcgagtttcgcggccagaggcttacaggtccaggtggagaggccgggctggccagggcttcggcctccggcgtcgggaaatggcggcggggggcaggatggaggacggttccttggatatcacccagagtattgaagacgacccacttctggatgcccagcttctcccacaccactcattacaagctcactttagaccccgattccatcctcttcctacagtcatcatagtgaatcttctgtggtttattcatctcgtgtttgttgttttagcatttttaacaggtgtgctttgttcttatcctaatccaaatgaggacaagtgcccaggaaattacacaaacccattgaaagttcagacggttataatccttgggaaagttattttgtggattctccatttactccttgaatgctacatccagtatcaccacagcaaaatcagaaaccgaggctataacttgatctaccgatcaacaaggcatctcaagagacttgcgttgatgatacagtcctctggcaacacagtgcttctcctcatactgtgcatgcagcactccttcccagagcctggcagattgtatcttgacctcattctggccatcttggcactggaactcatctgttccctgatatgtctcctcatttacacagtgaaaatccggagatttaataaagctaaaccagagcctgatatacttgaagaagaaaaaatctatgcttaccccagcaatattacctcggagactggattcagaactatttcaagcctagaagaaattgttgaaaagcaaggagacaccattgaatacctgaagcgacacaatgcgctgctgagtaagcgattgttggctctcacttcctcagacctgggctgtcagccaagtagaacgtgagaggctcacggtcatgacagcaattgcagaggaacccagagtaattgagactgactgaccacctgacaagctgccacggggaactgcagcttttgctgaatagcattttacagtgtttgttggaaacctgaatttggttctgacttctgtggctgtttaaaatatagggcttgtgggtcacttgaaaagtacctgtagaagcccggataacttgaggggaatgtctgtttgtacttttggaaattatttaactgcttggtttatcctaggatcagaggctaaacaactccatagtcaacacttttccacctgacattagaaccctgtaatgatttcattatggataggggaagtctaacaagacaatcgattttaaacagggttttaatcaaataagttcttcccacttttaagctgatgaaagaagtcattatttcttgtgaatattttttcctggagagccttatcatgtattttatatgcttatgtggtgttggatgacatcatggaccatatagcttttatagagaatttttctcaccataggactgaggtctcaccaggtgatctactatgcaaattcctacagttttctattcttaagaaataagggctgggcacggcggatcatgaggtcaggaaattgagaccatcctggctaacacggtgaaaccctgtctctactaaaaatacaaaaaaaattagccgagcatggtggcgggcacctgtagtcccagccacctgggaggctgaggcaggagaatggtgtggacccaggaggcggagcttgcagtgagccgagatcacgccactgcactccagcctgggcgacagagcgagactccgtctcaaaaaaacaaaaaagaaaaagaaaagaaataagatatgatgattgattacttggaccagtgttagaccgacctgtgttagacgaacctgtgttgcctattatattggcagcaccttccattagcaatagctgaaaaattcagagaagaatttagaactttcactttatttttgccattcttcaagaagttgctgtatatttcagtctggttataccttcaattgatcaataacttcaattataggaaaggcatcttctataattttaaattactgtaaaaaaaagataccttttaaagccttggattatacttaaaaattgtaatggaagaaatgcatattaagttatatgcagatattaaacatatctgattctgaagataaaactgaagtatttttcagagcaaatggcattatttctccatttttcctagtatgcccctttaatttgtcagtttgctgttagcactgttatatgctgccttagaaagacttttggttgaaggctgaatatgaggggaggggatatttatgactgtgttaatcttttttgatcattagctgaatattcaatatttgatatgtaaccatatagggatgtgttcgatataactatataggcaagggatatattgatttggccacatctatttgacttatggagggcaaatacctgtttcttttagatacagccattgccggggcattctaaaagttttctactaagataaagatgattgtgtatggctgggagcagttgctcatgcctgtaatcttagtactttgggaggctgaggcaggaggatcactcaaggccaggagtttgagaccagcctgggcaacaatgagacactgtctctcaaaaaaaaaaaaaaaagatcgtgtgtcacctgcacacaacattcacaaactaaagccaaattgtatttttaaaatttcctttctcccttccgtttttttttgttttttgggggtttttttttttgttgttgtttttgagacagagtctcaccctgtcgcccaggctggagtgcaatggcgcctttctttctttctttttttttcagacggagtctcgctctgttgcccaggctggagcgcagtagcatgatctcggctcactgcaacctccgcctcccgggattaagaaattctcctacctcagcctgctgagtagctgggattacaggcacatgccaccatgcctggctaatttttgtatttttagtacaggcggggtttcaccatgctggccaggctggtctcaaactcctgaccttttgatccgccctccttggcctcccaaagtgttgggattacaggcatgagccactgtgcccggccttcctttctttttaataagtgtatgtatctcaaagccattgccttctctagaaatctgtttctctgttctggaagagcctataaactttgccttcagttgtttttcttttcaaaagggaacaccagtggtagatgattaactcttatttatttttaaaatttaatttggatctatagtcagtatctgagatttataggatgaactttggtttacaaggaacagtgtagttaaaaagttagggtgcctatgttcttatgtaatcatcaacatgtttgttgtataatcatcaacatttttctgaatgcaatgatgaacatttcaaacaataaatgaaaatgaaactaagtatcagaagtagcaaaacagctgatgcagtggcttacgcctgtaatcccagcacttcgggaggctgaggcaggtggatcacctgaggttaggagctcaagaccagcctggccaacatagtaaaaccccatctttactaaaaatacaaaataagccaggcatggtggcacgcatctgtaatcccagctactcaggaggctgaggcaggagaatcgcttgaacacaggaggcagaggttgcagtgagctgaaattgcaccactgcattccagcttgggcaacagagctagactcgatctcaaaaaaaaaagaagtaacaaaacagaaaaatgaacaaaacaatttaaatgttaaacattctattcaccaggctggtaattgtgctagcactgaggatacaaaaattaaagactctggttggcagcttacattctaaagagagcgaggaatagatttccagactctgtgctaagtgcagtaatgacagtaggcccaacatgctgtaggagctccacgtcagggggtaccctgggggcaggagggtagagggttttaagaatgtcagacagaacaatgagtaaagtaggaaggcaaatagctacaaaatatcacaagcactgtgtatagctggaaccaaaagtgtgaggcaggacctgggtggagaggtagacagggtcagagcttggagggccttgatactatgctggaagactgcactttatcttgttgataatgggatcctctgaagcatttcaagcaaggaagtgacaatgtcagttttagtttcagcaggatcagatggtagttcaatatggaggaaatatgtgtggcagaaagatatggccctgaactagggcaggtatagtaaaccttttattataagtatgtatgtgtataggtatatagatagatataggtatatatgtatgtatatgtattccaaatgacaacagtatcatgacttattataaagttaaaagctcattttttaaaaaatggcaatatggaaaaatata

SEQ ID NO: 7398 - DNA, 2225 bp, Homo sapiens
accaaagaaaaaagacacctgtgcctggcaggtcgatacgctactaatttgcccgaggtacgaacgaaacagaagatgctgatttctggataaaacgttctgcagtgccaggctgcagtgtgttctactgaatgcatgtaccataatttacttaattatctgggctgattctgaatttctattatgaacaaagccacaggttccttggatatcacccagagtattgaagacgacccacttctggatgcccagcttctcccacaccactcattacaagctcactttagaccccgattccatcctcttcctacagtcatcatagtgaatcttctgtggtttattcatctcgtgtttgttgttttagcatttttaacaggtgtgctttgttcttatcctaatccaaatgaggacaagtgcccaggaaattacacaaacccattgaaagttcagacggttataatccttgggaaagttattttgtggattctccatttactccttgaatgctacatccagtatcaccacagcaaaatcagaaaccgaggctataacttgatctaccgatcaacaaggcatctcaagagacttgcgttgatgatacagtcctctggcaacacagtgcttctcctcatactgtgcatgcagcactccttcccagagcctggcagattgtatcttgacctcattctggccatcttggcactggaactcatctgttccctgatatgtctcctcatttacacagtgaaaatccggagatttaataaagctaaaccagagcctgatatacttgaagaagaaaaaatctatgcttaccccagcaatattacctcggagactggattcagaactatttcaagcctagaagaaattgttgaaaagcaaggagacaccattgaatacctgaagcgacacaatgcgctgctgagtaagcgattgttggctctcacttcctcagacctgggctgtcagccaagtagaacgtgagaggctcacggtcatgacagcaattgcagaggaacccagagtaattgagactgactgaccacctgacaagctgccacggggaactgcagcttttgctgaatagcattttacagtgtttgttggaaacctgaatttggttctgacttctgtggctgtttaaaatatagggcttgtgggtcacttgaaaagtacctgtagaagcccggataacttgaggggaatgtctgtttgtacttttggaaattatttaactgcttggtttatcctaggatcagaggctaaacaactccatagtcaacacttttccacctgacattagaaccctgtaatgatttcattatggataggggaagtctaacaagacaatcgattttaaacagggttttaatcaaataagttcttcccacttttaagctgatgaaagaagtcattatttcttgtgaatattttttcctggagagccttatcatgtattttatatgcttatgtggtgttggatgacatcatggaccatatagcttttatagagaatttttctcaccataggactgaggtctcaccaggtgatctactatgcaaattcctacagttttctattcttaagaaataagggctgggcacggcggatcatgaggtcaggaaattgagaccatcctggctaacacggtgaaaccctgtctctactaaaaatacaaaaaaaattagccgagcatggtggcgggcacctgtagtcccagccacctgggaggctgaggcaggagaatggtgtggacccaggaggcggagcttgcagtgagccgagatcacgccactgcactccagcctgggcgacagagcgagactccgtctcaaaaaaacaaaaaagaaaaagaaaagaaataagatatgatgattgattacttggaccagtgttagaccgacctgtgttagacgaacctgtgttgcctattatattggcagcaccttccattagcaatagctgaaaaattcagagaagaatttagaactttcactttatttttgccattcttcaagaagttgctgtatatttcagtctggttataccttcaattgatcaataacttcaattataggaaaggcatcttctataattttaaattactgtaaaaaaaagataccttttaaagccttggattatacttaaaaattgtaatggaagaaatgcatattaagttatatgcagatattaaacatatctgattctgaagataaaactg

SEQ ID NO: 7399 - DNA, 5590 bp, Homo sapiens
aggaggaggtggcttgaggcaaccatggcgggaggaatgaaagtggcggtctcgccggcagttggtcccgggccctggggctcgggagtcgggggcggtgggacagtgcggctactcttgatcctctccggctgcttggtctacggcacagctgaaactgatgtaaatgtggtcatgcttcaggaatcccaagtttgtgaaaagcgtgccagccaacaattctgttacacaaatgtgcttatcccaaaatggcatgatatatggacacggatacagatccgagtaaatagttccagattggttcgagtcacccaggtggagaatgaggagaaactgaaggagctagagcagtttagtatctggaactttttttcctcctttttaaaagagaaattgaatgacacctatgttaacgtgggtctatacagcacaaaaacctgcctcaaagttgagattatagagaaggacaccaagtacagtgtcattgtgatccggagatttgatcccaaactctttcttgttttccttcttggacttatgctatttttttgtggagacttgctgagcagaagtcaaattttctactactctactgggatgactgtgggaattgtggcctctctgctaatcatcatttttatactatctaagtttatgcctaagaaaagtcccatttacgtcatcctggtgggaggctggtctttttctctgtacctcattcaactagtttttaaaaatttacaagagatctggaggtgttactggcagtatcttttaagttatgtcctcacagttggattcatgagttttgcagtatgttacaagtatgggcccttggagaatgaacgaagtatcaacctgctgacctggaccttgcagctgatgggcctgtgtttcatgtattctggcatccagataccacatattgcccttgccattatcatcattgctctttgtactaagaacctggaacaccctattcagtggctgtacatcacctgcagaaaggtgtgtaagggagcagaaaagcctgttccccctcgtctcctgacagaagaagaatatcggatacaaggagaggtagaaacccgaaaggctttagaggagctccgagaattttgtaacagtccagactgctctgcttggaagactgtttctcgaatccagtctccaaaaagatttgctgactttgtggaaggctcttcccacctcacgccaaatgaagtttctgtccatgagcaggagtatggattagggagcattattgcccaggatgaaatctatgaggaagcatcctctgaggaggaggactcatattctcggtgtcctgctatcacacagaacaactttctaacctaggtagtggtcagttatctttacgtggactggcttggtgccttggtccatgttgcatgtgttgtgcaattgctttcaaccctttgaaacagagtgagatagatagggtagaaattctcctactgaaataagaggcctaaaaaggcctccctttggaaatgggaggtctctatgggatccctgaggaaggagagtggataaagtagtgaatgctgggtagttcacttcccattggttaagctaacagcccacttttatgtttccagagaaattggatggccacagctagcatggcattctagctccttcttgaaagttgattcaatcatggcatttctgtcactggctggctctccaaagtaagaactgttgttaagtgcaggaatgcttttagactataggctgcaacttccagagagaaatccacaaatctgagcctccttcactccagcttttatttcagtgactttagaataattattgatttaactgttttgggaggaaaatagatttttattgttttgttttttaaatgaatgtcttttaaaaaacataacaaactcatgttccagaaccagcaagtgctccagagtgacacaccccctaggcccctacatatttattaatatggattatccattaaagccccaggagctgttgttttaagctttgatttagttctcatacatatgatagaaagtcctatttgcctttaggaacatgcctgtaggctcttctgcaggtgagatgtactgggctttttattatattcaactttcaattccatcttaaaaaacatttgtattcttctcttcccattcttccttaccctgcctttgccctttcaggaagggtcagttcccttacctgtgaactatgtatgttcagagtagcattattcctgctagctaggagaagtcatcttgtttaggggatttggatgctttttatacgttctccattttcctgtcattgggtcatgttatctttgagttgctatgaaatcaggaaactgtctccttttcctttcccttcctttgtctacatgctctgtccattcctttcagccttttctcaccacccatactcccccaaatctgggtaatttttaagccttgaaactatgtagtttcttgatacacaatttgtagttatgcagcagccacaatttgcattgccaggaaataggctccaggttatcttcatgcctctgggtgctcattcagctgtcaagtttccatgaacttacacttatttatgattgcgtttctgacctgagatgtatgctgcctgttattgcagtagcattagtttcagattcttttgccattgcaaagtaccccttataaaccagcaatgtcatctgtgaggaagcaaattctcaagtgtctgtcatttacttggttctttttctttgtggtcttcacccttataccctggaaaagtctgtaattaccttagccaggaagatagatggtcatggcaagcgcacagcaccagacttactggctcaccaagatgatggaaaaaggcagatgattttttaaaaagccgtaatgactcctttagaccagccatttagcgtggtaattttgaaaggcctagctccattgcagacttccaaagggtcagctctgagactgccctccaggtgggcagttgattatttccaccagtgttttccagagccttaaactgtcctaagtgacaactacctcagttggcaggaaagagacatatagtagaaagtgaaaaatgagcagtatttgggcagatgctatgggttacagttgaagggtaaaaggaactttacattgggaaacctttatacccttgtgaattatgtacatggtaaaatgttctctctctacaaagaactattaaaacttctgaaatatactattttttaccttatttatagaaattgagacctagcatatttaagcataagtttattttaaaaaataattcaactcgtgcaagtggtctcaggattctctggagattttggtgcctcccctacttagggaggtgatagcttgcctataagggtgacttttcctgatcatgtctttatttcaatgagaaagcactgtgaaattgtgaaagattctcctctttctctgtttaataaacccccatgaaatatagtttccatctctagaccagttttttttccaccgtgtttagacttgaggtgaataaaatcaaactgttttttactccctatctggtagttggagacctgagctgtaggcagtggagatggcaattggttctgcagcctgagagttgctctcacacagtgaaggacggtgctgctctggtgtgctgtgtgtccttgccctgcctgcctgtggctctgcccagatgcttcagatcctctgtgttccggagattgcttgacttcaaccttctttaggagctgctcttgtctccctcttggccacttagtttgctggctcagtcactacttgaagaccccatttaatttttctctggcagttatagctcttgtgatttcagtacagtctcatctctcagaccaatctcatcaagaaggattgaagggataactatgaggtaagctggacattggagccgtgtttgctgccacgtcagcgtcttgctgggtgaatgtcaagccataaatgggctccagggctctggatctcatcagcattggaaatctattgcctctcatcagtctgaccaaattatgtagagcattaatgtagagactcccattaatgggaatacaagaggcagctggcataaaacatttctttcactttcctttcccactcagattgcttcaagagaccaacagaacacagggatcaaaaacaaggaaaatttagcaacttcattaccttctaataagtaattcctgttagccactgcatcccaccaaaactagtttatttttcccctcaaattcatgatttttacgtctgttacaaagggaattttgctgatagctctttgggtcccactgttccattttatgctaatagattccattctagggcccagccgtctcttgactgatggtgttccctttaacccttggcatgtataatagaattttggtgaatgaaagaacccaaataggccagatagtccccccaggccctgatatccataaaaggcttgggaatgcattatgtaattgtccttagtctttttgttgttttagaaaaaaaaaacaagatgggctcagatggatgcctacgtaaaaatggttcctagctgtgtactcataacttttctttgaattgagtagtgaaaggaaggaggaggaaaggaaattaaatgtccttctagtattctctggactcaagtctgacatatgagataataacctatattgaaatgccaagaattgtatctgaaacaagagaacagtttgacacatttatcatgccttcatattacatattaactgaaaccaattaataaacatatgaaatatccattgcacaaggcaaaggcacctaaaccttttgtttctttttctacatagcagaaattgattttttttttatttttttaggggaacctatataattatgacccagtgatgtcttttggtgacttaagcttatgaattcaggttacaattgagttgattctagatggttactaccttgaaaaggatgttggtgccttatgtgacacgagccagagcctgctgggaataaacaaagcagattcatgccaacaccaactcgtagctttagtggcagatgggagtggtcacagactcccaaaatgtggggctttggatttccacaccatcccacgtgtgtgtcatcttcctctttcacactcttgatgataatttgaaaatggtgaaatcacctctgaatttgcctatagcatgagcacattcttatgacaacataacaaatagttcataatgtgaatattagaaactgttacagcctgcagttaccataattttccatgtttgtggaattgatattgaaatagcagggctaaggaattactggcaagttttagcctgtgggtaataccttagggttatttaaatatttgtaattttatttaaatgttcatgaatgtttgaaaggaacaaaattatcagggatggctctttgccatgggtcttattttcaccctcttttctgtaagaaaaaagaacaatgtcttaatgtatttttaaagtttttggtatagtttctaattccaattttaataaaagttttat

SEQ ID NO: 7400 - DNA, 5370 bp, Homo sapiens
aggtggcttgaggcaaccatggcgggaggaatgaaagtggcggtctcgccggcagttggtcccgggccctggggctcgggagtcgggggcggtgggacagtgcggctactcttgatcctctccggctgcttggtctacggcacagctgaaactgatgtaaatgtggtcatgcttcaggaatcccaagtttgtgaaaagcgtgccagccaacaattctgttacacaaatgtgcttatcccaaaatggcatgatatatggacacggatacagatccgagtaaatagttccagattggttcgagtcacccaggtggagaatgaggagaaactgaaggagctagagcaaagtcaaattttctactactctactgggatgactgtgggaattgtggcctctctgctaatcatcatttttatactatctaagtttatgcctaagaaaagtcccatttacgtcatcctggtgggaggctggtctttttctctgtacctcattcaactagtttttaaaaatttacaagagatctggaggtgttactggcagtatcttttaagttatgtcctcacagttggattcatgagttttgcagtatgttacaagtatgggcccttggagaatgaacgaagtatcaacctgctgacctggaccttgcagctgatgggcctgtgtttcatgtattctggcatccagataccacatattgcccttgccattatcatcattgctctttgtactaagaacctggaacaccctattcagtggctgtacatcacctgcagaaaggtgtgtaagggagcagaaaagcctgttccccctcgtctcctgacagaagaagaatatcggatacaaggagaggtagaaacccgaaaggctttagaggagctccgagaattttgtaacagtccagactgctctgcttggaagactgtttctcgaatccagtctccaaaaagatttgctgactttgtggaaggctcttcccacctcacgccaaatgaagtttctgtccatgagcaggagtatggattagggagcattattgcccaggatgaaatctatgaggaagcatcctctgaggaggaggactcatattctcggtgtcctgctatcacacagaacaactttctaacctaggtagtggtcagttatctttacgtggactggcttggtgccttggtccatgttgcatgtgttgtgcaattgctttcaaccctttgaaacagagtgagatagatagggtagaaattctcctactgaaataagaggcctaaaaaggcctccctttggaaatgggaggtctctatgggatccctgaggaaggagagtggataaagtagtgaatgctgggtagttcacttcccattggttaagctaacagcccacttttatgtttccagagaaattggatggccacagctagcatggcattctagctccttcttgaaagttgattcaatcatggcatttctgtcactggctggctctccaaagtaagaactgttgttaagtgcaggaatgcttttagactataggctgcaacttccagagagaaatccacaaatctgagcctccttcactccagcttttatttcagtgactttagaataattattgatttaactgttttgggaggaaaatagatttttattgttttgttttttaaatgaatgtcttttaaaaaacataacaaactcatgttccagaaccagcaagtgctccagagtgacacaccccctaggcccctacatatttattaatatggattatccattaaagccccaggagctgttgttttaagctttgatttagttctcatacatatgatagaaagtcctatttgcctttaggaacatgcctgtaggctcttctgcaggtgagatgtactgggctttttattatattcaactttcaattccatcttaaaaaacatttgtattcttctcttcccattcttccttaccctgcctttgccctttcaggaagggtcagttcccttacctgtgaactatgtatgttcagagtagcattattcctgctagctaggagaagtcatcttgtttaggggatttggatgctttttatacgttctccattttcctgtcattgggtcatgttatctttgagttgctatgaaatcaggaaactgtctccttttcctttcccttcctttgtctacatgctctgtccattcctttcagccttttctcaccacccatactcccccaaatctgggtaatttttaagccttgaaactatgtagtttcttgatacacaatttgtagttatgcagcagccacaatttgcattgccaggaaataggctccaggttatcttcatgcctctgggtgctcattcagctgtcaagtttccatgaacttacacttatttatgattgcgtttctgacctgagatgtatgctgcctgttattgcagtagcattagtttcagattcttttgccattgcaaagtaccccttataaaccagcaatgtcatctgtgaggaagcaaattctcaagtgtctgtcatttacttggttctttttctttgtggtcttcacccttataccctggaaaagtctgtaattaccttagccaggaagatagatggtcatggcaagcgcacagcaccagacttactggctcaccaagatgatggaaaaaggcagatgattttttaaaaagccgtaatgactcctttagaccagccatttagcgtggtaattttgaaaggcctagctccattgcagacttccaaagggtcagctctgagactgccctccaggtgggcagttgattatttccaccagtgttttccagagccttaaactgtcctaagtgacaactacctcagttggcaggaaagagacatatagtagaaagtgaaaaatgagcagtatttgggcagatgctatgggttacagttgaagggtaaaaggaactttacattgggaaacctttatacccttgtgaattatgtacatggtaaaatgttctctctctacaaagaactattaaaacttctgaaatatactattttttaccttatttatagaaattgagacctagcatatttaagcataagtttattttaaaaaataattcaactcgtgcaagtggtctcaggattctctggagattttggtgcctcccctacttagggaggtgatagcttgcctataagggtgacttttcctgatcatgtctttatttcaatgagaaagcactgtgaaattgtgaaagattctcctctttctctgtttaataaacccccatgaaatatagtttccatctctagaccagttttttttccaccgtgtttagacttgaggtgaataaaatcaaactgttttttactccctatctggtagttggagacctgagctgtaggcagtggagatggcaattggttctgcagcctgagagttgctctcacacagtgaaggacggtgctgctctggtgtgctgtgtgtccttgccctgcctgcctgtggctctgcccagatgcttcagatcctctgtgttccggagattgcttgacttcaaccttctttaggagctgctcttgtctccctcttggccacttagtttgctggctcagtcactacttgaagaccccatttaatttttctctggcagttatagctcttgtgatttcagtacagtctcatctctcagaccaatctcatcaagaaggattgaagggataactatgaggtaagctggacattggagccgtgtttgctgccacgtcagcgtcttgctgggtgaatgtcaagccataaatgggctccagggctctggatctcatcagcattggaaatctattgcctctcatcagtctgaccaaattatgtagagcattaatgtagagactcccattaatgggaatacaagaggcagctggcataaaacatttctttcactttcctttcccactcagattgcttcaagagaccaacagaacacagggatcaaaaacaaggaaaatttagcaacttcattaccttctaataagtaattcctgttagccactgcatcccaccaaaactagtttatttttcccctcaaattcatgatttttacgtctgttacaaagggaattttgctgatagctctttgggtcccactgttccattttatgctaatagattccattctagggcccagccgtctcttgactgatggtgttccctttaacccttggcatgtataatagaattttggtgaatgaaagaacccaaataggccagatagtccccccaggccctgatatccataaaaggcttgggaatgcattatgtaattgtccttagtctttttgttgttttagaaaaaaaaaacaagatgggctcagatggatgcctacgtaaaaatggttcctagctgtgtactcataacttttctttgaattgagtagtgaaaggaaggaggaggaaaggaaattaaatgtccttctagtattctctggactcaagtctgacatatgagataataacctatattgaaatgccaagaattgtatctgaaacaagagaacagtttgacacatttatcatgccttcatattacatattaactgaaaccaattaataaacatatgaaatatccattgcacaaggcaaaggcacctaaaccttttgtttctttttctacatagcagaaattgattttttttttatttttttaggggaacctatataattatgacccagtgatgtcttttggtgacttaagcttatgaattcaggttacaattgagttgattctagatggttactaccttgaaaaggatgttggtgccttatgtgacacgagccagagcctgctgggaataaacaaagcagattcatgccaacaccaactcgtagctttagtggcagatgggagtggtcacagactcccaaaatgtggggctttggatttccacaccatcccacgtgtgtgtcatcttcctctttcacactcttgatgataatttgaaaatggtgaaatcacctctgaatttgcctatagcatgagcacattcttatgacaacataacaaatagttcataatgtgaatattagaaactgttacagcctgcagttaccataattttccatgtttgtggaattgatattgaaatagcagggctaaggaattactggcaagttttagcctgtgggtaataccttagggttatttaaatatttgtaattttatttaaatgttcatgaatgtttgaaaggaacaaaattatcagggatggctctttgccatgggtcttattttcaccctcttttctgtaagaaaaaagaacaatgtcttaatgtatttttaaagtttttggtatagtttctaattccaattttaataaaagttttatagata

SEQ ID NO: 7401 - DNA, 3975 bp, Homo sapiens
gaggaagaggacgacgacgagggagaagaaacccagacggaaagaggccatcagacaaggtcgctttttctggcgacaaagcaactgcaaggagcgtggtgctgaatatcatccgcccgctctgcctggggacccagagacttgcagaagcacttcgcattgccacgaaaacaaaggagaggtgacgaacgggagagggagagagaaactcggagcggttccctttggatctccgggaagcaaagctcctctcctcggcaataaaacagaagggaccctgtgaaagggtctagtaggctgaggagggcgcgggtttccctgcggagatttgggacgcggcagaactctggacagcgcctggggagcaaggctcggagctccctgggctcctccaggttttccgctgcttaaaagccccggtaccggtgtgcaatcttcgcaccaccgaacccaggaagatccttctacgatccctatctgaacgtgccagggggtggagcagctcctttgcctctggcccagccagggaaggtcttcgtttctggaaatccagcccttgtggataatgcctcgctcttgaagaaagaaaagttttgggatctggtagggggtggaaggggtaaggaggatagtggaagaaaaaaaggtagatggttgatttccctctctgatctggaaggaagatgaccgaggaaggatgtgcaccagcggtcagattattgggagcctcttggtgctctccgtgctggagatagggctgggggtgtccagcgtggccgtgggggcggtcagcttcagcctggccctccgagagcacaagccgcagctcggagactcgtccccgtttcttctttgtggcatttgtggaatattgtgtgccaaaaaaaaatcaggacttgtcatgatcctcttttcagcctgctgtatctgtggacttattgggggcatcctgaattttcagttcctccgggcagtcacaaagaaaacttcctccctatacccactgcaccttgcctccatgtctctcgcgtgcattgggatcgggggctgcactctctcttcctggctcacttgtcgactagccagttatgaacagaggaggatgttctcagaaagggagcattccctgcatcactctcatgaaatggctgagaaagaaataacagacaacatgagcaatggaggaccacagctgatatttaatggaagagtgtaatcaatgttttaaagaattgaacactttttaggattttcatgaggcaatgagacaccaaaggactagaaaataaaacagtttttgcatttgcatttatctctcctgagcatccactaaaattattcttcctaaaaaatatattgcctcactggtttctccacccttttttatggggtaaaaaactttccagaaacattctagtacaataatttcaagaggctttccagattgttctaaagaagacttttcaggaaaaagagataataaaacagaaataaaatgcatattctatacaaacactatttgactagcatgattattatatttgtaatgacatatttcatatgagtaattgaaaagtgcaaatatcaagaaataaaaataacttattgacgtctttgttctgaaagacagatggcttcaaggatgctacaattcaaaacctcagtaatgccttgttataaaaacattgtaattattttcaacttgtgaatgaaatatatttcataatttatttgtaaatgacaaaaaacctcaagcataaaaaagagactttttagagagagagaatactaatctatatggtatttttgcatttttgcacaaagagtgaaaagttatatgtgaatatcatttaagaaaataaacatgttttgatcatactgtgcagattgatctgcatgttcatgaatgagcctaagaataaagtatgtgtgtgaatgtgtgtatacatactgtaaatatagaacatgtatacagcatatattatagcatacatgaatgtaaataggtattagaaaagaaattgtgatgctgtgggggtattattaagattctactccaatagaaatgggaaggcaattgctcaaggcccttctatgcccacaaaatcacatgtttaatttctactaaaattgcccatttttcttcttttaattaggttttgtgtaaatatcattgtgggtgatatttatgaagatgagtgatctgaatagtgtagtatacagatagactacttatttgactatttcactatgattatagtatttatgtatagcaattaaaattaatttataaacgaacatgactttaatgacatacttccgtatttataaagatatcatgacttaaaattattgatgatattgatatttcaaacaccttgcagtccagttaaatgatacaaaagggcagatgatgtaaccccccaacaatgaagttataattacctttgctgtaatctaatttaggtgttttgttttacgattctcatgaaataatataggcagtccatatataagaaagcctatatccaaagatcctgaaagaattctttgaggaaaaagtgaaaagataggctaacatttgtatagctagattcaatcctttcctctaataatggaatgttaaaatagcaaacaagaacaacacatataagtgaaaaaacaacatatatctgaatatatttatcagaatataacctctggcaacagacaaagaaatctatcatttttaaatacataactctcactatattgtatacttttctttttcctcaaatctaatcaattttcaagtcattttttatgagttacttgttgaaccataggtaaattaaaatatttactgttcagtatgagaatataatttataaacaaaacatgagttttaattgtgctaacacagtaatgatcattcaagttaatgaaaatttgaaggtcttttatagcaacatgatcatcgtttaacctatttaaatcagctcacttaaaattctggctgtcatctattcaacagaaataactggactctgcttgtttggtgcactttttgaagtctcccaattcctttggataacttcattgcctagtagattacagaagttgtccataaatgcaacctcatatagtgaatcaacatcataactattcattcaatgccacaaacaggcatgatctttgccaatgaaaatctaaattacatcatgaagatatttgtgtgtgtatggtcctcctgaattcatgcaaggatgtagttttgtactgaaagaataaacactgactctaattttcagtagcatttctctataaacatgcttgttcaatacaaaattataatacatcagaaaaatgttgtaatgccttttgaactgatctataacataacacattaaaggacaaaaggagacatatcactgctttgatgtatagttaaaaagagatgccatcatcacaattattcaaatagtttacagtgtatgtttaaccaagtatagatatatttttaaatatgattatttctacctagtattttcagaattgagtttagaatgatttacttgggatgtgcggcgattcttttttagataagtgggggatgttaggaagacattgttcaagtgcttgaaactttaatttggacaatacattgaaccacatgctggaatgttttaagtgactaccttatagttttagtatgagcctacccttggaagaaagtaaggtgatactaaattagaaaaactatgtgaaactggagtggtggtatactttggaccatatcaaataggtagagtattataagcataaaagaataaaattgggctcgctttggaaattttaaacatatatgtgtatgtgtgtatatatatgcatatacatacacatatgtgtatatacacacacacaatggtttggaagtggaacaggaaatgataactctactgacatgtctataataaaatgatgtgctttgaaact

SEQ ID NO: 7402 - DNA, 768 bp, Homo sapiens
agcccagaaaggagccacggggagaagcggagtttcttctttgtggcatttgtggaatattgtgtgccaaaaaaaaatcaggacttgtcatgatcctcttttcagcctgctgtatctgtggacttattgggggcatcctgaattttcagttcctccgggcagtcacaaagaaaacttcctccctatacccactgcaccttgcctccatgtctctcgcgtgcattgggatcgggggctgcactctctcttcctggctcacttgtcgactagccagttatgaacagaggaggatgttctcagaaagggagcattccctgcatcactctcatgaaatggctgagaaaattgagggctattgaaataaccgacttgcccagctgcccggtggtgcccccgacaccagagttacctacaaggaaataacagacaacatgagcaatggaggaccacagctgatatttaatggaagagtgtaatcaatgttttaaagaattgaacactttttaggattttcatgaggcaatgagacaccaaaggactagaaaataaaacagtttttgcatttgcatttatctctcctgagcatccactaaaattattcttcctaaaaaatatattgcctcactggtttctccacccttttttatggggtaaaaaactttccagaaacattctagtacaataatttcaagaggctttccagattgttctaaagaagacttttcaggaaaaagagataataaaacagaaataaaatgcatattctat

SEQ ID NO: 7403 - DNA, 2393 bp, Homo sapiens
ctccccgcagagcagagccagcggcccgagccgaatccccggagccgcgcctcgattcccctccagcagctgctctgggctgcgcagggttcttgcgctcggcactggagcctcagccgcggccgcagctgtccgacgtgtcactgcaagggccccgcccccggggtggggtctcgggctctcgctaccggagagggaggagaagggggaggttaaaggggaaggacccccggaagtgccccctcctcagtgcgggagagggagacgccgggggcggagtcccctgcctcccgcggcgtggttggtgcgtcccatgtgacgtcagaagcagcccgcccctgcctggatggcccagcccgagttcccggacgccgcgggactggagtgccagccggtgttggacgtggagcggcgccgccaccgcgccgacaccattctctccggcccagcagcccccttcctcgcacgacggactttccctggaccccagtcagttggagcctctggcgccccgcaaccccggcccctcgggcctctgcacagcctctttcactcagaagctcaggtcgcctccagcccagcactatgccggggactgtggcaacactgcggttccagctgctgccccctgagccagatgatgccttctggggtgcaccttgtgaacagcccctggagcgcaggtaccaggcactgccggccctcgtctgcatcatgtgctgtttgtttggagtcgtctactgcttcttcggttaccgctgcttcaaggcagtgctctttctcactgggttgctgtttggctcggtggtcatcttcctcctctgctaccgagagcgggtgctagagacacagctgagtgctggggcgagcgcgggcatcgctctgggcatcgggctgctctgcgggctggtggccatgctagtgcgcagcgtgggcctcttcctggtggggctgctgctcggcctgctgctcgcagctgctgccctgctgggctccgcaccctactaccagccaggctccgtgtggggtccactggggctgttgctggggggcggcctgctctgtgccctgctcactctgcgctggccccgcccactcaccaccctggccaccgccgtgactggtgctgcgctgatcgccactgccgctgactacttcgccgagctgctactgctggggcgctacgtggtggagcgactccgggctgctcctgtgcccccactctgctggcgaagctgggccctgctggcactctggcccctgctcagcctgatgggcgttctggtgcagtggagggtgacagctgagggggactcccacacggaagtggtcatcagccggcagcgccgacgcgtgcaactgatgcggattcggcagcaggaagatcgcaaggagaaaaggcggaaaaagagacctcctcgggctcccctcagaggtccccgggctcctcccaggcctgggccaccagaccctgcttatcggcgcaggccagtgcccatcaaacgcttcaatggagacgtcctctccccgagctatatccagagcttccgagaccggcagaccgggagctccctgagctccttcatggcctcacccacagatgcggactatgagtatgggtcccggggacctctgacagcctgctcaggccccccagtgcgggtatagccatatctgtctgtctagactctgcagtcaccagctctgccagctcgaggaggcctgctaggctgccactcagcctcctggctttggctgtccctctccccagcctggagagggctggcctggtcactagaagggaggattgtctcaggcgagtcttggcctgagaggaaagccccctcccaagctcccaagaggctcctgaggaactcggggtgtgaaccccattggggtgtgctcagggttgtgagtgtgttgcccgtgtgtctgtgtgtatgtgtgtgggggtgggcaggcttggaggggacgctgggacccttgccttagatttctgactggtagggtttctccaggctcagccccacctcttcactccctgccaaggtcccatgggccacctcctgcatgtctccgcggaggggctaccttccttcccatcgccctgcctcgcagccagactcatctaagggttcttgtccttgtctatggggcaaactgtagcatccctcaccctggtcccctggcctctgtaaagccaccagcctgagggcagtggcaggagatgggggtgggggggtgctgctctgggctgggttgggaagggagttggggaggggtttaaatgcacggtgcatgtctggtgtctgtcatgccaacctagacacctcatgcttctgtctcccccaccccactctgttttacatcttttataaatgtgccaaactgtg

SEQ ID NO: 7404 - DNA, 2218 bp, Homo sapiens
gtgacgtcaggagcagaggccggagctgtccatcagcaccaaaggccgcgggcgggctcagggcatggggccgcggttctggggcggcccgagccccggctcctgcgccttccccttcctcaggcccagcccgagttcccggacgccgcgggactggagtgccagccggtgttggacgtggagcggcgccgccaccgcgccgacaccattctctccggcccagcagcccccttcctcgcacgacggactttccctggaccccagtcagttggagcctctggcgccccgcaaccccggcccctcgggcctctgcacagcctctttcactcagaagctcaggtcgcctccagcccaggttaacttgggagggtgactcccttctattcccagcactatgccggggactgtggcaacactgcggttccagctgctgccccctgagccagatgatgccttctggggtgcaccttgtgaacagcccctggagcgcaggtaccaggcactgccggccctcgtctgcatcatgtgctgtttgtttggagtcgtctactgcttcttcggttaccgctgcttcaaggcagtgctctttctcactgggttgctgtttggctcggtggtcatcttcctcctctgctaccgagagcgggtgctagagacacagctgagtgctggggcgagcgcgggcatcgctctgggcatcgggctgctctgcgggctggtggccatgctagtgcgcagcgtgggcctcttcctggtggggctgctgctcggcctgctgctcgcagctgctgccctgctgggctccgcaccctactaccagccaggctccgtgtggggtccactggggctgttgctggggggcggcctgctctgtgccctgctcactctgcgctggccccgcccactcaccaccctggccaccgccgtgactggtgctgcgctgatcgccactgccgctgactacttcgccgagctgctactgctggggcgctacgtggtggagcgactccgggctgctcctgtgcccccactctgctggcgaagctgggccctgctggcactctggcccctgctcagcctgatgggcgttctggtgcagtggagggtgacagctgagggggactcccacacggaagtggtcatcagccggcagcgccgacgcgtgcaactgatgcggattcggcagcaggaagatcgcaaggagaaaaggcggaaaaagagacctcctcgggctcccctcagaggtccccgggctcctcccaggcctgggccaccagaccctgcttatcggcgcaggccagtgcccatcaaacgcttcaatggagacgtcctctccccgagctatatccagagcttccgagaccggcagaccgggagctccctgagctccttcatggcctcacccacagatgcggactatgagtatgggtcccggggacctctgacagcctgctcaggccccccagtgcgggtatagccatatctgtctgtctagactctgcagtcaccagctctgccagctcgaggaggcctgctaggctgccactcagcctcctggctttggctgtccctctccccagcctggagagggctggcctggtcactagaagggaggattgtctcaggcgagtcttggcctgagaggaaagccccctcccaagctcccaagaggctcctgaggaactcggggtgtgaaccccattggggtgtgctcagggttgtgagtgtgttgcccgtgtgtctgtgtgtatgtgtgtgggggtgggcaggcttggaggggacgctgggacccttgccttagatttctgactggtagggtttctccaggctcagccccacctcttcactccctgccaaggtcccatgggccacctcctgcatgtctccgcggaggggctaccttccttcccatcgccctgcctcgcagccagactcatctaagggttcttgtccttgtctatggggcaaactgtagcatccctcaccctggtcccctggcctctgtaaagccaccagcctgagggcagtggcaggagatgggggtgggggggtgctgctctgggctgggttgggaagggagttggggaggggtttaaatgcacggtgcatgtctggtgtctgtcatgccaacctagacacctcatgcttctgtctcccccaccccactctgttttacatcttttataaatgtgccaaactgtgtggcctctgccaggaa

SEQ ID NO: 7405 - DNA, 1057 bp, Homo sapiens
tggatggtgcgccctgagtgacgtcaggagcagaggccggagctgtccatcagcaccaaaggccgcgggcgggctcagggcatggggccgcggttctggggcggcccgagccccggctcctgcgccttccccttcctcaggcccagcccgagttcccggacgccgcgggactggagtgccagccggtgttggacgtggagcggcgccgccaccgcgccgacaccattctctccggcccagcagcccccttcctcgcacgacggactttccctggaccccagtcagttggagcctctggcgccccgcaaccccggcccctcgggcctctgcacagcctctttcactcagaagctcaggtcgcctccagcccagcactatgccggggactgtggcaacactgcggttccagctgctgccccctgagccagatgatgccttctggggtgcaccttgtgaacagcccctggagcgcaggtaccaggcactgccggccctcgtctgcatcatgtgctgtttgtttggagtcgtctactgcttcttcggttaccgctgcttcaaggcagtgctctttctcactgggttgctgtttggctcggtggtcatcttcctcctctgctaccgagagcgggtgctagagacacagctgagtgctggggcgagcgcgggcatcgctctgggcatcgggctgctctgcgggctggtggccatgctagtgcgcagcgtgggcctcttcctggtggggctgctgctcggcctgctgctcgcagctgctgccctgctgggctccgcaccctactaccagccaggctccgtgtggggtccactggggctgttgctggggggcggcctgctctgtgccctgctcactctgcgctggccccgcccactcaccaccctggccaccgccgtgactggtgctgcgctgatcgccactgccgctgactacttcgccgagctgctactgctggggcgctacgtggtggagcgactccgggctgctcctgtgcccccactctgctggcgaagctgggccctgctggcactctggcccctgctc

SEQ ID NO: 7406 - DNA, 3106 bp, Homo sapiens
cgggcggaagtccgggttggggtcacctgaccggagagccggctagatatggcgtcctctttgcttgcgggcgagcgattggtgcgtgctttgggccccggcggggagctggagccagagcggctaccccgaaagctgcgggccgagcttgaggccgcgctggggaagaagcacaagggcggtgatagctccagtggcccccaacgcttggtttctttccgtctcatccgggatctgcaccagcatctgagagaaagggattccaaactatacctccatgagctcctagaaggcagtgaaatctatctcccagaggttgtgaagcctccacggaacccagaactagttgcccggctggagaagattaagatacagctggccaatgaggaatataaacggatcacccgcaacgtcacttgtcaggatacaagacatggtgggactctcagcgacctgggaaagcaagtgagatcattgaaggctctggtcatcaccatcttcaatttcattgtcacggtggttgctgccttcgtctgcacttaccttggaagccaatatatcttcacagaaatggcctcgcgggtgctagctgcattgatcgtcgcctctgtggtgggtctggccgagctgtatgtcatggtgcgggcaatggaaggcgagctgggagaactgtaactggtgcttcatcatcaagtctagagaagactttgggggcttcaggctccaattggcagtcaccgactcagtcaacccatcagactttttgtattcagctccagttagtcagaagaccagcccaggccagctgctgtttctgtggggagccctaatcttctgtgaatttccaaagggagcattggaggagattgagataacacatctttaaaacagaaagaactggtcttggtctatcagtacctcttcctgaatctggtacccatctgccttctccagttcattctaaacactgctgggactagggtttttccatcaggagcaaatggaatccaggccttcccagaagtagaccatactgccttgaacttgtccatatgtacaaactgatcaccagctttctccatacatttttaatgcagacctgtaattgagttcagaagcctccaagaaaacagaaaggatcccctttctccagtttgtgctggaagaggagctgatcagagacatcaaataagagaaagatgggttgctagaggatggtagaactggaagcaaggcagctacctttttgcaaaaggaaatggtgttaggccccttttccagaagataagacagactcatagagattaaatgatcactatggtccttcttctgttaaatggagccaaagacgcctatgttgttctgaagtcttgtaatgtttaacttctgagaacttagattagtggtgtgatgatagagtctgtataacgcattgaaaagggtatcaggcttagttatttatccaataaatatttattgtatgcagggtattcctattttaactcctgtgacaacacaaagcatagcgatttccatagttctaactgttcagggtctgctcctcctggtacactctttttggttcactgtatgtactcctgttgtctttttttttttttccaaagcacttttctgttttcataaattatatactcattcactcagtggacacttcctctacaatgtttgccagtttctgttagttgggagaagtgtcagctgtgaaaagaaaaagtaggtggcattttacagtgtttccagtaacctgagctatataaaatttgtgttaaaaagctacactgggccaggtgaggtggctcacacctgtaatcgtagcattttgggaggctgaggcaggcggatcacttgaggttgggagtttaagaccagcatggccaatatagcgaaaccccatctttactaaaaatacaaaaaaattagccaggcgtggtggtacatgcctgtaatcccagcactttgggagaccaaggtgggaggatgcttgagttcaggagtttgagaccagcctgggcaacatggcaaaagcccatctctacaaaaaaacgcagaaattagctgacatggtagcgcacgcctgtagtcccagctactcaggaggctaaggtgggaggatcacttgagcctgggaggcagaggttgcagtaagctgagtaagccaagatcatgctattgcactctagcctggatgacagagtgagaccttgtctcaatgaaaaagcagggggcactgggaggggagaaccaaatgccctatcctccagttctcagcatatagaagggagctctctcatctgctagccactcctgcctcactgtgccatgctttctgtaatgcactctgggtccagggactgcttggcaggaggtgggaagaacaagaagtttagggccttcccagtttcttagggcctgtctggagagggaactagcgtttactgagtttttacgatgtgttacacaccatgtaaagccctttacctacattatttcttataccccaaacagagagcaaataagtatccccattttttagtcacatagagttccagagttgccacagttacatcgcaaagtcaggatttgaatccagtgcagaccgcaaacaccatggttttctctccaaagcagagcagctccagaggtggaggtgactggaatgtcctagattcagtgggaccaggagctgggggtgctagcagaggctctcatctccccagggtcttgtcagtcagagtcctaaacccttcaattaactatccctctaatcccagctgaagcctgggtaatacctcccaccaagaggtatctgtgtggaacctggccctatttagggattaggtgatggagataaatttccatggcaaacggccctcgtccccgttcgtttgcagagcacaacaatccagattaaggtacagagtttgggttttatttggagattagttggtattacaggtgatggtgataccaaaacccaatgctgctatacctgcctccatcccagatctgtcaggttgtctccacagccccacatcagagggcatccaatctgatctttgtgaaaattaaatcaacataagcccca

SEQ ID NO: 7407 - DNA, 1050 bp, Homo sapiens
acctgaccggagagccggctagatatggcgtcctctttgcttgcgggcgagcgattggtgcgtgctttgggccccggcggggagctggagccagagcggctaccccgaaagctgcgggccgagcttgaggccgcgctggggaagaagcacaagggcggtgatagctccagtggcccccaacgcttggtttctttccgtctcatccgggatctgcaccagcatctgagagaaagggattccaaactatacctccatgagctcctagaaggcagtgaaatctatctcccagaggttgtgaagcctccacggaacccagaactagttgcccggctggagaagattaagatacagctggccaatgaggaatataaacggatcacccgcaacgtcacttgtcaggatacaagacatggtgggactctcagcgacctgggaaagcaagtgagatcattgaaggctctggtcatcaccatcttcaatttcattgtcacggtggttgctgccttcgtctgcacttaccttggaagccaatatatcttcacagaaatggcctcgagaccgcgtggcgcgcattgggctgggcgtgatcctgaacctggcgaaggaacgcgaacccgtagagctggcgcggagtgggtcaggcatcttggagcacatgttcaagcattcggaggagacatgccagaggctggtggcggccggcggcctggacgcggtgctgtattggtgccgccgcacggaccccgcgctgctgcgccactgcgcgctggcgctgggcaactgcgcgctgcacgggggccaggcggtgcagcgacgcatggtagagaagcgcgcagccgagtggctcttcccgctcgccttctccaaggaggacgagctgctttcgctgcacgcctgcctcgcagtagcggtgttggcgactaacaaggaggtggagcgcgaggtggagcgctcgggcacgctggcgctcgtggagccgcttgtggcctcgctggaccctggccgcttcgcccgctgtctggtggacgccagcgacacaagccagggccg

SEQ ID NO: 7408 - DNA, 3512 bp, Homo sapiens
ccaaagatgggttttgtctgcgggtgatttgggctctcgaagtgcaactttgtggccgggacgcggatcggccggcctgggctcctgcagagcagatcctgtctgcgtcctccaggaggagtgggtggcaggactggggtttcccacaggttttggggcggcggcgagattggcacggtccggggtcgcaggcgcgcagccacgcccctggaagtccgccccggcccccgcccccaacccgcctcttcggggctttatggcgtgaggtttggggctgggatccatctggagccgagcagaaaacttttcccctcccgttcccggtcccttttgtctttcttggacgcggtggcggcgccgcctgagcggcgactccctctcccctgcccggcttgctgcgcccggtgccctccgagggcaggcgcgcctggactctgcgcccggatggcggcggccctctgtgagcaccggcagcggcgcatcccctgccccgaggcctccggtgcccccccggcgcgggcataggggcgcccccaccctccgtccgcttgcaccccttgccacccgccccctcgcctgactcatccgcccgcggtggccgcccgagccctgggatggggagggagaccgcggctgcccgcggcggccgagattcccgctgacgcccccgaccctgccgccttcttcgtccgcctccagaggcgcccgacgtcccgacagctcctggagtgagaccaggactgagaacagggagaggcgacccgacccccagggcccggtgctcaggacagcacacagagccgctgaaaacgactgaagagagcaagggatttcctgggacatctggctctggagagtaaaaggccaagctatgatagcaactggtggagtgataactggcctggccgccttgaaaaggcaagactctgccagatcacagcagcatgtcaacctcagcccgtctcctgctacccaagagaagaagcccatcaggcgccggccccgggcagatgttgtggttgttcgtggcaaaatccggctttattccccatctggtttttttcttattttaggagtgctcatctccattataggaattgctatggccgttcttggatattggccccaaaaagaacattttattgatgctgaaacaacactgtcaacaaatgaaactcaggtcattcggaatgaaggcggtgtggtggttcgcttctttgagcagcatttgcattctgataagatgaaaatgcttggcccattcaccatggggattggcattttcattttcatttgtgctaatgccattcttcatgaaaaccgtgacaaagagaccaaaatcatacacatgagggatatctattccacagtcattgacattcacacgctaagaatcaaggagcaaaggcaaatgaacggcatgtacactggtttgatgggagaaacagaagtaaaacagaatgggagctcctgtgcctcgagattggcagcaaatacgatcgcctctttctcgggttttcggagcagttttcgaatggacagctccgtggaggaggatgaacttatgttaaatgaaggtaagagttctgggcatcttatgccccctttgctctctgacagctctgtgtctgtctttggcctctatccacctccttccaagacaactgatgataagaccagcggctctaagaaatgtgaaaccaagtcaattgtgtcatcgtccatcagtgcttttacattgcctgtgatcaaacttaataactgtgttattgatgagcccagtatagataacatcactgaagatgctgacaacctcaaaagtaggtcaaggaatttgtcaatggattcccttgtggttcctttgcccaacaccagtgaatccttccagcccgtcagcacagtgctaccaaggaataattccattggggagtcgttgtcgagtcagtacaagtcatctatggctctcggacctggggctggacagctcttgtctcctggggctgccagaagacagtttgggtccaatacatccttgcatttgctctcgtcacactcaaagtccttggacttagaccggggtccctccactctaactgttcaggcagaacaacggaaacatccaagttggcctaggttggatcggaacaacagcaagggatatatgaaactagagaacaaagaagacccgatggataggttgcttgtgccccaagttgccatcaaaaaggactttaccaataaggagaagcttcttatgatttcaagatctcacaataatttgagttttgaacatgatgagtttttgagtaacaacctaaagaggggaacttctgaaacaaggttttaatgttaaaagaatatatcattttacaagggtatatattttaaaacgattttcactggtgtttccttcttaaagtattggctgtaagcctttttaatcaaatggtttgtagtgtattagaattggctgcttagttctgtaatgaagatggttgtatgtttgggttacttgtgactgcagtactctatgttaccacacatgattttatttttctcttcctttgaaagcatgatctcttttattaatatgaatgcaaaatgcttgcatccaaattaaagcttattttctttacttttaagttctttgattgccctattcataaaatgaaatgtccagtatggaaaacatagggtaccaaagtgtggaccaggagtacaaattcagtcccaatactcaatacgtattatagatgactatgagtgcaaaccttaggatgtgattttctgaataattgttctttgtaggatttggttacattatttaaaatgaaaaagatctagttttagtgtgagctcagtaatgttaattggttaagttcattgtgaatcttgagttttagataagtagttatttttttcaatatcacttctgtttttagtgatattatatcaagaaacaacgtattcaagagccatggctgacagtgccagatatacttagggataaacatcaaaatgcaattatagttgctataacgttagatactcggaatcaaaatttatttgcaagctgacttgataaactaaatgaaccaataaaatttgtagaaatgctatcctgaaataattatatacatgaagacaatgttgactaatgaattaagatacattatatactagttaatgctaactagtctcagtacctgtttttagccatctgttactgtccaatagcacctcattcccacattctattttcccccggtattctttagatcctagtatttggaaaacaatcggctaaccttgacatttctttttaccttcatatgccactatctcggtagttcaaaaaaatttagttcttgataaattgccttgaagtttaccttgtgctggagagccttatgataactccaaagactttcttacggtataatacatgttgtttaggattgtgtttcttagtcactgaagataataaatattaaaatggatgttttcatcag

SEQ ID NO: 7409 - DNA, 5017 bp, Homo sapiens
gcaagcatttaggaatagcatttgccaactcccaagacttggctgtccctctcgctctggccttacttacctaactgacctcctgtagtactgagttgtgtgctggccaagttcctattcctggactgctttctttcccttgaccttccttgaaatactgctaacctgacttttgactgtgatctatgtgctatctcctgtgtgaagcctaatgaaaggtccttctctaatggaaactttcattctaggagttacctcattctgttttatgtggatctgttagctccttcattaggtttcaagctgtttgaaacagtgattgaatttgctcacctttgctttcctctcagggtctacattgggaccctgagtgataatagagccttctgtagtattgaattgctttaaacagaattaaaggacattggcaccaaatgtgattttgccaatccttgggagtcttggtgcctctgtctgggcttgaccagggtagaatggctgaagaaaatgtgattcctccacccattaaattctttatttctcaactactctggaagtttttgcctctttttgtttctatccattttcatacttttaagatacccttttttactttaagataccttttttcttcctaacgtttctttacatgctcacatgcaagcccagtcatccatctctctttttcacctttctgtcctcatatatttttcttaaaatatcttttctcatctaatctcctttcctctatcaatcagcctcctaagcgaaaatggtagtgctaatgttttaaaaagtgggggaggactagaaatctgtatggaatgtaattcacttttattgcttttaaattaaatgaaacgtttttgcccttgtttccattctactcagaaggatttcagactaaatccttaagcctgccatatggaaataactgggctagagggctgctatctaatctaagcatttaattcaaacatttgaaatggtttttgcttcaagaaaacataggttgacactaagctttattttagcaaaggtttgggaaaggttctaatctgcagtatgtacactttgataaatttcatagactagagcaacagattacaatttagtttgttcttccaacataaaactattttaatcctagttataatttcactgaaggctggatttactcactggcttgttaaaactgtagataacaaccacaagcctgttatttaaacacaattcagaaatcataaatagaaattcaaaaggagagctcaatgctgcaagatgagatttgatgccctgaagaaactctctctgaaatttgccaaagaccttgtggaacttaaaatatcttcttgtttcctaccagctagatatggcagcttgagaactatttattatgaatcaagatagatattttaccaactcagaaaatgttgctttttgtttggatattaatcttgtttgttcatatttttaactaggaaagttagtacagtaatatggtggtcatccaacagaccacaagaagagaatttgtccctcattcagcattttagcaaatatttcttgaacactagccatgtgcaaggtattacagtgagtgtttctgctaataaaaatatgaattaaatttgatgtttgatcataagtagaagaactgtgatactataatattgtaagtgccatagaaaacttgctattataaaatgctgtaaggagttaatgcttgcatagggtgcagtgggtcagctagagaaggctttataaagaaagtggaatatgagctttgatgcctagccagatgtgggtatgtgaagaacagggcagggcagtggggagtgggtggattctggacagctgaaacattgttaacaaaatctcagaaatggtacaaaatggaatatgaatgagaaatacagaacatttgttaggttttatttttatgcaaattaaagagaagagttagagacaaagttaaagtcaatgggtctagaatttcagctaaaactttggtaggtagtggagaatattttatcattattctgctctttaaacaacttcagagatgattgattaatcttgattgtaaaggaagagaaattctttggaagaccagttagggggttatcatatggtctagtaaaagttaataagatctgcacaaggctgggaagagtaggattagaacagaggggtggaattaaaggacatcgtatattggaaatttctaggatttagaacctgattggaagaggaagaagaaagggaggagttaaaaataactgtaaagagccaaatctgagaactgaccctgctaaaaaagtcagacaagtcaagtggtgcagctggtgtgtgctagaagagtaaaaggccaagctatgatagcaactggtggagtgataactggcctggccgccttgaaaaggcaagactctgccagatcacagcagcatgtcaacctcagcccgtctcctgctacccaagagaagaagcccatcaggcgccggccccgggcagatgttgtggttgttcgtggcaaaatccggctttattccccatctggtttttttcttattttaggagtgctcatctccattataggaattgctatggccgttcttggatattggccccaaaaagaacattttattgatgctgaaacaacactgtcaacaaatgaaactcaggtcattcggaatgaaggcggtgtggtggttcgcttctttgagcagcatttgcattctgataagatgaaaatgcttggcccattcaccatggggattggcattttcattttcatttgtgctaatgccattcttcatgaaaaccgtgacaaagagaccaaaatcatacacatgagggatatctattccacagtcattgacattcacacgctaagaatcaaggagcaaaggcaaatgaacggcatgtacactggtttgatgggagaaacagaagtaaaacagaatgggagctcctgtgcctcgagattggcagcaaatacgatcgcctctttctcgggttttcggagcagttttcgaatggacagctccgtggaggaggatgaacttatgttaaatgaaggtaagagttctgggcatcttatgccccctttgctctctgacagctctgtgtctgtctttggcctctatccacctccttccaagacaactgatgataagaccagcggctctaagaaatgtgaaaccaagtcaattgtgtcatcgtccatcagtgcttttacattgcctgtgatcaaacttaataactgtgttattgatgagcccagtatagataacatcactgaagatgctgacaacctcaaaagtaggtcaaggaatttgtcaatggattcccttgtggttcctttgcccaacaccagtgaatccttccagcccgtcagcacagtgctaccaaggaataattccattggggagtcgttgtcgagtcagtacaagtcatctatggctctcggacctggggctggacagctcttgtctcctggggctgccagaagacagtttgggtccaatacatccttgcatttgctctcgtcacactcaaagtccttggacttagaccggggtccctccactctaactgttcaggcagaacaacggaaacatccaagttggcctaggttggatcggaacaacagcaagggatatatgaaactagagaacaaagaagacccgatggataggttgcttgtgccccaagttgccatcaaaaaggactttaccaataaggagaagcttcttatgatttcaagatctcacaataatttgagttttgaacatgatgagtttttgagtaacaacctaaagaggggaacttctgaaacaaggttttaatgttaaaagaatatatcattttacaagggtatatattttaaaacgattttcactggtgtttccttcttaaagtattggctgtaagcctttttaatcaaatggtttgtagtgtattagaattggctgcttagttctgtaatgaagatggttgtatgtttgggttacttgtgactgcagtactctatgttaccacacatgattttatttttctcttcctttgaaagcatgatctcttttattaatatgaatgcaaaatgcttgcatccaaattaaagcttattttctttacttttaagttctttgattgccctattcataaaatgaaatgtccagtatggaaaacatagggtaccaaagtgtggaccaggagtacaaattcagtcccaatactcaatacgtattatagatgactatgagtgcaaaccttaggatgtgattttctgaataattgttctttgtaggatttggttacattatttaaaatgaaaaagatctagttttagtgtgagctcagtaatgttaattggttaagttcattgtgaatcttgagttttagataagtagttatttttttcaatatcacttctgtttttagtgatattatatcaagaaacaacgtattcaagagccatggctgacagtgccagatatacttagggataaacatcaaaatgcaattatagttgctataacgttagatactcggaatcaaaatttatttgcaagctgacttgataaactaaatgaaccaataaaatttgtagaaatgctatcctgaaataattatatacatgaagacaatgttgactaatgaattaagatacattatatactagttaatgctaactagtctcagtacctgtttttagccatctgttactgtccaatagcacctcattcccacattctattttcccccggtattctttagatcctagtatttggaaaacaatcggctaaccttgacatttctttttaccttcatatgccactatctcggtagttcaaaaaaatttagttcttgataaattgccttgaagtttaccttgtgctggagagccttatgataactccaaagactttcttacggtataatacatgttgtttaggattgtgtttcttagtcactgaagataataaatattaaaatggatgttttcatc

SEQ ID NO: 7410 - DNA, 1817 bp, Homo sapiens
agtggctctcaaacctcagcaggcatcagaatcacctggaggacttatgaaaccagtttgctgggcccgcttggtccagcgcttctgattcagtagggagaagtggaaccatgaatttgcattcccgacaagctcacaggttataccagtgttgctggcccgaggattgtattttgggcagcattactccatctgaactcttcttgttctcttacctccttacgtcccaagactcgcggatgttagtttattctcagagtaaaaggccaagctatgatagcaactggtggagtgataactggcctggccgccttgaaaaggcaagactctgccagatcacagcagcatgtcaacctcagcccgtctcctgctacccaagagaagaagcccatcaggcgccggccccgggcagatgttgtggttgttcgtggcaaaatccggctttattccccatctggtttttttcttattttaggagtgctcatctccattataggaattgctatggccgttcttggatattggccccaaaaagaacattttattgatgctgaaacaacactgtcaacaaatgaaactcaggtcattcggaatgaaggcggtgtggtggttcgcttctttgagcagcatttgcattctgataagatgaaaatgcttggcccattcaccatggggattggcattttcattttcatttgtgctaatgccattcttcatgaaaaccgtgacaaagagaccaaaatcatacacatgagggatatctattccacagtcattgacattcacacgctaagaatcaaggagcaaaggcaaatgaacggcatgtacactggtttgatgggagaaacagaagtaaaacagaatgggagctcctgtgcctcgagattggcagcaaatacgatcgcctctttctcgggttttcggagcagttttcgaatggacagctccgtggaggaggatgaacttatgttaaatgaaggtaagagttctgggcatcttatgccccctttgctctctgacagctctgtgtctgtctttggcctctatccacctccttccaagacaactgatgataagaccagcggctctaagaaatgtgaaaccaagtcaattgtgtcatcgtccatcagtgcttttacattgcctgtgatcaaacttaataactgtgttattgatgagcccagtatagataacatcactgaagatgctgacaacctcaaaagtaggtcaaggaatttgtcaatggattcccttgtggttcctttgcccaacaccagtgaatccttccagcccgtcagcacagtgctaccaaggaataattccattggggagtcgttgtcgagtcagtacaagtcatctatggctctcggacctggggctggacagctcttgtctcctggggctgccagaagacagtttgggtccaatacatccttgcatttgctctcgtcacactcaaagtccttggacttagaccggggtccctccactctaactgttcaggcagaacaacggaaacatccaagttggcctaggttggatcggaacaacagcaagggatatatgaaactagagaacaaagaagacccgatggataggttgcttgtgccccaagttgccatcaaaaaggactttaccaataaggagaagcttcttatgatttcaagatctcacaataatttgagttttgaacatgatgagtttttgagtaacaacctaaagaggggaacttctgaaacaaggttttaatgttaaaagaatatatcattttacaagggtatatattttaaaacgattttcactggtgtttccttctt

SEQ ID NO: 7411 - DNA, 2553 bp, Homo sapiens
gtcttgatccgagcggtcttcccggtgtctagctcaagtcgctcctgctgcagcttcgctgcgggcggaggaggtctggaaggagggggcgggcagggagaggctggagccggtgacgccccctcctcccgcgctgcgagcgcccagacgacggcgagatgacggccgggagccccgaagaatgcggggaggtgcggaggagccccgagggccgcgtctctcgcttgggccgccgcctgggccgccgccggcgcccgcgctccccgcccgagcctctgcgggtgcgggcgcggctgcggctgcgctcgccgtcgggggcgttcgcggcgctgggggcgctcgtggtactggtgggtatgggcattgcagtggccggctactggccgcaccgggccggggccccagggtcccgggccgccaatgccagctcgccccagatgagcgagctgcgacgcgagggtcgcggcgggggccgggctcacggcccgcacgagcggctgcggctcctcgggccggtgatcatgggcgtcggcctgttcgtgttcatctgcgccaacacactgctgtatgagaaccgagacttggagacgcgacggctccgccagggggtgctgcgggcccaggcgctccggccccccgacggcccgggctgggactgcgccctccttcccagccccggccctaggagtccccgagccgtaggctgcgcagagccagaaatctgggacccgtccccgcgtcggggtacttcacccgtcccgtcagtgcggagtctgcgttcagagcccgctaatcctcgcttggggttacctgccttgctcaacagctacccgctgaagggccccgggctgcccccaccctggggtccacggacgcagactggccatgtgatcatcaccgtgcagccgtctggctcctgcattgaacattccaagtctctggatctgggccttggggagctcctccttggggccccagcagctcgggactgtgctcaccgaagctggccacggctggaccgcctcagtcttgggggctatgccaaattgggaggaggaggggacttgggggcccgggtctgaagagaggggagacagcctgctctgaggctgcagcatggaccatgctaataggaccaaaggaccaggagtcccaacgtctaatagatgtttcagtcacatcccaggctggggatggatgctctgaccacagcagctgtgaagggcatcctgacctgcatgcgggcagagaaatgccagctgcaccagggctcagtgagctggagagggtgcgtttcactgtggggtgtggaggactcgcctcaggaatttcttcagcctctgtaagtggccttagccctaacagggctggaggtccaggccagggtgactgggagatgtacccagtgtcttggcaaacccaagaaagtggtgggcaagggcccctaagactgggaggtaggttgggatgttacaggctggggcaggctccctccaaggcggcactggtgatggagtgtggggcctctgggaagatggaccacgggatgagactctccactgccatctgggacggggactgagccttgaactcctaccacctcaatccctttcttccctcagccatctggggtatatccctctagagctacactactgccaatgccttcatactgagttctgggcccttctgcaaataagtctgagaagccccttctctccttcctttatcgtggcctatgctgcagaatctcactgcagctggcaaaaggcattggccagctctcagaaatccctttactcaacgttgaagctgcattttggtcaatgtgggtaacttactttagaaaatgacttgagtttaggtctcccccacccatatttaatttttcccaagttgctggtagaagagaaatttaaaagtggatcaatcctcacagagagagttctttttgttgttgtttattgaaaaaaatgcaatacaagaagcaagaccaaacagatatctaaacactacaaccacttctactacgaaaggccaaaacagcagacttgattattgcctgtgtagtctaaagattctgccaatctgattctgctgcccgagttcctattttttcaagaaatgtaaacaactacttgatatgattcataattttaaaaaaaatttacaaagctccttcatttttgtcaccaaaataatacatttgagagagatttgtagaaacaaccagcctggggctgagatcctgggcagaaatttcccgtgagcatcaaaaggcgtcagtcaggccgcagctctggctccagttcccgaggtttgttgtctcctcacccccagctgccaagcatccccccaacacacactgatgggcccagcggtggaggggggggtggggacggggatgggtcacggggccctgacgggtcccgcagttaggctccctgagccctcggcttataaatacaggtcttgctttgtgggtgggtgccagagtcctcatgtggcttggaggaaatctttatttctcaaattaaaataaaattgcagcga

SEQ ID NO: 7412 - DNA, 2501 bp, Homo sapiens
ccgggccgtggagacccgggcggctctggagcctccgcgcgcggactgggacccggacccgcgcggcgctgcggcgccagagcgcccagacgacggcgagatgacggccgggagccccgaagaatgcggggaggtgcggaggagccccgagggccgcgtctctcgcttgggccgccgcctgggccgccgccggcgcccgcgctccccgcccgagcctctgcgggtgcgggcgcggctgcggctgcgctcgccgtcgggggcgttcgcggcgctgggggcgctcgtggtactggtgggtatgggcattgcagtggccggctactggccgcaccgggccggggccccagggtcccgggccgccaatgccagctcgccccagatgagcgagctgcgacgcgagggtcgcggcgggggccgggctcacggcccgcacgagcggctgcggctcctcgggccggtgatcatgggcgtcggcctgttcgtgttcatctgcgccaacacactgctgtatgagaaccgagacttggagacgcgacggctccgccagggggtgctgcgggcccaggcgctccggccccccgacggcccgggctgggactgcgccctccttcccagccccggccctaggagtccccgagccgtaggctgcgcagagccagaaatctgggacccgtccccgcgtcggggtacttcacccgtcccgtcagtgcggagtctgcgttcagagcccgctaatcctcgcttggggttacctgccttgctcaacagctacccgctgaagggccccgggctgcccccaccctggggtccacggacgcagactggccatgtgatcatcaccgtgcagccgtctggctcctgcattgaacattccaagtctctggatctgggccttggggagctcctccttggggccccagcagctcgggactgtgctcaccgaagctggccacggctggaccgcctcagtcttgggggctatgccaaattgggaggaggaggggacttgggggcccgggtctgaagagaggggagacagcctgctctgaggctgcagcatggaccatgctaataggaccaaaggaccaggagtcccaacgtctaatagatgtttcagtcacatcccaggctggggatggatgctctgaccacagcagctgtgaagggcatcctgacctgcatgcgggcagagaaatgccagctgcaccagggctcagtgagctggagagggtgcgtttcactgtggggtgtggaggactcgcctcaggaatttcttcagcctctgtaagtggccttagccctaacagggctggaggtccaggccagggtgactgggagatgtacccagtgtcttggcaaacccaagaaagtggtgggcaagggcccctaagactgggaggtaggttgggatgttacaggctggggcaggctccctccaaggcggcactggtgatggagtgtggggcctctgggaagatggaccacgggatgagactctccactgccatctgggacggggactgagccttgaactcctaccacctcaatccctttcttccctcagccatctggggtatatccctctagagctacactactgccaatgccttcatactgagttctgggcccttctgcaaataagtctgagaagccccttctctccttcctttatcgtggcctatgctgcagaatctcactgcagctggcaaaaggcattggccagctctcagaaatccctttactcaacgttgaagctgcattttggtcaatgtgggtaacttactttagaaaatgacttgagtttaggtctcccccacccatatttaatttttcccaagttgctggtagaagagaaatttaaaagtggatcaatcctcacagagagagttctttttgttgttgtttattgaaaaaaatgcaatacaagaagcaagaccaaacagatatctaaacactacaaccacttctactacgaaaggccaaaacagcagacttgattattgcctgtgtagtctaaagattctgccaatctgattctgctgcccgagttcctattttttcaagaaatgtaaacaactacttgatatgattcataattttaaaaaaaatttacaaagctccttcatttttgtcaccaaaataatacatttgagagagatttgtagaaacaaccagcctggggctgagatcctgggcagaaatttcccgtgagcatcaaaaggcgtcagtcaggccgcagctctggctccagttcccgaggtttgttgtctcctcacccccagctgccaagcatccccccaacacacactgatgggcccagcggtggaggggggggtggggacggggatgggtcacggggccctgacgggtcccgcagttaggctccctgagccctcggcttataaatacaggtcttgctttgtgggtgggtgccagagtcctcatgtggcttggaggaaatctttatttctcaaattaaaataaaattgcagcgagagttg

SEQ ID NO: 7413 - DNA, 1920 bp, Homo sapiens
cctccatcccagaggctagtcctgcactccaggagctcgccatgatcgccaccggcggcctgctaaggatttccgccagaaagcaggatccactccgccccccaagccagatacccaagcgcaagcggaaagccaagaagaggcgcaagaacgacgtggtggtggtgaaaggcaagctgaagctgtgctccatctcagggctcatcgccctctgtgggatcctggtgctgctggtgggcatagccatggcggtggtgggctactggcccaaggccaccgggaccaatcgggaggggggtaagcagctgccgcctgcgggcagcagccaccgggtcccaaccacggccaacagcagtagcagtggcagcaaaaaccggtccaggagccaccctagggctccagggggtgtcaactccagttccgcgggcgcgcccaggagcacgcctccagcacgagccgcctccccgtcctcctcctccacgtccgtgggcttcttcttccgcatcttctctggctacctgcactctgacaagctcaaggtcttcgggcccctcatcatgggcatcggcatcttcctcttcatctgcgcaaacgcggtcctccacgagaaccgggacaagaagaccaaaatcatcaacctgcgggacctctactccaccgtcatcgacgtgcacagcctccgcgccaaagacctggcggccgccgcggccgccgccgcggccgccgccgcctcttcgtcgtcgtctgcccccgccgcggcgccccccggggccataccgctcaacggcttcctcagctacgtgcagtcgcggggcctggagctgaagcccgggggctgcggtggctccggggacgccttcggagcggcggcgatgctggccaagggctcgtggcctcctcaccccgcggcgccgagcggcggccgccctcggggcgccgcgtccccgccggacctggcctcttccccgcgctgtccgcgggagcccccgagcctggccgaggccgtgtacagcgtctaccgcgagcgctcgggcgtggcaggcagtcgccgggccgccgctgccaccgccgccgcagccgctagcagctgcagcagtccggcgccctgcagcccacccgagagctgggggcgccagagcacggccagctccttcgtggactcctcgctgagcgccttcgcgctgctgcccttgcaagggggccgcgataggggcggggacgcggagggcgcgagctgcagctggcagaggcctccgggggaacgcggctcccaggagatcccgaggggcgagctcgacctgagcatgaccaacctccgcggcgcagagggcagcatgcgcggggcgcgccgggagccggaggagcccgagggcgcggtagcggcgcgcgccgccagggggcagggcggccgcctgcccaggaccggcaggtacgcggccttgcggcgccgcagcaccagcgggctcccggactaccgggcgccgccgtcccccgagcccccgccctccccggggagtgcggacccggactccagccctctggccaaggccgcctccccctcgccacccctgcggctggagggctcgccccccaccaggcgggactccgggagctcccagtcggatgacccatccagcagcaataagggctacacacccctgcgggaggccggcacctccaccgagtcggtcttggacgcagtagctggtcaaacgcgagactctgctgtggccgcccccgttctgggtgcggagcagagctcgccggagggtgccagccaggagccacccacggccgagcaacctcagccggtgcagaggcagtttacaaacaaggagaaactcatcatgatttccaggtctcatgccataggggtagaagaagaactggaaagcacaggcatttagagaaaggggtggg

SEQ ID NO: 7414 - DNA, 3290 bp, Homo sapiens
gcggactctggcccctagctccccgagagcgcccctcggatgctgctggggagaccctccgggcctctctttggggcctctggggcccgcggctcagacagcaacagccgccagtccggccgccccgagccgccgccgcgggctcaactccacccggcggagcccggcgcgccgcagccacacaaaagaggcgcgagggccggcggcgcggccgcaggggcccgcccgggagcgccgcgctaggggacgccgggagctggaggatgagcggcggagaggagggctccgaggcgggatgcgggatgcgggatgcggaggacctgacacttcttggaaactcttggaaatggctcccgccacagcgccggcggggactgcgagcctggggcgggcgctcgcccccgcggggctgctgagtcgcgctcggatgcggggccccggggcgctgtccctgcgctccgccgtcggctcgggctgaaaaagtttctccatggttcctttgtgtcgcccgagcgcccgttcgccggccccgacctccctcggtctccctggcaggaggaggtggctgagcagctagtgggcagttggcgccctccctgtgcaagcctccatcccagaggctagtcctgcactccaggagctcgccatgatcgccaccggcggcctgctaaggatttccgccagaaagcaggatccactccgccccccaagccagatacccaagcgcaagcggaaagccaagaagaggcgcaagaacgacgtggtggtggtgaaaggcaagctgaagctgtgctccatctcagggctcatcgccctctgtgggatcctggtgctgctggtgggcatagccatggcggtggtgggctactggcccaaggccaccgggaccaatcgggaggggggtaagcagctgccgcctgcgggcagcagccaccgggtcccaaccacggccaacagcagtagcagtggcagcaaaaaccggtccaggagccaccctagggctccagggggtgtcaactccagttccgcgggcgcgcccaggagcacgcctccagcacgagccgcctccccgtcctcctcctccacgtccgtgggcttcttcttccgcatcttctctggctacctgcactctgacaagctcaaggtcttcgggcccctcatcatgggcatcggcatcttcctcttcatctgcgcaaacgcggtcctccacgagaaccgggacaagaagaccaaaatcatcaacctgcgggacctctactccaccgtcatcgacgtgcacagcctccgcgccaaagacctggcggccgccgcggccgccgccgcggccgccgccgcctcttcgtcgtcgtctgcccccgccgcggcgccccccggggccataccgctcaacggcttcctcagctacgtgcagtcgcggggcctggagctgaagcccgggggctgcggtggctccggggacgccttcggagcggcggcgatgctggccaagggctcgtggcctcctcaccccgcggcgccgagcggcggccgccctcggggcgccgcgtccccgccggacctggcctcttccccgcgctgtccgcgggagcccccgagcctggccgaggccgtgtacagcgtctaccgcgagcgctcgggcgtggcaggcagtcgccgggccgccgctgccaccgccgccgcagccgctagcagctgcagcagtccggcgccctgcagcccacccgagagctgggggcgccagagcacggccagctccttcgtggactcctcgctgagcgccttcgcgctgctgcccttgcaagggggccgcgataggggcggggacgcggagggcgcgagctgcagctggcagaggcctccgggggaacgcggctcccaggagatcccgaggggcgagctcgacctgagcatgaccaacctccgcggcgcagagggcagcatgcgcggggcgcgccgggagccggaggagcccgagggcgcggtagcggcgcgcgccgccagggggcagggcggccgcctgcccaggaccggcaggtacgcggccttgcggcgccgcagcaccagcgggctcccggactaccgggcgccgccgtcccccgagcccccgccctccccggggagtgcggacccggactccagccctctggccaaggccgcctccccctcgccacccctgcggctggagggctcgccccccaccaggcgggactccgggagctcccagtcggatgacccatccagcagcaataagggctacacacccctgcgggaggccggcacctccaccgagtcggtcttggacgcagtagctggtcaaacgcgagactctgctgtggccgcccccgttctgggtgcggagcagagctcgccggagggtgccagccaggagccacccacggccgagcaacctcagccggtgcagaggcagtttacaaacaaggagaaactcatcatgatttccaggtctcatgccataggggtagaagaagaactggaaagcacaggcatttagagaaaggggtgggttggggaggaggaaagagaaaatgggagaaacgcccacttgaatcagtgcattaacaggtccctgtttcttttgtggactgatccgaggacatcattcaatatccaaagagctgcagaatgttatccttgaattgcgtccacaagattcctgtagataactccaaggatttttttttttaagcaaactagtctttttatgtccgatggtgattgtatgttcaatgaaaaccaaatgtattaaaaggtcagcaatctagtccattagataaaatcttttaattttcttaggatcaaaataatatatttttgacagtaactgtgcactttactccgacttttttttttaatccctcatttcccgacccctgtactctgcgctggttttgcccacagctgcttgcgaatggcaggcttttttctccattcctttgcggaacatagaagagtttgtctcagttctcttagaattgatgttactaactgaagtcaaagccaaaagcatgaataattcaggaacgagcactttccttgccccaccccactgtgctcacccaatgcccaaaagcttcttcatttttaaacgggtgtgtacgttttgctactaggctatgtggtggagactggaggggaccaggaactagatggactgttacattccgaaatttatatcaagtacaccatgctttattgagtgttatcacacctgtattgaaaatagcattaatatttaaaatcttttttaataaaagaagtttccgaacaaa

SEQ ID NO: 7415 - DNA, 3851 bp, Homo sapiens
cggagagccatggagggagtgagcgcgctgctggcccgctgccccacggccggcctggccggcggcctgggggtcacggcgtgcgccgcggccggcgtgttgctctaccggatcgcgcggaggatgaagccaacgcacacgatggtcaactgctggttctgcaaccaggatacgctggtgccctatgggaaccgcaactgctgggactgtccccactgcgagcagtacaacggcttccaggagaacggcgactacaacaagccgatccccgcccagtacttggagcacctgaaccacgtggtgagcagcgcgcccagcctgcgcgacccttcgcagccgcagcagtgggtgagcagccaagtcctgctgtgcaagaggtgcaaccaccaccagaccaccaagatcaagcagctggccgccttcgctccccgcgaggagggcaggtatgacgaggaggtcgaggtgtaccggcatcacctggagcagatgtacaagctgtgccggccgtgccaagcggctgtggagtactacatcaagcaccagaaccgccagctgcgcgccctgttgctcagccaccagttcaagcgccgggaggccgaccagacccacgcacagaacttctcctccgccgtgaagtccccggtccaggtcatcctgctccgtgccctcgccttcctggcctgcgccttcctactgaccaccgcgctgtatggggccagcggacacttcgccccaggcaccactgtgcccctggccctgccacctggtggcaatggctcagccacacctgacaatggcaccacccctggggccgagggctggcggcagttgctgggcctactccccgagcacatggcggagaagctgtgtgaggcctgggcctttgggcagagccaccagacgggcgtcgtggcactgggcctactcacctgcctgctggcaatgctgctggctggccgcatcaggctccggaggatcgatgccttctgcacctgcctgtgggccctgctgctggggctgcacctggctgagcagcacctgcaggccgcctcgcctagctggctagacacgctcaagttcagcaccacatctttgtgctgcctggttggcttcacggcggctgtggccacaaggaaggcaacgggcccacggaggttccggccccgaaggtcagagaagcagccatgactgcggggggaggacacacggatgctcaggcccaggctttgccaggtccgaagcgggcccctctctgtcctgcctcttttcacctgctcacgccctcccacccccaccctacagccccaggtcctggcccagtccctccactgcctcgaagagtcagtctgccctgccttttcctttcgggcaccaccagccatccccgagtgccctgtagccactcaccactgctgccacctctctggccaatggccctttcactggcctggtgactggaatgtgggcagcgcccacacaggctctggcccatggcttcctactggcagctccaggcacccccctctcaccacgccgtttgctggctctgacactgttgggtgagggtcctggtcctgctgtcttcccttctggcctctgcacaggggtggtgacagtggctacaggctgggcccctggcgtgccctgaccgtgcagcagagtgaggctggggcagcagagagccccagcctcacccctgaggagcacctgtggtctgtccccttggtcctgcttatggctggaccggccctgcaggaggtggtggagccgtgaaggaggccgagctgcagctctggctgctgcttggcctcctgctccaagaccctcccgagtccccggaaatggagagtgcagttcttgggcccagcctggccttcgccatgagtttggggagcgagaccccacctgagacaggcagtaggagcctgtgctgaccttggggaatctgagcttttccaagggtaaggggcccagggtatgcaggccttcagtgacatcaggtcgttgtcatcctttccctccctgacctgtcacgagcctctgcaggtgcctgctcaccatggcccagcgccactctgtcctccgactcaggtgagggggcagcccacagacctgctcctcagtagcagggcctggccaggcccctgctgttctcagcctcagtttgccatctatgaaatgaggtggacccctctccatagcccttgggtgccagctcagtgggtgtggggatcacatgaggtggctcatgaggacacactctggaagtcgaggggctgccacgtgcagaggaagttcccggcctgggggctttatccaggggtcccagtcgagagtggcccgaggccgtccctcaccgggcatgttccctctggctgcccactccctcagggcccacatgtcctgccactcgccactctgagcacgagttcaccttccagatgtggccagggtgtgccagctcctctctcctgtgcgttggaaccccgggggaggcaagagcagatcacaggtgcatgagggttacacccgtcacctgggtctgccgggatgggttgggggggcaggtgccaggcctcactgctgtgaatctgccacgcctgggggtcctagaggctgccccaccccagtgattgggtagcagctcacatcccacccagcttcacaagtgaggaacccaggtgcatcgggagaccctcgggggcttctgtggcctctgtgcccgatgacctgcgtggcttcagacaaggccccagcgttactgggctcagcttgttgttctgtgtggagcgtgaggtgagaaaacccctctgaaaagatgtggtcggggccacgcttcccactggttctgcagtgaggagttggggcgggtgagccaaagcggccccccatggtgtctacctgaggggcagggaaccgcctgcctgtgcactcacgccaccccccagcccacaaagagcccatctgagagaaggacgtggtggagccaggacgggaaagcgtcctgtcggctggccatgctgttgcttgcgtctcgaatcttcggttctcgaggaagtgttgacagtgtgatgctaatgtctgcttttcttggcgttgggtagaagcaggacatctgtgtgtatgtgcgtatttaaattagattatttataataaccagagccagccctcgcgctggccaggatcctcctgccgagctgatgtcgctcctgccctctgccggggtccggaagcgacatctcaggaggtagctctcagcagagtgaggattcctgcctttcgtagagttttgtgtgactttttaaattattcatgtgtcccttaaaagtttcactacgtggagaaaattccagcaccaagtgttgtggcaacagctgagagagtgcaggcaccactgtgttgtggcttgttgaccgggaatgtgtcacccctgccagggaactcttctcctcgcgggggacttgggatggccatcagaccttctagggtctggctggggtcatcctaggtatgggtgaccgtccctgagacataagcgaggtagattcagccatcctcaccctcagacttgaggtccccacccaggccaagccggccccccgtaccccttgcctgggagcaaaccgccaggacgcagcctccacgccgcacctgccacattcagccctgcccaggaaggaacacatgacccttctgtctgtgactgttgctgagtctctgtctcatgtcgtagaattgtggataattgtctagtgaccctctcatcactgtaaccatcgcgcctggcctagatgtcgtgttttggatgctgtgttttcaataaatgcctctggggccctgcttttacccgc

SEQ ID NO: 7416 - DNA, 3776 bp, Homo sapiens
cggagagccatggagggagtgagcgcgctgctggcccgctgccccacggccggcctggccggcggcctgggggtcacggcgtgcgccgcggccggcgtgttgctctaccggatcgcgcggaggatgaagccaacgcacacgatggtcaactgctggttctgcaaccaggatacgctggtgccctatgggaaccgcaactgctgggactgtccccactgcgagcagtacaacggcttccaggagaacggcgactacaacaagccgatccccgcccagtacttggagcacctgaaccacgtggtgagcagcgcgcccagcctgcgcgacccttcgcagccgcagcagtgggtgagcagccaagtcctgctgtgcaagaggtgcaaccaccaccagaccaccaagatcaagcagctggccgccttcgctccccgcgaggagggcaggtatgacgaggaggtcgaggtgtaccggcatcacctggagcagatgtacaagctgtgccggccgtgccaagcggctgtggagtactacatcaagcaccagaaccgccagctgcgcgccctgttgctcagccaccagttcaagcgccgggaggccgaccagacccacgcacagaacttctcctccgccgtgaagtccccggtccaggtcatcctgctccgtgccctcgccttcctggcctgcgccttcctactgaccaccgcgctgtatggggccagcggacacttcgccccaggcaccactgtgcccctggccctgccacctggtggcaatggctcagccacacctgacaatggcaccacccctggggccgagggctggcggcagttgctgggcctactccccgagcacatggcggagaagctgtgtgaggcctgggcctttgggcagagccaccagacgggcgtcgtggcactgggcctactcacctgcctgctggcaatgctgctggctggccgcatcaggctccggaggatcgatgccttctgcacctgcctgtgggccctgctgctggggctgcacctggctgagcagcacctgcaggccgcctcgcctagctggctagacacgctcaagttcagcaccacatctttgtgctgcctggttggcttcacggcggctgtggccacaaggaaggcaacgggcccacggaggttccggccccgaaggttcttcccaggagactctgccggccttttccccaccagccccagcttggccatccctcacccgagtgtcggaggctctccagcgtctctgttcatccccagcccgcccagcttcctgcccctcgccaaccagcagctcttccggtctcctcgacggacctcaccctcctcattgcctggccgcctcagccgggccctctctctgggaaccataccctctctgactcgagcagactccggctatctgttcagcggtagccgcccaccatctcaggtgtctcgatctggggagtttcctgtttcagattacttctctcttctgtcggggagctgcccctcctccccactcccttccccagcgccttccgtggccggctcggtggcctccagctccggctctctgcgccaccgcaggcccctcatcagccctgcccggctcaacctgaagggacagaagctgctgctgttcccgtcaccccctggagaggcccccaccacgcccagcagctccgatgagcactcgcctcacaacggcagcctcttcaccatggagccgccccatgttccccggaagccgcccctgcaggacgtgaagcacgccctggacctgagatccaagctggaaagaggcagtgcctgcagcaaccgctccatcaagaaagaggacgactcttcccagtcatctacctgtgtggtggacaccaccaccaggggctgctcggaggaggccgccacctggagaggtcgtttcggcccttccctggtccggggcctcctggccgtgagcttggccgccaacgccctgttcacctcggtgtttctgtaccagagcctgcgctgacccaccgttggagcccctcggaggggagcaacccggtgcctgctgcttcaccactgccggcctcaggaccctccctggaggggctgccacctctgccctcatctccagggccttgacctcactggactgtgactgtcctcaggacacctgcccctcctcacctaacggactgcagggctgagcatgtgtctgaggtcacactctctgcccactcacctccttggctgacatcggttgtgtttggtgctgacactctgatcccgaagccagggagccccaaggggctgcatgaccctggggtgccccacacagttcagccctgcctggcagggacgccagtactactgtaactgcagcaggagctgcccggcctgccttctggccccacgcccacaggcgtagtcacatctttgtactgtactcccctgtctcacctggggcaacctcagagccccactaagctgaaggccccctgggggagggggaagcatggtccttatcatctgccctatcttgccccttcctgtggagtgggcagaagggctcccgggatcctcagagctcccaggtctgagcagccaaaggcccagctgggcctccaggaccagcgcgagcccctgccccaccctcccctgccccatgtgccctgctttgtgacctctgttgaccttcctggaagcagccccattaccctgagaatgcggagcgccctggcccacctcgccctgtgtttccaggcctgcacgtctggtccttcagctgcacatggaactgcagggcaggctggcggggggccttcagatctcagatgagactgcaccccttcgaccaccctactgggcacctgcctccagcccctgagaactccatcttcccctagttctgcccaggagcccctgagaaccccatcttcccctggttctcttgcccactcccctgctggggctccttcctggcactgaggaggggcgctcccaatgctgtgaggcagcggggagggaccgtgcacccgtggctatcagagcccctccgctgtcccaccctgggcctgggacacgggcctggggcagtgtgtgtctgctggtcatgtgctggtgccagttggggaggaatcagctgtctcggtggattctgagactcactgtggggcgggaagaagggtcttcactctgccattcagggataaagtttaattttatttttctacacattttgccaggtcaggcattttgctagtaagcaggatgcccccaactctccctgccatggaggattcttttttttaagctttgggtgcttttttaatacttttttttttaatgtggggaaggagcttgctctgacgtcaccctcctctcccctgactcctgtcctgagagctgtggatgccgcctcctgccctgcctacccctgaaacgtggggaatgggggccccaggacagcatcaggacttttgagtccagctgccagcaatggttccaactcggaggcagcgcctcttggtccccatttctgtatagcaggcgtgtgtgtgtgtgtcgaggttttttattttttgcttaatcaaactccattcccaaatgcactccatctctggctctgagggcgctccctcctctcagccgggcagcctggcctctcctgcccagacctgcggtcccagcatcccccagagccagggaacaggcccagcgggagggggttttatgttttgtttcaaacagaaaacacaaccttatttttctttacaaaagcaaaaaaggaaa

SEQ ID NO: 7417 - DNA, 3780 bp, Homo sapiens
ctacccgcctacccgcctacccccctgccggcctgccgtccttccacgcggagagccatggagggagtgagcgcgctgctggcccgctgccccacggccggcctggccggcggcctgggggtcacggcgtgcgccgcggccggcgtgttgctctaccggatcgcgcggaggatgaagccaacgcacacgatggtcaactgctggttctgcaaccaggatacgctggtgccctatgggaaccgcaactgctgggactgtccccactgcgagcagtacaacggcttccaggagaacggcgactacaacaagccgatccccgcccagtacttggagcacctgaaccacgtggtgagcagcgcgcccagcctgcgcgacccttcgcagccgcagcagtgggtgagcagccaagtcctgctgtgcaagaggtgcaaccaccaccagaccaccaagatcaagcagctggccgccttcgctccccgcgaggagggcaggtatgacgaggaggtcgaggtgtaccggcatcacctggagcagatgtacaagctgtgccggccgtgccaagcggctgtggagtactacatcaagcaccagaaccgccagctgcgcgccctgttgctcagccaccagttcaagcgccgggaggccgaccagacccacgcacagaacttctcctccgccgtgaagtccccggtccaggtcatcctgctccgtgccctcgccttcctggcctgcgccttcctactgaccaccgcgctgtatggggccagcggacacttcgccccaggcaccactgtgcccctggccctgccacctggtggcaatggctcagccacacctgacaatggcaccacccctggggccgagggctggcggcagttgctgggcctactccccgagcacatggcggagaagctgtgtgaggcctgggcctttgggcagagccaccagacgggcgtcgtggcactgggcctactcacctgcctgctggcaatgctgctggctggccgcatcaggctccggaggatcgatgccttctgcacctgcctgtgggccctgctgctggggctgcacctggctgagcagcacctgcaggccgcctcgcctagctggctagacacgctcaagttcagcaccacatctttgtgctgcctggttggcttcacggcggctgtggccacaaggaaggcaacgggcccacggaggttccggccccgaaggttcttcccaggagactctgccggccttttccccaccagccccagcttggccatccctcacccgagtgtcggaggctctccagcgtctctgttcatccccagcccgcccagcttcctgcccctcgccaaccagcagctcttccggtctcctcgacggacctcaccctcctcattgcctggccgcctcagccgggccctctctctgggaaccataccctctctgactcgagcagattacttctctcttctgtcggggagctgcccctcctccccactcccttccccagcgccttccgtggccggctcggtggcctccagctccggctctctgcgccaccgcaggcccctcatcagccctgcccggctcaacctgaagggacagaagctgctgctgttcccgtcaccccctggagaggcccccaccacgcccagcagctccgatgagcactcgcctcacaacggcagcctcttcaccatggagccgccccatgttccccggaagccgcccctgcaggacgtgaagcacgccctggacctgagatccaagctggaaagaggcagtgcctgcagcaaccgctccatcaagaaagaggacgactcttcccagtcatctacctgtgtggtggacaccaccaccaggggctgctcggaggaggccgccacctggagaggtcgtttcggcccttccctggtccggggcctcctggccgtgagcttggccgccaacgccctgttcacctcggtgtttctgtaccagagcctgcgctgacccaccgttggagcccctcggaggggagcaacccggtgcctgctgcttcaccactgccggcctcaggaccctccctggaggggctgccacctctgccctcatctccagggccttgacctcactggactgtgactgtcctcaggacacctgcccctcctcacctaacggactgcagggctgagcatgtgtctgaggtcacactctctgcccactcacctccttggctgacatcggttgtgtttggtgctgacactctgatcccgaagccagggagccccaaggggctgcatgaccctggggtgccccacacagttcagccctgcctggcagggacgccagtactactgtaactgcagcaggagctgcccggcctgccttctggccccacgcccacaggcgtagtcacatctttgtactgtactcccctgtctcacctggggcaacctcagagccccactaagctgaaggccccctgggggagggggaagcatggtccttatcatctgccctatcttgccccttcctgtggagtgggcagaagggctcccgggatcctcagagctcccaggtctgagcagccaaaggcccagctgggcctccaggaccagcgcgagcccctgccccaccctcccctgccccatgtgccctgctttgtgacctctgttgaccttcctggaagcagccccattaccctgagaatgcggagcgccctggcccacctcgccctgtgtttccaggcctgcacgtctggtccttcagctgcacatggaactgcagggcaggctggcggggggccttcagatctcagatgagactgcaccccttcgaccaccctactgggcacctgcctccagcccctgagaactccatcttcccctagttctgcccaggagcccctgagaaccccatcttcccctggttctcttgcccactcccctgctggggctccttcctggcactgaggaggggcgctcccaatgctgtgaggcagcggggagggaccgtgcacccgtggctatcagagcccctccgctgtcccaccctgggcctgggacacgggcctggggcagtgtgtgtctgctggtcatgtgctggtgccagttggggaggaatcagctgtctcggtggattctgagactcactgtggggcgggaagaagggtcttcactctgccattcagggataaagtttaattttatttttctacacattttgccaggtcaggcattttgctagtaagcaggatgcccccaactctccctgccatggaggattcttttttttaagctttgggtgcttttttaatacttttttttttaatgtggggaaggagcttgctctgacgtcaccctcctctcccctgactcctgtcctgagagctgtggatgccgcctcctgccctgcctacccctgaaacgtggggaatgggggccccaggacagcatcaggacttttgagtccagctgccagcaatggttccaactcggaggcagcgcctcttggtccccatttctgtatagcaggcgtgtgtgtgtgtgtcgaggttttttattttttgcttaatcaaactccattcccaaatgcactccatctctggctctgagggcgctccctcctctcagccgggcagcctggcctctcctgcccagacctgcggtcccagcatcccccagagccagggaacaggcccagcgggagggggttttatgttttgtttcaaacagaaaacacaaccttatttttctttacaaaagcaaaaaaggaaaccaaaaaagatacagcctttgaatgatg

SEQ ID NO: 7418 - DNA, 1557 bp, Homo sapiens
ggcgtccgatcgaggcgggcgttcacgggcggccagggttgagtcccgggtcggggccgggggattgccggcgcatcagggccgagggctggggctggcggggccgctcgctgcctctcgctcgcagcagcggcggcaggcgcgggcgagggccacggggagaggagacgcagccccgcgggtggcacgctcggccgggccccggcccgcgctcaacgggcgcgatgctcttctcgctccgggagctggtgcagtggctaggcttcgccaccttcgagatcttcgtgcacctgctggccctgttggtgttctctgtgctgctggcactgcgtgtggatggcctggtcccgggcctctcctggtggaacgtgttcgtgcctttcttcgccgctgacgggctcagcacctacttcaccaccatcgtgtccgtgcgcctcttccaggatggagagaagcggctggcggtgctccgccttttctgggtacttacggtcctgagtctcaagttcgtcttcgagatgctgttgtgccagaagctggcggagcagactcgggagctctggttcggcctcattacgtccccgctcttcattctcctgcagctgctcatgatccgcgcctgtcgggtcaactagcctcaccgaggtgccggagagggagcgctggacaactagaatgttgacctcgagccgaggccctacttgcagcgcaccggaggagaggctctctagtctgaaggcaccgccggcttgcgccgagctgagtgccgggtttccctattccaatcctgtttgaaatggtttcttcagcagggcttaaaagagcagccttcatcctgaaaatgtatttccttttgtttaatgctttgagtagataatcctgaattgaggtcatgaggaggccccccaggccagacagtcctgaacccctctgacacttggaaactgaatataagtaaaatgtccaggtggactctgagtatttcctgtggatcctgggaaagtactgttgcacaaaggctgcaaagctggactcaggaatgtcctccaaccagcagcgctgacctaagagctccctgtgccgtctatccagaccagacttcggtagatgcctttgttagatctatcacatgtaaacgagcttgtatctccttccctgtgccacgagagagattggctttttattccagtctaggcagagacagaagaatgttgaataagagcacgattagagtcctgtctggttatctgttgcccaagaaaagaactctgctgtccaggcactgcttggcttactatcccagcaaagactgcagttttgtggacttttgaccaccttgggctggcactcttagcacacctgagacagatttaagcctccctaagagactgaagagaggaacaggtgtcagatactcataggcactgagatctacaaatgggaagcttgtgagtggcccatctttgttggcctacgaactttggtttgatgccagtcaggtgccacatgagaacctttgctgagatgcaaataaagtaagagaatgttttcctgaaa

SEQ ID NO: 7419 - DNA, 590 bp, Homo sapiens
gcgtccgatcgaggcgggcgttcacgggcggcccgcgctcaacgggcgcgatgctcttctcgctccgggagctggtgcagtggctaggcttcgccaccttcgagatcttcgtgcacctgctggccctgttggtgttctctgtgctgctggcactgcgtgtggatggcctggtcccgggcctctcctggtggaacgtgttcgtgcctttcttcgccgctgacgggctcagcacctacttcaccaccatcgtgtccgtgcgcctcttccaggatggagagaagcggctggcggtgctccgccttttctgggtacttacggtcctgagtctcaagttcgtcttcgagatgctgttgtgccagaagctggcggagcagactcgggagctctggttcggcctcattacgtccccgctcttcattctcctgcagctgctcatgatccgcgcctgtcgggtcaactagcctcaccgaggtgccggagagggagcgctggacaactagaatgttgacctcgagccgaggccctacttgcagcgcaccggaggagaggctctctagtctgaaggcaccgccggcttgcgccgagctgag

SEQ ID NO: 7420 - DNA, 943 bp, Homo sapiens
ctgggacttggctttctccggataagcggcggcaccggcgtcagcgatgaccgtgcagagactcgtggccgcggccgtgctggtggccctggtctcactcatcctcaacaacgtggcggccttcacctccaactgggtgtgccagacgctggaggatgggcgcaggcgcagcgtggggctgtggaggtcctgctggctggtggacaggacccggggagggccgagccctggggccagagccggccaggtggacgcacatgactgtgaggcgctgggctggggctccgaggcagccggcttccaggagtcccgaggcaccgtcaaactgcagttcgacatgatgcgcgcctgcaacctggtggccacggccgcgctcaccgcaggccagctcaccttcctcctggggctggtgggcctgcccctgctgtcacccgacgccccgtgctgggaggaggccatggccgctgcattccaactggcgagttttgtcctggtcatcgggctcgtgactttctacagaattggcccatacaccaacctgtcctggtcctgctacctgaacattggcgcctgccttctggccacgctggcggcagccatgctcatctggaacattctccacaagagggaggactgcatggccccccgggtgattgtcatcagccgctccctgacagcgcgctttcgccgtgggctggacaatgactacgtggagtcaccatgctgagtcgcccttctcagcgctccatcaacgcacacctgctatcgtggaacagcctagaaaccaagggactccaccaccaagtcacttcccctgctcgtgcagaggcacgggatgagtctgggtgacctctgcgccatgcgtgcgagacacgtgtgcgtttactgttatgtcggtcatatgtctgtacgtgtcgtgggccaacctcgttctgcctccagc

SEQ ID NO: 7421 - DNA, 1938 bp, Homo sapiens
acatcctgttggtgtctggctgccgcggcagggccgctatttgttgcggttggctacgccttccagctcaccaaaaacagtctcaaaaacaaccatttcctctctgctgagagccagggaaggcgagctctgcgcacacgggcgtccctgcagcagccactctgctttccaggaccggccaactgccctggaggcatccacacaggggcccaggcagcacagaggagctgtgaacccgctccacaccggccaccctgcccggagcctggcactcacagcaggccggtgctaaggagtgtggcgcgggctcgactcccactgctgccggcctcccgagtgactctgttttccactgctgcaggcgagaagaggcacgcgcggcacaggccggcctccgcttcccgggaagacggcgcactcctggccctgggttcttgctgctgcccaccctctgctccctgggatgggccccgaggcgagcagcttcagcacaggcctggccctgctccaggtgcaggaaggaggataaggccgggccgagaggcggcacacctggaccatcccatgggcctccgcccgcgccgccccgaggatgagtggtgatgtcctctagccacccctagcagcgtcggctctccctggacgtgcggccgcggactgggacttggctttctccggataagcggcggcaccggcgtcagcgatgaccgtgcagagactcgtggccgcggccgtgctggtggccctggtctcactcatcctcaacaacgtggcggccttcacctccaactgggtgtgccagacgctggaggatgggcgcaggcgcagcgtggggctgtggaggtcctgctggctggtggacaggacccggggagggccgagccctggggccagagccggccaggtggacgcacatgactgtgaggcgctgggctggggctccgaggcagccggcttccaggagtcccgaggcaccgtcaaactgcagttcgacatgatgcgcgcctgcaacctggtggccacggccgcgctcaccgcaggccagctcaccttcctcctggggctggtgggcctgcccctgctgtcacccgacgccccgtgctgggaggaggccatggccgctgcattccaactggcgagttttgtcctggtcatcgggctcgtgactttctacagaattggcccatacaccaacctgtcctggtcctgctacctgaacattggcgcctgccttctggccacgctggcggcagccatgctcatctggaacattctccacaagagggaggactgcatggccccccgggtgattgtcatcagccgctccctgacagcgcgctttcgccgtgggctggacaatgactacgtggagtcaccatgctgagtcgcccttctcagcgctccatcaacgcacacctgctatcgtggaacagcctagaaaccaagggactccaccaccaagtcacttcccctgctcgtgcagaggcacgggatgagtctgggtgacctctgcgccatgcgtgcgagacacgtgtgcgtttactgttatgtcggtcatatgtctgtacgtgtcgtgggccaacctcgttctgcctccagctttcctggttagcgcaacgcggctccacgaccacacgcacttcagggtggaagctggaagctgagacacaggttaggtggcgcgaggctgccctgcgctccgctttgctttgggattaatttattctgcatctgctgagaggggcaccccagccatatcttacactttggtaaagcagaaaaccaggaaaattttcttaaaatatccacaatattccttgagtgagtcagaatctatagccggttagtgatggtttcagacagaatcgtgttcgtgtctgttttgctcgattcttttcctaagttaaataaatgcaagcctctgaactctgtctataa

SEQ ID NO: 7422 - DNA, 2475 bp, Homo sapiens
acgcctggtctctgggacgcccctccggaccggtttcgcctcgcggagccggtaggtccaggtgcagcggccgcagtgctgcgtccgtgcgccgcgggctggggcggtctcaggtgtgccgaagctctggtcagtgccatgatccggcaggagcgctccacatcctaccaggagctgagtgaggagttggtccaggtggttgagaactcagagctggcagacgagcaggacaaggagacggtcagagtccaaggtccgggtatcttaccaggcctggacagcgagtccgcctccagcagcatccgcttcagcaaggcctgcctgaagaacgtcttctcggtcctactcatcttcatctacctgctgctcatggctgtggccgtctttctggtctaccggaccatcacagactttcgtgagaaactcaagcaccctgtcatgtctgtgtcttacaaggaagtggatcgctatgatgccccaggtattgccttgtaccccggtcaggcccagttgctcagctgtaagcaccattacgaggtcattcctcctctgacaagccctggccagccgggtgacatgaattgcaccacccagaggatcaactacacggaccccttctccaatcagactgtgaaatctgccctgattgtccaggggccccgggaagtgaaaaagcgggagctggtcttcctccagttccgcctgaacaagagtagtgaggacttcagcgccattgattacctcctcttctcttctttccaggagttcctgcaaagcccaaacagggtaggcttcatgcaggcctgtgagagtgcctattccagctggaagttctctgggggcttccgcacctgggtcaagatgtcactggtaaagaccaaggaggaggatgggcgggaagcagtggagttccggcaggagacaagtgtggttaactacattgaccagaggccagctgccaaaaaaagtgctcaattgttttttgtggtctttgaatggaaagatcctttcatccagaaagtccaagatatagtcactgccaatccttggaacacaattgctcttctctgtggcgccttcttggcattatttaaagcagcagagtttgccaaactgagtataaaatggatgatcaaaattagaaagagataccttaaaagaagaggtcaggcaacgagccacataagctgaagtcacctcgcgttgtttagagaactgtccacatcaatgggagctgtcatcacttccactttgtaaacggagctatcaacaatcctgtactcacttgaagaaatggggccttgctgggaggaacagcatgtaaaactggaacttctaaccccgtcccaaaagaggcggtgtagagcctaatagaagagactaatggataaacctacaagttatttaaatatttaaattattaataaactttttaaagagctggccaatgacttttgaatagggtttgtagaagatgcctttcttcctgtttggttcattgtattgtattaggttaagctctactagggtaatgaaggctctacttttcactttttaaaagtggacaaaagagtgtgattttctttttccaaaaattcctgagtatcaagacgtgcaggtcatgctttggagcctatgcactgtacacaaaggcaaaaccctatgactttggcatcatctgccattgatgtccagcctctgacatgctctttgatttgttaaatgttaaatgagactttaaggctactagaaactagtaattaagtttcttaatggactgagtagccacctacttgtccggctagaatgtttgttgatgtatgagtttagattaacactcaaaagcactaggacagatgtacatagaaggtgcctactcattgtattttgatgatttcattaacaggtaaataaaagttaatacaaaaggaacgagtgtgacaatatgaatatctgctcaatcatcgggcacaattactttcatttggtgacttccaaggacaaaaaggtagtatgagtctggactcccaagatggatctgactcccaaggtatgttctaactgcttccagggaagggtttgttaggcatggcaactgatggcaggtgtccagaaagagtgacctggtgtccccgaggaagctgggttaactctttactgtgtccacaaaactacccatcatatgaggaaggggcatacgcagtgtgaccctcaaaaagcttttagcctagcctttgacagaaatgagtatgcattaaaaaaaagtctatttttcacattaaggttctaaaaattgtttccagagttttaaattatttatgtgcctgttgcttcaaagaggacttggtagcatttcctaaattttgtaatctggcttccgataatccaaagggaataactcaaatgtatgaataggcattttaaatgggaagaaactgttttttggatgaatgattaaaagtgaactgtataaag

SEQ ID NO: 7423 - DNA, 2113 bp, Homo sapiens
atcgccacgcctggtctctgggacgcccctccggaccggtttcgcctcgcggagccggtaggtccaggtgcagcggccgcagtgctgcgtccgtgcgccgcgggctggggcggtctcaggtgtgccgaagctctggtcagtgccatgatccggcaggagcgctccacatcctaccaggaggctgtgcgtccagcgcttccttcaagcaagccctgcctcctcacttctccagctgtattagtgaaactgctctcctcctccgcctccacttctcggcccccaaaccttggtcatctttggcaaccgtcctcttctgtgcccctccatcgtgccgcctcattggccaaagtcaggcagttccagctgagtgaggagttggtccaggtggttgagaactcagagctggcagacgagcaggacaaggagacggtcagagtccaaggtccgggtatcttaccaggcctggacagcgagtccgcctccagcagcatccgcttcagcaaggcctgcctgaagaacgtcttctcggtcctactcatcttcatctacctgctgctcatggctgtggccgtctttctggtctaccggaccatcacagactttcgtgagaaactcaagcaccctgtcatgtctgtgtcttacaaggaagtggatcgctatgatgccccaggtattgccttgtaccccggtcaggcccagttgctcagctgtaagcaccattacgaggtcattcctcctctgacaagccctggccagccgggtgacatgaattgcaccacccagaggatcaactacacggaccccttctccaatcagactgtgaaatctgccctgattgtccaggggccccgggaagtgaaaaagcgggagctggtcttcctccagttccgcctgaacaagagtagtgaggacttcagcgccattgattacctcctcttctcttctttccaggagttcctgcaaagcccaaacagggtaggcttcatgcaggcctgtgagagtgcctattccagctggaagttctctgggggcttccgcacctgggtcaagatgtcactggtaaagaccaaggaggaggatgggcgggaagcagtggagttccggcaggagacaagtgtggttaactacattgaccagaggccagctgccaaaaaaagtgctcaattgttttttgtggtctttgaatggaaagatcctttcatccagaaagtccaagatatagtcactgccaatccttggaacacaattgctcttctctgtggcgccttcttggcattatttaaagcagcagagtttgccaaactgagtataaaatggatgatcaaaattagaaagagataccttaaaagaagaggtcaggcaacgagccacataagctgaagtcacctcgcgttgtttagagaactgtccacatcaatgggagctgtcatcacttccactttgtaaacggagctatcaacaatcctgtactcacttgaagaaatggggccttgctgggaggaacagcatgtaaaactggaacttctaaccccgtcccaaaagaggcggtgtagagcctaatagaagagactaatggataaacctacaagttatttaaatatttaaattattaataaactttttaaagagctggccaatgacttttgaatagggtttgtagaagatgcctttcttcctgtttggttcattgtattgtattaggttaagctctactagggtaatgaaggctctacttttcactttttaaaagtggacaaaagagtgtgattttctttttccaaaaattcctgagtatcaagacgtgcaggtcatgctttggagcctatgcactgtacacaaaggcaaaaccctatgactttggcatcatctgccattgatgtccagcctctgacatgctctttgatttgttaaatgttaaatgagactttaaggctactagaaactagtaattaagtttcttaatggactgagtagccacctacttgtccggctagaatgtttgttgatgtatgagtttagattaacactcaaaagcactaggacagatgtacatagaaggtgcctactcattgtattttgatgatttcattaacaggtaaataaaagttaatac

SEQ ID NO: 7424 - DNA, 1448 bp, Homo sapiens
agttctgagaaagaaggaaataaacacaggcaccaaaccactatcctaagttgactgtcctttaaatatgtcaagatccagacttttcagtgtcacctcagcgatctcaacgatagggatcttgtgtttgccgctattccagttggtgctctcggacctaccatgcgaagaagatgaaatgtgtgtaaattataatgaccaacaccctaatggctggtatatctggatcctcctgctgctggttttggtggcagctcttctctgtggagctgtggtcctctgcctccagtgctggctgaggagaccccgaattgattctcacaggcgcaccatggcagtttttgctgttggagacttggactctatttatgggacagaagcagctgtgagtccaactgttggaattcaccttcaaactcaaacccctgacctatatcctgttcctgctccatgttttggccctttaggctccccacctccatatgaagaaattgtaaaaacaacctgattttaggtgtggattatcaatttaaagtattaacgacatctgtaattccaaaacatcaaatttaggaatagttatttcagttgttggaaatgtccagagatctattcatatagtctgaggaaggacaattcgacaaaagaatggatgttggaaaaaattttggtcatggagatgtttaaatagtaaagtagcaggcttttgatgtgtcactgctgtatcatacttttatgctacacaaccaaattaatgcttctccactagtatccaaacaggcaacaattaggtgctggaagtagtttccatcacatttaggactccactgcagtatacagcacaccattttctgctttaaactctttcctagcatggggtccataaaaattattataatttaacaatagcccaagccgagaatccaacatgtccagaaccagaaccagaaagatagtatttgaatgaaggtgaggggagagagtaggaaaaagaaaagtttggagttgaagggtaaaggataaatgaagaggaaaaggaaaagattacaagtctcagcaaaaacaagaggttttatgccccaacctgaagaggaagaaattgtagatagaaggtgaaggagattgctgaagatatagagcacatataatgccaacacggggagaaaagaaaagttccccttttacagtaatgaatgtggcctccatagtccatagtgtttctctggagcctcagggcttggcatttattgcagcatcatgctaagaaccttcggcataggtatctgttcccatgaggactgcagaagtagcaatgagacatcttcaagtggcattttggcagtggccatcagcagggggacagacaaaaacatccatcacagatgacatatgatcttcagctgacaaatttgttgaacaaaacaataaacatcaatagatatctaaaa

SEQ ID NO: 7425 - DNA, 794 bp, Homo sapiens
cgacttcggtctgcgccggaagtgcatgagctgccgatgtggtgcttagtgattgcggtttcggtcgctctcccgtgtttcccgggctgggtatttgcctcgcaccatggcgcccaagggcaaagtgggcacgagagggaagaagcagatatttgaagagaacagagagactctgaagttctacctgcggatcatactgggggccaatgccatttactgccttgtgacgttggtcttcttttactcatctgcctcattttgggcctggttggccctgggctttagtctggcagtgtatggggccagctaccactctatgagctcgatggcacgagcagcgttctctgaggatggggccctgatggatggtggcatggacctcaacatggagcagggcatggcagagcaccttaaggatgtgatcctactgacagccatcgtgcaggtgctcagctgcttctctctctatgtctggtccttctggcttctggctccaggccgggccctttacctcctgtgggtgaatgtgctgggcccctggttcactgcagacagtggcaccccagcaccagagcacaatgagaaacggcagcgccgacaggagcggcggcagatgaagcggttatagccattgacattgtggccacaggccactggccctgggtggctctgtcagggtgcacagcccctcatgcctggagcaatgagggtctagtccaggggccaaaagcagtctgaggtattgggtatacttatactctatagggtcgttgaataaatggcttagaatgtgg

SEQ ID NO: 7426 - DNA, 1980 bp, Homo sapiens
ggctttgcgcatgcccagagagagtggcgcgagcctgcgttttccggccagaggacatgatgcagggggaggcacaccctagtgcttcccttattgacagaaccatcaagatgagaaaagaaacagaggctaggaaagtggtcttagcctggggactcctaaatgtatctatggctggaatgatatatactgaaatgactggaaaattgattagttcatactacaatgtgacatactggcccctctggtatattgagcttgcccttgcatctctcttcagccttaatgccttatttgatttttggagatatttcaaatatactgtggcaccaacaagtctggttgttagtcctggacagcaaacacttttagggttgaaaacagctgttgtacagactacgcctccacatgatctggcagcaacccaaatccctcccgctccaccttccccttcaattcagggtcagagtgtgttgagttatagcccttctcgttcgcccagtaccagtcccaagttcaccaccagctgtatgactggttacagccctcagctgcaaggtctgtcctcaggtggcagtggttcttatagccctggagtgacctactcgcccgtcagtggttataataagttggcgagctttagcccctctcctccttctccgtaccctaccactgttggaccagtggagagcagtggattgagatctcgctaccgttcttcacctaccgtctacaactcacctactgacaaagaagactacatgaccgacctacgaactttggatacttttctcagaagtgaagaggagaaacagcatagggttaagctggggagcccagattctacctctccttccagcagtcctactttctggaactatagtcgttctatgggggattatgcacaaactttaaagaagtttcagtatcagcttgcctgtaggtctcaggccccatgtgctaacaaagatgaagccgatctcagctctaaacaagccgcagaagaggtctgggcaagagtggctatgaatagacaacttcttgatcatatggattcatggacagctaaatttagaaattggatcaatgagacaatattagtgccacttgttcaagagattgagtctgtcagcacacagatgagacgaatgggttgtccagagctacagataggagaactatctcagggaggttgtatgagctcatttcgatggaacagaggtggcgacttcaaaggacgaaagtgggatacagacctgcccaccgattctgctatcatcatgcatgtattttgcacctaccttgattccagattacctccacatccgaagtatcccgacggaaaaacttttacttctcagcactttgttcagacaccaaataaaccagatgttacaaatgagaatgttttttgcatttatcagagtgctatcaaccctccccattatgagctcatctaccagcgtcatgtatacaacctgccaaagggcagaaataatatgtttcatacattgttgatgtttctctacatcataaagaccaaagagtcaggaatgcttgggagagttaatcttggtctatctggtgtgaatatattgtggatctttggcgagtagcaagtcatatatttaattctgacatttagactatttcactgaaccagaagtcgaaactaaacatctctgagccactgactcttctgaaataaaatacacatgggtgtatgttacagactctttagatttaacagaaaatgtagctgttatgaaatgtaattgtaaaaatatgtcccgtatcttctatatcgagacattgcctttaattttatatcgcttttcagaaatttcagttgactacaaaactgcaacccttcggatttttattgactcaaaatagtgccattccccttaatgaaatagattttgagtctttttttcattgtaacccccaaatgagaatcatctacctgattcttgtacc

SEQ ID NO: 7427 - DNA, 3545 bp, Homo sapiens
gagaagagactacctagttcttccggtaactttagagccgcttgccggtggcctcccgcttgagcttggctttgcgcatgcccagagagagtggcgcgagcctgcgttttccggccagaggacatgatgcagggggaggcacaccctagtgcttcccttattgacagaaccatcaagatgagaaaagaaacagaggctaggaaagtggtcttagcctggggactcctaaatgtatctatggctggaatgatatatactgaaatgactggaaaattgattagttcatactacaatgtgacatactggcccctctggtatattgagcttgcccttgcatctctcttcagccttaatgccttatttgatttttggagatatttcaaatatactgtggcaccaacaagtctggttgttagtcctggacagcaaacacttttagggttgaaaacagctgttgtacagactacgcctccacatgatctggcagcaacccaaatccctcccgctccaccttccccttcaattcagggtcagagtgtgttgagttatagcccttctcgttcgcccagtaccagtcccaagttcaccaccagctgtatgactggttacagccctcagctgcaaggtctgtcctcaggtggcagtggttcttatagccctggagtgacctactcgcccgtcagtggttataataagttggcgagctttagcccctctcctccttctccgtaccctaccactgttggaccagtggagagcagtggattgagatctcgctaccgttcttcacctaccgtctacaactcacctactgacaaagaagactacatgaccgacctacgaactttggatacttttctcagaagtgaagaggagaaacagcatagggttaagctggggagcccagattctacctctccttccagcagtcctactttctggaactatagtcgttctatgggggattatgcacaaactttaaagaagtttcagtatcagcttgcctgtaggtctcaggccccatgtgctaacaaagatgaagccgatctcagctctaaacaagccgcagaagaggtctgggcaagagtggctatgaatagacaacttcttgatcatatggattcatggacagctaaatttagaaattggatcaatgagacaatattagtgccacttgttcaagagattgagtctgtcagcacacagatgagacgaatgggttgtccagagctacagataggagaggctagtattactagcttgaaacaagctgccctggttaaagcgcctctcattccgactttgaacacaatcgttcagtatctagaccttactccaaatcaggaatacttgtttgaaaggatcaaagaactatctcagggaggttgtatgagctcatttcgatggaacagaggtggcgacttcaaaggacgaaagtgggatacagacctgcccaccgattctgctatcatcatgcatgtattttgcacctaccttgattccagattacctccacatccgaagtatcccgacggaaaaacttttacttctcagcactttgttcagacaccaaataaaccagatgttacaaatgagaatgttttttgcatttatcagagtgctatcaaccctccccattatgagctcatctaccagcgtcatgtatacaacctgccaaagggcagaaataatatgtttcatacattgttgatgtttctctacatcataaagaccaaagagtcaggaatgcttgggagagttaatcttggtctatctggtgtgaatatattgtggatctttggcgagtagcaagtcatatatttaattctgacatttagactatttcactgaaccagaagtcgaaactaaacatctctgagccactgactcttctgaaataaaatacacatgggtgtatgttacagactctttagatttaacagaaaatgtagctgttatgaaatgtaattgtaaaaatatgtcccgtatcttctatatcgagacattgcctttaattttatatcgcttttcagaaatttcagttgactacaaaactgcaacccttcggatttttattgactcaaaatagtgccattccccttaatgaaatagattttgagtctttttttcattgtaacccccaaatgagaatcatctacctgattcttgtaccaaaaaaaaatttttttcagtcttttttttttttagagagggtctctgtcaacgcagactggagtgcagtggcacgatcttagctcactacaacttctgcctcccaggctcaagcaattctcctgcctcagcctcctgagtagctgggattacaggcatgcaccaccacgcccagctaatttttgtatttttagtagagacagggtttcaccatgttggccaggctggtcccgaactcctgacctcaggtgatccacccacctcggcctcccaaagtgctgggattataggtgcgagccactgcgcccagcctcagttattttatttaacagtgtaagtacttagaaagtaagaaaattgctgatttagtttttttttttttttttttaatgtttccccagcattctgcaagttaggccaaagcccacattcaaagaaatgagattaactcttaagtaatgtattaagtttatgtatattttaaaatattattaaaggaggtttgaaagtattgacatttaaaaagtcaacacttagattaaatttagctggtagttttaatttgggttttagttaagagtgtgaggacatcaggaaaactgtttactactttggttttagcagctcagttttactattccataatgtgttatttttaaagttctctttttaagatcacagtgatatcctatcttcaaattttttaaatatgttcaaaatatctggagggtgagaagttaccaagtttgtatgttttgtttgactcaccatctttattttctgtatatgtagtagctggcaattgcatatattttcttgattaacatattagagactgcttccatcatcttatgtaaacctggaaacagctgaaactagtcttttctgaagaaccgtgtatcagtgttagatgtgcatcccgttttgtcattccctcagactttgaatacagtcattactctctggaagagaaatgtaagtatattttttgttatctgcagtatggtttaacatgtattaataatacacatatgcagactcactaaagtatccccagtaattagtaaattccaaatttaagtcagtacagttctgtatttgtaaattctgtctttcaaaaagttgttcgtgtttttaaaagttgatgtccaaaggaaaggagcttcttttaagtacttttggtgtatgttgaatatttatttgctatgatattctagaagaaaatatcaaacatgttaaatataagaacatgttaaaatttaaatttgctatttcaaaagttactgaagatgtcttggaataacaattgtcatgctgttaaactagttgcatatacttcattaaaagcaccatggagaaacattttaacaatg

SEQ ID NO: 7428 - DNA, 2322 bp, Homo sapiens
gcttcctgtcttggaatctacgcgggttgtgggagttccgcgcctgctgatctgtcctgggttcagccaagggggatgtggctaggcgttccgcctctctaggggaagggaagaaagaagcaatagggttgctgaagttcgtgcccaggagccggggagggaagctctggactgggaaattgggacgcgggggctgagtggcgcgaaagctattgctctgtcctctgtgggatacgactgcttgtcgctggaacaagttttgcacgatgcagggggaggcacaccctagtgcttcccttattgacagaaccatcaagatgagaaaagaaacagaggctaggaaagtggtcttagcctggggactcctaaatgtatctatggctggaatgatatatactgaaatgactggaaaattgattagttcatactacaatgtgacatactggcccctctggtatattgagcttgcccttgcatctctcttcagccttaatgccttatttgatttttggagatatttcaaatatactgtggcaccaacaagtctggttgttagtcctggacagcaaacacttttagggttgaaaacagctgttgtacagactacgcctccacatgatctggcagcaacccaaatccctcccgctccaccttccccttcaattcagggtcagagtgtgttgagttatagcccttctcgttcgcccagtaccagtcccaagttcaccaccagctgtatgactggttacagccctcagctgcaaggtctgtcctcaggtggcagtggttcttatagccctggagtgacctactcgcccgtcagtggttataataagttggcgagctttagcccctctcctccttctccgtaccctaccactgttggaccagtggagagcagtggattgagatctcgctaccgttcttcacctaccgtctacaactcacctactgacaaagaagactacatgaccgacctacgaactttggatacttttctcagaagtgaagaggagaaacagcatagggttaagctggggagcccagattctacctctccttccagcagtcctactttctggaactatagtcgttctatgggggattatgcacaaactttaaagaagtttcagtatcagcttgcctgtaggtctcaggccccatgtgctaacaaagatgaagccgatctcagctctaaacaagccgcagaagaggtctgggcaagagtggctatgaatagacaacttcttgatcatatggattcatggacagctaaatttagaaattggatcaatgagacaatattagtgccacttgttcaagagattgagtctgtcagcacacagatgagacgaatgggttgtccagagctacagataggagaggctagtattactagcttgaaacaagctgccctggttaaagcgcctctcattccgactttgaacacaatcgttcagtatctagaccttactccaaatcaggaatacttgtttgaaaggatcaaagaactatctcagggaggttgtatgagctcatttcgatggaacagaggtggcgacttcaaaggacgaaagtgggatacagacctgcccaccgattctgctatcatcatgcatgtattttgcacctaccttgattccagattacctccacatccgaagtatcccgacggaaaaacttttacttctcagcactttgttcagacaccaaataaaccagatgttacaaatgagaatgttttttgcatttatcagagtgctatcaaccctccccattatgagctcatctaccagcgtcatgtatacaacctgccaaagggcagaaataatatgtttcatacattgttgatgtttctctacatcataaagaccaaagagtcaggaatgcttgggagagttaatcttggtctatctggtgtgaatatattgtggatctttggcgagtagcaagtcatatatttaattctgacatttagactatttcactgaaccagaagtcgaaactaaacatctctgagccactgactcttctgaaataaaatacacatgggtgtatgttacagactctttagatttaacagaaaatgtagctgttatgaaatgtaattgtaaaaatatgtcccgtatcttctatatcgagacattgcctttaattttatatcgcttttcagaaatttcagttgactacaaaactgcaacccttcggatttttattgactcaaaatagtgccattccccttaatgaaatagattttgagtctttttttcattgtaacccccaaatgagaatcatctacctgattcttgtaccaaaaaaaaa

SEQ ID NO: 7429 - DNA, 585 bp, Homo sapiens
agaggacatggtgcgttttcggggtcgtgtttgtgcttcctgtcttggaatctacgcgggttgtgggagttccgcgcctgctgatctgtcctgggttcagccaagggggatgtggctaggcgttccgcctctctaggggaagggaagaaagaagcaatagggttgctgaagttcgtgcccaggagccggggagggaagctctggactgggaaattgggacgcgggggctgagtggcgcgaaagctattgctctgtcctctgtgggatacgactgcttgtcgctggaacaagttttgcacggtctgtaagagttgagcctagctgaagaaaggaggaattataaatcccaaatgtggaccaaaacaatgcacgttttcccctctctccctcttactccgctcaccaccccatcataaatgcagggggaggcacaccctagtgcttcccttattgacagaaccatcaagatgagaaaagaaacagaggctaggaaagtggtcttagcctggggactcctaaatgtatctatggctggaatgatatatactgaaatgactggaaaattgattagttcatactacaatg

SEQ ID NO: 7430 - DNA, 1961 bp, Homo sapiens
gcgagcctgcgttttccggccagaggacatgatgcagggggaggcacaccctagtgcttcccttattgacagaaccatcaagatgagaaaagaaacagaggctaggaaagtggtcttagcctggggactcctaaatgtatctatggctggaatgatatatactgaaatgactggaaaattgattagttcatactacaatgtgacatactggcccctctggtatattgagcttgcccttgcatctctcttcagccttaatgccttatttgatttttggagatatttcaaatatactgtggcaccaacaagtctggttgttagtcctggacagcaaacacttttagggttgaaaacagctgttgtacagactacgcctccacatgatctggcagcaacccaaatccctcccgctccaccttccccttcaattcagggtcagagtgtgttgagttatagcccttctcgttcgcccagtaccagtcccaagttcaccaccagctgtatgactggttacagccctcagctgcaaggtctgtcctcaggtggcagtggttcttatagccctggagtgacctactcgcccgtcagtggttataataagttggcgagctttagcccctctcctccttctccgtaccctaccactgttggaccagtggagagcagtggattgagatctcgctaccgttcttcacctaccgtctacaactcacctactgacaaagaagactacatgaccgacctacgaactttggatacttttctcagaagtgaagaggagaaacagcatagggttaagctggggagcccagattctacctctccttccagcagtcctactttctggaactatagtcgttctatgggggattatgcacaaactttaaagaagtttcagtatcagcttgcctgtaggtctcaggccccatgtgctaacaaagatgaagccgatctcagctctaaacaagccgcagaagaggtctgggcaagagtggctatgaatagacaacttcttgatcatatggattcatggacagctaaatttagaaattggatcaatgagacaatattagtgccacttgttcaagagattgagtctgtcagcacacagatgagacgaatgggttgtccagagctacagataggagaactatctcagggaggttgtatgagctcatttcgatggaacagaggtggcgacttcaaaggacgaaagtgggatacagacctgcccaccgattctgctatcatcatgcatgtattttgcacctaccttgattccagattacctccacatccgaagtatcccgacggaaaaacttttacttctcagcactttgttcagacaccaaataaaccagatgttacaaatgagaatgttttttgcatttatcagagtgctatcaaccctccccattatgagctcatctaccagcgtcatgtatacaacctgccaaagggcagaaataatatgtttcatacattgttgatgtttctctacatcataaagaccaaagagtcaggaatgcttgggagagttaatcttggtctatctggtgtgaatatattgtggatctttggcgagtagcaagtcatatatttaattctgacatttagactatttcactgaaccagaagtcgaaactaaacatctctgagccactgactcttctgaaataaaatacacatgggtgtatgttacagactctttagatttaacagaaaatgtagctgttatgaaatgtaattgtaaaaatatgtcccgtatcttctatatcgagacattgcctttaattttatatcgcttttcagaaatttcagttgactacaaaactgcaacccttcggatttttattgactcaaaatagtgccattccccttaatgaaatagattttgagtctttttttcattgtaacccccaaatgagaatcatctacctgattcttgtaccaaaaaaaaa

SEQ ID NO: 7431 - DNA, 1984 bp, Homo sapiens
gcgagcctgcgttttccggccagaggacatgatgcagggggaggcacaccctagtgcttcccttattgacagaaccatcaagatgagaaaagaaacagaggctaggaaagtggtcttagcctggggactcctaaatgtatctatggctggaatgatatatactgaaatgactggaaaattgattagttcatactacaatgtgacatactggcccctctggtatattgagcttgcccttgcatctctcttcagccttaatgccttatttgatttttggagatatttcaaatatactgtggcaccaacaagtctggttgttagtcctggacagcaaacacttttagggttgaaaacagctgttgtacagactacgcctccacatgatctggcagcaacccaaatccctcccgctccaccttccccttcaattcagggtcagagtgtgttgagttatagcccttctcgttcgcccagtaccagtcccaagttcaccaccagctgtatgactggttacagccctcagctgcaaggtctgtcctcaggtggcagtggttcttatagccctggagtgacctactcgcccgtcagtggttataataaggtaatgactctcttctcttgtctagtcacattattttagaattgagaggtatactaaaaatcatctaatgagtcaaaacttatcagtgagcaaactgagagttgatttgcccagaacacccatttaaaaaccgagaatagaacataatatcttaaacacaacatcttaaaatgaaagagaaaaaattagcatttacagagataacaaacttagtgcaccatctacgatctttcagctgtctttaaaacaagttgaaacaaggataattttttactttagttgcttttactcctgttttccctcttgctttccttcttcatgtgaggcctttgtatacctttttagagttttagtgtggtttatcatgttggagtgtcttctaagctaaaagctgagattgtcacatagtttcttttttttttccaatgagtacaaatgattcttgaatatggacgctttccatggaatagtaggaaccttcatttccactcccacagtaatgtgaaattttgttctaatttttaggattaatagaaacaggattgacaaattgaaattttgactccttcttgaagcataaaactattaatttttttttttttttttttttttgagacagagtctcgctctgttgcctagactggagtgcagtggcgtgatctcagctcactgcaaactccgcctcccgggctcatgccattctcctgcctcagcctcccgagtagctgggactacaggcgtccaccaccgtgcccggctaattttttgtactttcagtagagacggggtttcgccatgttagccaggatggtctcgatctcctgaccttgcgatctgccctcctcgacctcccaaacatttacacatttctttgtaatgaaattccatactactggttatccaatattaaaattaattttggcaggtaatagaattttgaaaattttgtacaagttaaatttttatgagaaagtatatatgtagtgaaaattaataactcataggtaaatgtgacttttaaaaataatttttcacaagatgatactatatgatccttatagaaaattggaaaagtaaaacagaaggaaaattattatagtcctgccacacaaaaataatctgtttaatggctatttaatactcatctaatggatataccataatttactcttgaatgtttaagtcattttcatttataaaaaaactttttaatgtatactaaatagccctgtacataaaattattgataaatttgggatgggagtgtcgatccaaaagaattgtaccaatttacattgtcacagaaatgtagaagagtgtttgttttaccacactgttgaccatcaagttaattttttaaaaaaataaatctctgctaataag

SEQ ID NO: 7432 - DNA, 507 bp, Homo sapiens
ctttgcctggaaggtctcagctgtgatgctcctcggaggctggctcctgttggccttcaatgcaattttcctcctgtcttgggctgtggcccccaaagggctgtgcccaaggagaagcagtgttccaatgccaggggtgcaggcagtggcagctactgccatgattgtgggtctgctgattttcccaatcggccttgcctccccattcatcaaggaagtgtgcgaagcctcctccatgtattatggtgggaagtgccggctgggttggggttacatgactgctatcctcaatgcagtcctggccagcctcctgcccatcatcagctggccccacacaaccaaggtccaagggaggaccatcatcttctccagtgccaccgagagaatcatctttgtgccagaaatgaacaaataaaaatctcctgggagtagcacaaagggcacactccagagttttatgaaatcatcatgtagccaacttcaaatcccatctctgctccttcttgc

SEQ ID NO: 7433 - DNA, 866 bp, Homo sapiens
cattgttctacaagctaaattattccttcaaaggagaggagaattgtataaggtcacagacgtggatccaaagccggagcctgagcagaggtggccacgctggagggtcttgacctaaagtgtgaccccgaccttctcctttggcatcctcacctactgctcctggcctcagggcaacagttggaaccagagctgcgtgaccttcagttccctggaggatattcctgactttgcctggaaggtctcagctgtgatgctcctcggaggctggctcctgttggccttcaatgcaattttcctcctgtcttgggctgtggcccccaaagggctgtgcccaaggagaagcagtgttccaatgccaggggtgcaggcagtggcagctactgccatgattgtgggtctgctgattttcccaatcggccttgcctccccattcatcaaggaagtgtgcgaagcctcctccatgtattatggtgggaagtgccggctgggttggggttacatgactgctatcctcaatgcagtcctggccagcctcctgcccatcatcagctggccccacacaaccaaggtccaagggaggaccatcatcttctccagtgccaccgagagaatcatctttgtgccagaaatgaacaaataaaaatctcctgggagtagcacaaagggcacactccagagttttatgaaatcatcatgtagccaacttcaaatcccatctctgctccttcttgctgtgtgacttcaggcaagccactttacctctctggaacagttttttcttctggaaaatgaaagttgaaatcatacctacctcataaggttgttctgagaattcactggagatgctctgtgtaaataaagca

SEQ ID NO: 7434 - DNA, 695 bp, Homo sapiens
atgttgagcagtgtgtgggtagctctggggctctctctgacctgcacctcagccttcagcctcatctcccctgcctggttccagaccccgaccttctcctttggcatcctcacctactgctcctggcctcagggcaacagttggaaccagagctgcgtgaccttcagttccctggaggatattcctgactttgcctggaaggtctcagctgtgatgctcctcggaggctggctcctgttggccttcaatgcaattttcctcctgtcttgggctgtggcccccaaagggctgtgcccaaggagaagcagtgttccaatgccaggggtgcaggcagtggcagctactgccatgattgtgggtctgctgattttcccaatcggccttgcctccccattcatcaaggaagtgtgcgaagcctcctccatgtattatggtgggaagtgccggctgggttggggttacatgactgctatcctcaatgcagtcctggccagcctcctgcccatcatcagctggccccacacaaccaaggtccaagggaggaccatcatcttctccagtgccaccgagagaatcatctttgtgccagaaatgaacaaataaaaatctcctgggagtagcacaaagggcacactccagagttttatgaaatcatcatgtagccaacttcaaatcccatctctgctccttcttgc

SEQ ID NO: 7435 - DNA, 1155 bp, Homo sapiens
ccatggtgtttcccccaaacacccagcataagttcacctctggcagagttgctttccagctcctgcaggtgggagtcgactcacctgcagcaggcactcggcacaactccgcaggaccggctcacctgcaccgggcactcagcacagcctccagcatgcagcgcctccccgctgccacccgggccaccctgatcctcagcctggcctttgcctccctccactcggcttgctcggcagcaagcagcagcaacagctcaagcttgaccgctcaccacccagaccctgggaccctggagcagtgcctcaacgtggacttctgcccacaagcagcccggtgctgccgcacaggagtggacgagtacggctggatcgcggcagctgttggctggagcctctggttcctcaccctcatcctgctctgtgtggacaaactgatgaagctgactccagatgagcccaaggacttgcaagcgtgagacccaggctcggtgcacaaaatggtgatcgccaccaatttgtggctaatggggaaggggagtaaggctaacatggtttctattatttaagtcattttcacctttaagcttcagttacttttacaagggaaagaagaaagagcgggagaaccaaataaggcaagccagtgctgcccttgcatgtcactcccaagggcccctgggctgtgcccaggtaactcctctctcaagatagtccctctgtaatgtatcctgttttaacctttcttctaggcaccaagggaggtgcacaagaaactataagacttagtctcatcatcaacattttcagaagcaagtgcataaccttctcaccaaaaccaggttatctgcttctgtccctggcttgagtcctgggcttaactgtcatttcagaatctgagaatcagtcaggtatggtggctcatgcctgtaatcccagcactttgggaggcagaggtgggcagatcactcaaggtcaggagttccagatcagcctggccaacatggtgaaaccctgtctctactaaaaatacaaaaattagccaggtgtggtggtgcacacctgtaatcccagctacttgggaggccgaggcaggagaatctcttgaacctcggaggcggaggttgcagtgagccaagatcatgccactgcactcca

SEQ ID NO: 7436 - DNA, 4167 bp, Homo sapiens
atggtgtttcccccaaacacccagcataagttcacctctggcagagttgctttccagctcctgcaggtgggagtcgactcacctgcagcaggcactcggcacaactccgcaggaccggctcacctgcaccgggcactcagcacagcctccagcatgcagcgcctccccgctgccacccgggccaccctgatcctcagcctggcctttgcctccctccactcggcttgctcggcagaagcaagcagcagcaacagctcaagcttgaccgctcaccacccagaccctgggaccctggagcagtgcctcaacgtggacttctgcccacaagcagcccggtgctgccgcacaggagtggacgagtacggctggatcgcggcagctgttggctggagcctctggttcctcaccctcatcctgctctgtgtggacaaactgatgaagctgactccagatgagcccaaggacttgcaagcgtgagacccaggctcggtgcacaaaatggtgatcgccaccaatttgtggctaatggggaaggggagtaaggctaacatggtttctattatttaagtcattttcacctttaagcttcagttacttttacaagggaaagaagaaagagcgggagaaccaaataaggcaagccagtgctgcccttgcatgtcactcccaagggcccctgggctgtgcccaggtaactcctctctcaagatagtccctctgtaatgtatcctgttttaacctttcttctaggcaccaagggaggtgcacaagaaactataagacttagtctcatcatcaacattttcagaagcaagtgcataaccttctcaccaaaaccaggttatctgcttctgtccctggcttgagtcctgggcttaactgtcatttcagaatctgagaatcagtcaggtatggtggctcatgcctgtaatcccagcactttgggaggcagaggtgggcagatcactcaaggtcaggagttccagatcagcctggccaacatggtgaaaccctgtctctactaaaaatacaaaaattagccaggtgtggtggtgcacacctgtaatcccagctacttgggaggccgaggcaggagaatctcttgaacctcggaggcggaggttgcagtgagccaagatcatgccactgcactccagcctgggcggcagagcaagactctgtatcagaaaaaaaaaaaaaaaaaagaatgtgaggatcaggtgggcatggtggctcatgcctgtaatcccagcactttgagagactgagacaggaggatcactttagcccaggaattcgagaccagcctgggcaagatggcaagaccttgtttctgtttaaaaactttttaaagttaaaaataaaaatgtgagaatccccttgacactcccaccatcttcacccccacctcaggtccttctccagctctccttctggcttcatcctgtcttccacggctctcctgtcccacctattctccctgccggtgcccaagttttagccttcactgccttcccctagaacacgccagggatattgcattctgtcctcactgtcttgaggatcttcctccccggctcatcactccccatgggcagctgccagggtaggcgctgtcaccttctgttgacaacagtcagtagctcctaaggactaaaactgttcagcccagcattcagctctttggaggagtccatctgtcccccagcacatccaggagtaaggattccgactggtccactcctcatcctggtgtcttcagcttctctgctgccatgttctttgctgggatggctgcttcccaactccacctccagaatcaaggatattcctccaagcccagctcgaatgcttgatctgcctggagccttcctggtcatccttgggtgacctggagctggtgctgttagagcacttctgctctgccctgatgtgcagttgttgtgaatgggccactccatagtttatccttcctcacacccctggggcatagtaccctattcaagtttgtccaatgagtgcatgggtgaattaatgaatgaatgaacaaatgagtctttgccctagacaacttaaggtcctcactctgcattaggagcctccatttttctccagatggttgaaataaccagcctctgaaggagccaatggtttggtcactgctctctcagcaaattacagtcactgtcacttagcatggagagtggacgttgcacatcactgtgaaaccttgcagaggaggagagggcaggttcatcagaagaaagaaaggacaaaatgactccttatgaagcattttgtgccttctgtgagaaaacatgtatttagatcagataaactctagtcaaaatacaaaaaggaaaaatgaaagacctctgaaataggaacaatctcttgaagaggcaaatgactcaaaactgctcagtggctctttcagaaaatctaagtaaagttccctgacaacagaaactgaagagattgcctggttcatcttgtagtcttccaaaacagcagataatttctgaatctcagatgttgaatcagtgcaacgggatggatttcttgttcctaagtgttaaatgatcacatacataaaagagtctgagcctgagcaacataatgagaccctgtctctacaaaaaaaaaaaaaagattagccaggcgtggtggtgcacactgatagtcccagctactcaggaggctgagggaggcggatcacttgagctagagagttcaaagctgcagtgagccatgtttgtgccactgcactccagcctgggcaacaaagtgagaccctgtctggaaaaaaaaaaaaaaaaagcgtctgcataattcctggtgcattttgtggatatacaatatgagtatgtgttccatgttttcagaaattcaaaggaagcgtttccacaatatgtgacggtttatttcccaagagatgaaaagattcattaaggtgcatgctttgatttaacatctgcaaacatttaaaaaatataacagtgtgtgacgtagcagtgagagtactatctttttttaaaaagggaaattaagatttatttctggccaatgtgaacagaaataagtcactttatctcactgagcaccaattttacacgtggaaaatagaagaattggaccaaatcagcagtttcaagctgagttgcaaaagttcatggaaccatttcagtcgcttcatggaatcggggtaggcatgaggcccgttgttctttcaacctgagccgcatggctcttgtgtctttaaaccttgtggtaggatttttttttttttctgctttaataagtgaagggtcagggcaccagttggtgtctgagatgccctccagtctggggaaccccgtagatgcttagactactttgaactgaagtatgtgcagtctgccatctcacattaaaatgtaggcattttgtcaattgcttttctttcatctgcacaagaggaaggagagaacgaatcaatacaaccactcttttccttgagactgcaaagaaaatggttctatagtttgatggttctacttcccagatgctacctctcagatttattctcaacagaaaattttttgattacagcagaccagatctttatctgtcaataagttaaaaaagataatctgggctggatgtggtggctcactcctgtaattccagcacttcgggaggccaagacaggaggattgcttgagcccaggaatttgagaccagcctgggcaacatggcgaaaccccacctctacaaaaaaatacaaaaaaattatttgggactggtggcgcatgcctgtggtcccagctactcgggaggctgaggtgggaagatcatttgagcccaggaggttgaggctgcagtgagctatgatcttgccactgcactccagcctgggtgacagagtgagaccttgcctcaaaaagaaaaaaataaagaaaagaaaatctgaaagggaaagcaggcatcaacttccagggatctaataacttcctaacttaaagcaacagaacttacctaacttttggacttttcattttaaaactttgcctctagcagtggacactgtcctcaacacagctacagtttatgtaacacagagtccatattatatggggcatgtctgtatcaaaatgtcatatgtagaaataaagtattaaatattaa

SEQ ID NO: 7437 - DNA, 2990 bp, Homo sapiens
gcggcgcgctcgcgccggaccggaaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatgattatccctacagcctggtgagccgggagctacgtgggatcatccgagggctgctggcgaaggcagcagggtctctggagctcttttttgaccactgtctgttcaccatgttgcaagagctggataagacaccaggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctaggcaagtggccagttgcctccacctcagttcttccatctttggtggggacagggcccagcagcatctcagcctcctacccacaattccactgaacacttttctggccctactgcacatggcccccagcctccatccttgtgctggtagcctctcacaactccgcccttgccctctgccttccacttccttccatctcatttctaaaccccaaacagctcatctctaaaaagatagaactcccagcaggtggcttctgtgttcttctgacaaatgattcctgcttctccagactttagcagcctcctgttcccattcttggtcacagctctagccacagcagaaggaaaggggcttccagaagaatatagcaccgcattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttctag

SEQ ID NO: 7438 - DNA, 2700 bp, Homo sapiens
gcggcgcgctcgcgccggaccggaaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatgattatccctacagcctggtgagccgggagctacgtgggatcatccgagggctgctggcgaaggcagcagggtctctggagctcttttttgaccactgtctgttcaccatgttgcaagagctggataagacaccaggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctagactttagcagcctcctgttcccattcttggtcacagctctagccacagcagaaggaaaggggcttccagaagaatatagcaccgcattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttcta

SEQ ID NO: 7439 - DNA, 2830 bp, Homo sapiens
aaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccaagggcttcggcatgattggccccaaggacttcttcccacttctggactttgcctatatgccgaacaactccctgacacccagcctgcaggagcagctgtgtcagctctacccccgactgaaagtgctggcatttggagcaaagccggattccaccctgcatacctacttcccttctttcctgtccagagccacccctagctgtccccctgagatgaagaaagagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctaggcaagtggccagttgcctccacctcagttcttccatctttggtggggacagggcccagcagcatctcagcctcctacccacaattccactgaacacttttctggccctactgcacatggcccccagcctccatccttgtgctggtagcctctcacaactccgcccttgccctctgccttccacttccttccatctcatttctaaaccccaaacagctcatctctaaaaagatagaactcccagcaggtggcttctgtgttcttctgacaaatgattcctgcttctccagactttagcagcctcctgttcccattcttggtcacagctctagccacagcagaaggaaaggggcttccagaagaatatagcaccgcattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttct

SEQ ID NO: 7440 - DNA, 974 bp, Homo sapiens
gcgccggaccggaaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgc

SEQ ID NO: 7441 - DNA, 2824 bp, Homo sapiens
aaagccggggaagtggccgaggagggagggctgcgagccatggcgaccaagacggcgggcgtggggcggtgggaggtagtgaagaagggtcggcggcctggggtcggcgccggcgccggcggccgaggaggcggcaggaaccgcagggcgctcggggaagcaaacggagtgtggaaatacgacctgacccctgcaatccagaccacaagcaccctttatgagcggggctttgagaatatcatgaagcggcagaataaggagcaggtcccaccccctgctgtggaacctaagaaaccagggaacaagaagcagccaaagaaggtggcaactcctcccaaccaaaaccagaagcagggccgcttccgcagcctggaggaagcactgaaagctctggatgtggcagacctgcagaaggaactggacaagagccagagtgtgttctctggaaacccatccatatggttgaaggacctggccagctatctcaactacaagctacaagctcctctaagtgaacccacgctgagccagcatactcatggggagtcactacatggttaccgcatctgtatccaggccatcctgcaagacaagcccaagattgccacggcaaacctaggcaagttcctggaactgctgaggtcccaccagagccgaccagcaaagtgtctcaccatcatgtgggccctgggtcaagcaggttttgccaacctcaccgagggactgaaagtgtggctggggatcatgctgcctgtgctgggcatcaagtctctgtctccctttgccatcacatacctggatcggctgctcctgatgcatcccaaccttaccgggcttcggcatgattggccccaaggacttcttcccacttctggactttgcctatatgccgaacaactccctgacacccagcctgcaggagcatgtcagctctacccccgactgaaagtgctggcatttggagcaaagccggattccaccctgcatacctacttcccttctttcctgtccagagccacccctagctgtccccctgagatgaagaaagagctcctgagcagcctgactgagtgcctgacggtggaccccctcagtgccagcgtctggaggcagctgtaccctaagcacctgtcacagtccagccttctgctggagcacttgctcagctcctgggagcagattcccaagaaggtacagaagtctttgcaagaaaccattcagtccctcaagcttaccaaccaggagctgctgaggaagggtagcagtaacaaccaggatgtcgtcacctgtgacatggcctgcaagggcctgttgcagcaggttcagggtcctcggctgccctggacgcggctcctcctgttgctgctggtcttcgctgtaggcttcctgtgccatgacctccggtcacacagctccttccaggcctcccttactggccggttgcttcgatcatctggcttcttacctgctagccaacaagcgtgtgccaagctctactcctacagtctgcaaggctacagctggctgggggagacactgccgctctggggctcccacctgctcaccgtggtgcggcccagcttgcagctggcctgggctcacaccaatgccacagtcagcttcctttctgcccactgtgcctctcaccttgcgtggtttggtgacagtctcaccagtctctctcagaggctacagatccagctccccgattccgtgaatcagctactccgctatctgagagagctgcccctgcttttccaccagaatgtgctgctgccactgtggcacctcttgcttgaggccctggcctgggcccaggagcactgccatgaggcatgcagaggtgaggtgacctgggactgcatgaagacacagctcagtgaggctgtccactggacctggctttgcctacaggacattacagtggctttcttggactgggcacttgccctgatatcccagcagtaggccctgccttcctggccactgatttctgcatgggtagaccatccaagactgcagcgggtagaaggtggcagttcttcatgggagtctttttaacttggtgcctgagttctctcctaggcaagtggccagttgcctccacctcagttcttccatctttggtggggacagggcccagcagcatctcagcctcctacccacaattccactgaacacttttctggccctactgcacatggcccccagcctccatccttgtgctggtagcctctcacaactccgcccttgccctctgccttccacttccttccatctcatttctaaaccccaaacagctcatctctaaaaagatagaactcccagcaggtggcttctgtgttcttctgacaaatgattcctgcttctccagactttagcagcctcctgttcccattcttggtcacagctctagccacagcagaaggaaaggggcttccagaagaatatagcaccgcattgggaaacagcagcctcacctccacctgaagcctgggtgtggctgtcagtggacatggggagctggatggaaatgcctctcacttcaaaatgcccagcctgccccaaatgcctctaagcccctccctgtcccctcccttgtagtcctacttcttccaactttccattccccatcatgctgggggtcttggtcacaaggctcagcttctctccactgtccatccctcctatcatctgtagagcagagcacaggcagttgtgtgccttgggcccagggaaccctccatcaacctgagacaggactcagtatatggttcttgggtatgccctaccaggtggaataaaggacacagatttgatttct

SEQ ID NO: 7442 - DNA, 3581 bp, Homo sapiens
gatgtaacaaggccaggctcgcgccgcgtcccctctttcccagactcagtgctccctcctcctcccgcgccccgcgctctgcgcgctgagctggcgccgggctccgcttgcacagcaccgggaccgacgggcactgctgggagagccgctctcccaggttccacctccccgatgcagagtccgtgggggaaaccaggctttcctcccagaaccaagggagcgagccgagggggcagctgctgtgggggcttctgaggagacagcctggcttctttccctacttcctggagagggcaggaaacctcagaatagaggaacgctgctccctggtcagcaagcagcccccaacctggatggagtgaaacatgcggcctgatgacattaacccgaggactgggctggtggtggccctggtcagtgtcttcctcgtctttggtttcatgttcaccgtctctgggatgaaaggggagactttgggaaacatccccctcctggccatcgggccagccatctgcctaccaggcatcgcagccattgccctggccaggaaaaccgagggatgcaccaagtggccagagaacgagctgctgtgggtccgcaaattgccctgcttccggaaacccaaagacaaggaggtggtagagctgctgaggaccccttcagacctagaatccggcaaggggagctcagatgagctggctaagaaggcgggcctcagggggaagcctcccccacaaagccagggtgaggtgtccgtggccagctccatcaacagccccacacccacggaggaaggagaatgccagagcctcgtccagaatgggcatcaggaggagacgtccagatacctggacggctactgcccctcgggcagttccctcacctacagtgccttggacgtcaagtgctcagcaagggacagatctgagtgccctgagcctgaggatagcatcttctttgtgccccaggacagtatcatcgtttgctcctacaagcagaacagcccgtatgacagatactgttgttatatcaatcagatacaaggcaggtgggaccacgagaccatcgtctaatctctgcctacaaaggtggctggattgatagaatatgactaagcccagctccccgtggaagcaaattgctctgcttggagagccttcacactgttagaaattgacctggtatgtgatgggtgtgataacctctggtacccgagagtcatgtaaataggcatgttggggacacattttagggaagggcgatgagggttaaggacactggaagaggcagtgggtaggaaaggaagctactccagttgcttcttaacaatttacacaatgttaaatgttttgtaaaataacccaaaaagtgctatccagaaccagctgagagcaagataaatctagagtgggctgcagatgtgaggcatcaaatgatgcatgagctgaccacagggaaactgagctgctttatgtttgaataagttgaaaataaaattaatgatccgttatataaagtaatttttgcctggttaaaagcttatcacacttggtatttgctgaaagaaaaaaaaatcaagatacaagagttaaaccctccttagatgggatggtttttgggaaaagggtagttaaagagagttggattatgtaactgagtcttgtggcattattgtctgacaagatcatggtctctaataaagtaaaataagtgtgagcagctatgtgaaaagttaacatttttagatggctatgttacttcttaaactcttcgtttaaatccatttattgcatctttatctgaaatgggttttttctaaacatttactatcattcatgtattatttccttaccaggtgcaacattatttgaaatgatactttcatagattggaatttgttttcatcaagacaaaatgaattttacatatatatccaagtctttaacattggcagacatgtactgataattaccattcctacataccttttaaaatctgaaaactataaagtctacacattagccttgaacattgcacataatttgtatgaaatgcaatggttaaacctttggaagtgtcattatttgtacatttgttcaactcctctcacagactgtaaatgccagtgaaacaagaactcatctactaaatttaactgaagcctagattttattaagctcacctgatcagtgaacattacatgataaaagtctctttatttcatacatttttgctgctgaggaaaacaacaaatcacaatgatatcctaaaatgtgctttctatttcacttgctcaactgcaatagataagaaggctatcaagcagaatgccatttgatccccggtgaagaaaaatatgaattatatataggaatggtgatagagttcatcttgaagatcagaagtattttgtatccttcaaagaatgatcattttaagtgatcatatagtcttagtcactttctcccaaaaggggaattgaggacaaaaatttgggcatatatgttttgtgtatttcaattccaactctgcaattctttcttaagtatagcaattgttctgtcttaagaatcatggtatttttaaaaaatcataattttcaagtcaagttcaagatcaaaaatatgtaattattttagtagggcttaaatatcagaaatgagatgcatgatcttgggcaaattttatcttcttacacctgagtttcctactctgtgaagggagggggaactgatttacacttgattatttctatcattcattttcagtgtaaatattctatggtgttatgtcaaaggcattttatatattgccaggaaatgagttacagcaaaatgcatgccaaagttatgaaatttatgataattatgtgacatacattgcacagctactactcaaaaaagaattttgtagatgtatgaaagcagattattcaacacaatgcattcctgagaataaaatgaacataatcagagtaaaatatttttgaggagaaaacttaaaatgttggtataactcaaagtaatctaatacacaaccttgcactaaatgtgattgacatttggatttgggatggggagagatagtttcctaaaatcacagtaacttttaataattgtaatgcattttgaaaacagagaatcatatttttataatggtgagaactatgcaataactctttaggaatgaaaacttcctttaagaagtttgccaccgttagagatgaggagatagtgagacagagagatgttcacagagactcagcaaatcttagacaataatgctgcaattttctgaaagaagatgcttgcagtgtcaggtatggtttgggggttggaaaagttacttttctgatttcttggaaccatttaaaactcctttatatcattctgtctctttccaaattgagggtcaactactagtttagagatataaggtattttatcttgttttcaagttctacttcagaagaaaacctatttcatgtttcttctcccattacctacttaagatacttaaggtatttaagtatgcatttgaggaaatattttcctgtgctaaaataaaggtttgcaaatgtt

SEQ ID NO: 7443 - DNA, 1546 bp, Homo sapiens
agttcctacccgcgagagggaagaagcaggaggtctcagcatgaaacagcagcagtggtgtgggatgactgccaaaatgggcaccgtgttgtcaggggtcttcaccatcatggccgtagacatgtatctcatctttgaacagaagcacctagggaatggcagttgcactgagatcacaccaaagtacaggggtgcaagtaacatcataaataacttcatcatctgctggagttttaaaatcgtcctcttcctgtctttcatcaccatcctcatcagctgcttcctcctgtactcagtgtatgcccagatcttcaggggcctggtcatctacattgtctggatttttttctatgaaactgcaaacgtcgtaatacaaatcctcaccaacaatgactttgacattaaagaggtcagaatcatgcgctggtttggcttggtgtctcgtacagtcatgcactgtttctggatgttctttgtcatcaactatgcccacataacctacaaaaaccggagccagggcaatataatttcctacaagagacgaatttctacagcggagattctccacagcagaaataaaagattatcaatttcgagtgggttcagtggctcacacctggaatcccagtactttgagaggcagagcttccacactagcatatttacctgtctgtctccagtgccaagctcagcccccagcacctgtagatacacaatagatgtctgctgagaggtgctctggtaaaacaagtataaaatgaatgtcaggatgttctccctcatggtgggcatcttctctgtccttaataccacccagttcttcatctttgacctgaaccagaagacacacatttgctatgaggccaagttcagcatctacgtggactcaaagtcggagctagtcacttggaccctgttccacagggctaatatcagcactggcctctccctcaccaccatcatcatcggctgcttcctcttttattgtatccacaagaatatctacatggggctgctgatctatgccatgtggatcatcacttacgagctcatcaacttctccatagtcctgctcctcaacgggatcatcaaagatcacttcaagacgctgagttatttgcactggatcttccaaatctcacacatgctcctgcactttttctgtctgcccttcatcgtcaagcatgcatacaacctttacaaggaatcccagactgtgggcaggaaacgccgccacaggctctgctccaccattgcagtgaactcatgactacctgtccgtctgggaatgttgtaccggaagttaaactgaaccatgccagatgccaggaaaggtgggagggaatggtgttcctcaacaatggaaccctccctaccctgcctgtcttctgttgatgctgcttggtttgtcagggcttttgagttttacgcactgaggaatgattctcgggagagggcaggttgtgcggatcaattattttacagatgtgttgtgtgacttgttttagcagttaatgatatgtggccttgtgcttacttaaccatc

SEQ ID NO: 7444 - DNA, 1489 bp, Homo sapiens
ttggacgagccgagaggcggggctcaaagttcctacccgcgagagggaagaagcaggaggtctcagcatgaaacagcagcagtggtgtgggatgactgccaaaatgggcaccgtgttgtcaggggtcttcaccatcatggccgtagacatgtatctcatctttgaacagaagcacctagggaatggcagttgcactgagatcacaccaaagtacaggggtgcaagtaacatcataaataacttcatcatctgctggagttttaaaatcgtcctcttcctgtctttcatcaccatcctcatcagctgcttcctcctgtactcagtgtatgcccagatcttcaggggcctggtcatctacattgtctggatttttttctatgaaactgcaaacgtcgtaatacaaatcctcaccaacaatgactttgacattaaagaggtcagaatcatgcgctggtttggcttggtgtctcgtacagtcatgcactgtttctggatgttctttgtcatcaactatgcccacataacctacaaaaaccggagccagggcaatataatttcctacaagagacgaatttctacagcggagattctccacagcagaaataaaagattatcaatttcgagtgggttcagtggctcacacctggaatcccagtactttgagaggcagaggaggtgctctggtaaaacaagtataaaatgaatgtcaggatgttctccctcatggtgggcatcttctctgtccttaataccacccagttcttcatctttgacctgaaccagaagacacacatttgctatgaggccaagttcagcatctacgtggactcaaagtcggagctagtcacttggaccctgttccacagggctaatatcagcactggcctctccctcaccaccatcatcatcggctgcttcctcttttattgtatccacaagaatatctacatggggctgctgatctatgccatgtggatcatcacttacgagctcatcaacttctccatagtcctgctcctcaacgggatcatcaaagatcacttcaagacgctgagttatttgcactggatcttccaaatctcacacatgctcctgcactttttctgtctgcccttcatcgtcaagcatgcatacaacctttacaaggaatcccagactgtgggcaggaaacgccgccacaggctctgctccaccattgcagtgaactcatgactacctgtccgtctgggaatgttgtaccggaagttaaactgaaccatgccagatgccaggaaaggtgggagggaatggtgttcctcaacaatggaaccctccctaccctgcctgtcttctgttgatgctgcttggtttgtcagggcttttgagttttacgcactgaggaatgattctcgggagagggcaggttgtgcggatcaattattttacagatgtgttgtgtgacttgttttagcagttaatgatatgtggccttgtgcttacttaaccatct

SEQ ID NO: 7445 - DNA, 1034 bp, Homo sapiens
tagagcctgggggagagtggatccaggtgaagggggcagaggactgggagttttcatcctcttgaataagaactcgacaacagagtgggaactttctgtcttgtgatccattgcctggtgagtcacagctcacaccatggatttaacctgagagcttcaacttctgctttggccctggagttcccatgccctggtgtcttctaccagttcttaggctttctgtatttgtctgaatgctttcacgggagtgtgttgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaaaacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacctgggcttctggttct

SEQ ID NO: 7446 - DNA, 2104 bp, Homo sapiens
cttcaggcattagattctcataaggagcctgcaacctagatgcttcgcacgtgcagtccacactagggttcgtgctcctgtgagaacctaatgccgctgccactgataggacaggaggcgaagctcaggtggtaaggctggcttgcctgctgctcacctcctcctgtgcggcccagttcctaaaaggccatggaccagtaccagtccatggcccaggggttggggacccctgccctagagcctttggagggagcacagccctgctgacacctttattttggattgctggcctgtgagaaaataaatttctattttgagctgctaattaggaaactaatagataccccatcgcgcttatatctcacttacccatcctgtaacatggctatagtaatacctttctcagaagcttcgctccgggattcaatgagatatgtttgtacggcacttagcacacagtgaatgttcaaaaatagtgatggctgttcctcttctttaaggactgggagttttcatcctcttgaataagaactcgacaacagagtgggaactttctgtcttgtgatccattgcctgtgtgttgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaaaacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacctgggcttctggttctttttgataatatataaaattattcattatgaggttgcagttgtttgcaaaggagaggcactcaaatttgaaaggttattttaatgtgataatttggaagacttactcagatgttggtcattgaccactctgtgcatatatttctgcagagctctgtgaaggcaatgagtgtcacttccctctgctctaataaagcaataaataatagctaaagggctgactttcacttcgaactcttggccacggctttttaatcaagttctttaggtttccttgggattagaggaaaggtatggaaatattgttttttgttttttgtcttgccatgtatctgtaggtttttttcttccatgatgtggtgggctgtgtgtgccttatttaattaccatgagtccattttggggtgtcttcacttttcatctttgtagccctttctccaaagctagtgaggaaggtatattctcaacatcagatataactctatacctgtctgatctcccagaccaaatgaaatttgcattaaatggaggggccctggtcaggttccactttggaagtctgatcctgactccctagagccatttgaaaaagaatcttctggcttaaaattaagaaccaagaaaacaagttggaaagagatcactgatggagtatgtgctctatgccaatagcacactaattcctttgaggtttaatttatttaatttttacaacggtctcatttttatcatccccactttaaa

SEQ ID NO: 7447 - DNA, 972 bp, Homo sapiens
cccgtgggctggaacgcgccggaatctgagggcttgagtcagtgtgaaaatcgggggatgggtgagatatctccctccagcagcagcacttaggccacattaccctctgaggaatccacatttgtcttagatagttacctgtgcagggatcagtccatttattcctattttctctgacagctggatgaaagggactgggagttttcatcctcttgaataagaactcgacaacagagtgggaactttctgtcttgtgatccattgcctgtgtgttgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaaaacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaa

SEQ ID NO: 7448 - DNA, 706 bp, Homo sapiens
gtgggctggaacgcgccggaatctgagggcttgagtcagtgtgaaaatcgggggatgggtgagatatctccctccagcagcagcacttaggccacattaccctctgaggaatccacatttgtcttagatagactgggagttttcatcctcttgaataagaactcgacaacagagtgggaactttctgtcttgtgatccattgcctgtgtgttgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaaaacgaaaacctgttctctccttcattgtgatgacattgatgagcaggaaggcactattcaga

SEQ ID NO: 7449 - DNA, 812 bp, Homo sapiens
ccggaatctgaggtgtgagtagagcctgggggagagtggatccaggtgaagggggcagaggactgggagttttcatcctcttgaataagaactcgacaacagagtgggaactttctgtcttgtgatccattgcctgcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaaaacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaa

SEQ ID NO: 7450 - DNA, 848 bp, Homo sapiens
aacgcgccggaatctgaggtgtgagtagagcctgggggagagtggatccaggtgaagggggcagagggcttgagtcagtgtgaaaatcgggggatgggtgagatatctccctccagcagcagcacttaggccacattaccctctgaggaatccacatttgtcttagatagttacctgtgcagggatcagtccatttattcctattttctctgacagctggatgaaagggactgggagttttcatcctcttgaataagaactcgacaacagagtgggaactttctgtcttgtgatccattgcctgtgtgttgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaaaacgaaaacctgttctctccttcattgtgatgacattgatgagcaggaaggcactattcagagccttgttttgacagccctcatgccttaaggttagaggagtatc

SEQ ID NO: 7451 - DNA, 1828 bp, Homo sapiens
gaagttggccgttgaaagagcaacgctgattagtgaatcttaaatcacctaaatgaaagcccacttgtgattcgccctaagtaaaccagagccccgtgggctggaacgcgccggaatctgaggtgtgagtagagcctgggggagagtggatccaggtgaagggggcagaggactgggagttttcatcctcttgaataagaactcgacaacagagtgggaactttctgtcttgtgatccattgcctggtgagtcacagctcacaccatggatttaacctgagagcttcaacttctgctttggccctggagttcccatgccctggtgtcttctaccagttcttagtgtgttgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaaaacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacctgggcttctggttctttttgataatatataaaattattcattatgaggttgcagttgtttgcaaaggagaggcactcaaatttgaaaggttattttaatgtgataatttggaagacttactcagatgttggtcattgaccactctgtgcatatatttctgcagagctctgtgaaggcaatgagtgtcacttccctctgctctaataaagcaataaataatagctaaagggctgactttcacttcgaactcttggccacggctttttaatcaagttctttaggtttccttgggattagaggaaaggtatggaaatattgttttttgttttttgtcttgccatgtatctgtaggtttttttcttccatgatgtggtgggctgtgtgtgccttatttaattaccatgagtccattttggggtgtcttcacttttcatctttgtagccctttctccaaagctagtgaggaaggtatattctcaacatcagatataactctatacctgtctgatctcccagaccaaatgaaatttgcattaaatggaggggccctggtcaggttccactttggaagtctgatcctgactccctagagccatttgaaaaagaatcttctggcttaaaattaagaaccaagaaaacaagttggaaagagatcactgatggagtatgtgctctatgccaatagcacactaattcctttgaggtttaatttat

SEQ ID NO: 7452 - DNA, 1103 bp, Homo sapiens
tagagcctgggggagagtggatccaggtgaagggggcagagggcttgagtcagtgtgaaaatcgggggatgggtgagatatctccctccagcagcagcacttaggccacattaccctctgaggaatccacatttgtcttagatagactgggagttttcatcctcttgaataagaactcgacaacagagtgggaactttctgtcttgtgatccattgcctggtgagtcacagctcacaccatggatttaacctgagagcttcaacttctgctttggccctggagttcccatgccctggtgtcttctaccagttcttagtgtgttgcactggagcacagaggacactcgatcgtgcggcgcgcagggcggggggccgccgctgcctccccgcgggatggctggcactgtgctcggagtcggtgcgggcgtgttcatcttagccctgctctgggtggcagtgctgctgctgtgtgtgctgctgtccagagcctccggggcggcgaggttctctgtcatttttttattcttcggtgctgtgatcatcacatcagttctgttgcttttcccgcgagctggtgaattcccagccccagaagtggaagttaagattgtggatgactttttcattggccgctatgtcctgctggctttccttagtgccatcttccttggaggcctcttcttggttttaatccattatgttctggagccgatctatgccaaaccactgcactcctactgaccactcttcaggaaaacgaaaacctgttctctccttcattgtgatgacattgatgagcaggaaggcactattcagagccttgttttgacagccctcatgccttaaggttagaggagtatctgtccatcactaagacaaatctctggagtcctggcttccagaaacaggattgccaaattgtccctgtggggctagattcttaccagcttaagaaggatattgctatcttcttagtacccgtaccttaggatttccaactgttttgaaagggaaatagtaacagtgatctgcttagagtggattttcactcaagtccttagtaagtggattttggggaaaaaagcacctgggcttctggttct

SEQ ID NO: 7453 - DNA, 999 bp, Homo sapiens
gaggaggagggtcggggacggaagcgcagagcacggaccccgccccctcgcggccccgctcgtgacgtcgcggggggcgccggcctccgcccggccccgagggcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaatgtgggggaaaataaaaagcttttttgcccagtgg

SEQ ID NO: 7454 - DNA, 1024 bp, Homo sapiens
agggaacaagcttcaattgaatgaaactggcttgaccacagaggaatctgggggactttctgagcttcgcggacttgtgccgcctcctgactttaagctggctctggaggaggaggaagtggaggtatctcaggctctccccggaggctcagccccctctgctccccatgggcaactgccaggcagggcacaacctgcacctgtgtctggcccaccacccacctctggtctgtgccactttgatcctgctgctccttggcctctctggcctgggccttggcagcttcctcctcacccacaggactggcctgcgcagccctgacatcccccaggactgggtctcttttttgagatcttttggccagctgaccctgtgtcccaggaatgggacagtcacagggaagtggcgagggtctcacgtcgtgggcttgctgaccaccttgaacttcggagacggtccagacaggaacaagacccggacattccaggccacagtcctgggaagtcagatgggattgaaaggatcttctgcaggacaactggtccttatcacagccagggtgaccacagaaaggactgcaggaacctgcctatattttagtgctgttccaggaatcctaccctccagccagccacccatatcctgctcagaggagggggctggaaatgccaccctgagccctagaatgggtgaggaatgtgttagtgtctggagccatgaaggccttgtgctgaccaagctgctcacctcggaggagctggctctgtgtggctccaggctgctggtcttgggctccttcctgcttctcttctgtggccttctctgctgtgtcactgctatgtgcttccacccgcgccgggagtcccactggtctagaacccggctctgagggcactggcctagttcccgacttgtttctcaggtgtgaatcaacttcttgggccttggctctgagttggaaaaggttttagaaaaagtgaagagctggaatgtgggggaaaataaaaagcttttttgcccagt

SEQ ID NO: 7455 - DNA, 1577 bp, Homo sapiens
aggcgcagagtccgcgcggcggcgcccctctccctccgcagtactccgggcagcgcccgcctcgattttcccaggcgagggcacgcccgcgtcagtcgcctccggggcaccttcctcgccacgacacgcagaattgattatctgaagaaatggatacttctccctccagaaaatatccagttaaaaaacgggtgaaaatacatcccaacacagtgatggtgaaatatacttctcattatccccagcctggcgatgatggatatgaagaaatcaatgaaggctatggaaattttatggaggaaaatccaaagaaaggtctgctgagtgaaatgaaaaaaaaagggagagctttctttggaaccatggataccctacctccaccaacagaagacccaatgatcaatgagattggacaattccagagctttgcagaaaaaaacatttttcaatcccgaaaaatgtggatagtgctgtttggatctgctttggctcatggatgtgtagctcttatcactaggcttgtttctgatcggtctaaagttccatctctagaactgatttttatccgttctgtttttcaggtcttatctgtgttagttgtgtgttactatcaggaggccccctttggacccagtggatacagattacgactcttcttttatggtgtatgcaatgtcatttctatcacttgtgcttatacatcattttcaatagttcctcccagcaatgggaccactatgtggagagccacaactacagtcttcagtgccattttggcttttttactcgtagatgagaaaatggcttatgttgacatggctacagttgtttgcagcatcttaggtgtttgtcttgtcatgatcccaaacattgttgatgaagacaattctttgttaaatgcctggaaagaagcctttgggtacaccatgactgtgatggctggactgaccactgctctctcaatgatagtatacagatccatcaaggagaagatcagcatgtggactgcactgtttacttttggttggactgggacaatttggggaatatctactatgtttattcttcaagaacccatcatcccattagatggagaaacctggagttatctcattgctatatgtgtctgttctactgcagcattcttaggagtttattatgccttggacaaattccatccagctttggttagcacagtacaacatttggagattgtggtagctatggtcttgcagcttctcgtgctgcacatatttcctagcatctatgatgtttttggaggggtaatcattatgattagtgtttttgtccttgctggctataaactttactggaggaatttaagaaagcaggactaccaggaaatactagactctcccattaaatgaatacctgattattattgtctcattaatgttcagttattatgtatactgccattttaatgtttacctatgaatgtcttttgtgttatataactgacagagtgctataaaatatataatatatacaaatgcagaaaatttattctagtctaatatattcaaatacaaatattaaatatatgaaatacgtta

SEQ ID NO: 7456 - DNA, 2060 bp, Homo sapiens
cccgcagtctccaactccggcgccagtcaggttgtggggtgggggcggcggagggcggagagcgcaggcgcagagtccgcgcggcggcgcccctctccctccgcagtactccgggcagcgcccgcctcgattttcccaggcgagggcacgcccgcgtcagtcgcctccggggcaccttcctcgccacgacacgcaggtaaccgggccccgggagccggtcggcggcggcggactgggaccttgatcctgcctgcccggccgcccgacaagggaatgagagcggaccccgaactccacacacccgcgtttagccgccacacctaaggggcacaacagtctttttgggtaagggccgggctgggggcgacgcgccccgcccgctttgcagacttcggggtgctctgcacgacgcctgaaaggccgcggggcccgcatttctctgtgctgccctcctggagaaccgggacacggggacgggagggccagcatcggctacggcccggtttcccgtttctttccgctgtcgcgtgtctgggccctcctgcagcgtccatgatgaaggccaggggctgttgctttcctctcgcccagtagccaacccaagcaagggaattgattatctgaagaaatggatacttctccctccagaaaatatccagttaaaaaacgggtgaaaatacatcccaacacagtgatggtgaaatatacttctcattatccccagcctggcgatgatggatatgaagaaatcaatgaaggctatggaaattttatggaggaaaatccaaagaaaggtctgctgagtgaaatgaaaaaaaaagggagagctttctttggaaccatggataccctacctccaccaacagaagacccaatgatcaatgagattggacaattccagagctttgcagaaaaaaacatttttcaatcccgaaaaatgtggatagtgctgtttggatctgctttggctcatggatgtgtagctcttatcactaggcttgtttctgatcggtctaaagttccatctctagaactgatttttatccgttctgtttttcaggtcttatctgtgttagttgtgtgttactatcaggaggccccctttggacccagtggatacagattacgactcttcttttatggtgtatgcaatgtcatttctatcacttgtgcttatacatcattttcaatagttcctcccagcaatgggaccactatgtggagagccacaactacagtcttcagtgccattttggcttttttactcgtagatgagaaaatggcttatgttgacatggctacagttgtttgcagcatcttaggtgtttgtcttgtcatgatcccaaacattgttgatgaagacaattctttgttaaatgcctggaaagaagcctttgggtacaccatgactgtgatggctggactgaccactgctctctcaatgatagtatacagatccatcaaggagaagatcagcatgtggactgcactgtttacttttggttggactgggacaatttggggaatatctactatgtttattcttcaagaacccatcatcccattagatggagaaacctggagttatctcattgctatatgtgtctgttctactgcagcattcttaggagtttattatgccttggacaaattccatccagctttggttagcacagtacaacatttggagattgtggtagctatggtcttgcagcttctcgtgctgcacatatttcctagcatctatgatgtttttggaggggtaatcattatgattagtgtttttgtccttgctggctataaactttactggaggaatttaagaaagcaggactaccaggaaatactagactctcccattaaatgaatacctgattattattgtctcattaatgttcagttattatgtatactgccattttaatgtttacctatgaatgtcttttgtgttatataactgacagagtgctataaaatatataatatatacaaatgcagaaaatttattctagtctaatatattcaaatacaaatattaaatatatgaaatacgttatgaa

SEQ ID NO: 7457 - DNA, 3119 bp, Homo sapiens
tctttccttctttctttttctttctttctctttcttcctctctcccctcccgcctgccttccttccttttttccttcttttttttctttcttctttttttttttttttgtgaggaaggtagctttagtgaaaacagggtttggagttgaacctatacgggttcaaattcgacttccgtccaccaccgagacctgcgctccctgagggactcgctttcccatccgcgaaaccaggacggcgccgcctacaccccgcggcgttcggggcgggctgaatgggtcgctgagtgggggctacacccacgcccttcgctccccgcccccgggcggagcgacggccacggcagtgtccccaaggcaccgaaaccgaggcgggggtctcggtccctccgcgcaaggaggaaggcggaccgtacgtggcaggactcaccgccccgcacgtggcaggactcaccgccccgcgccgtgttctccgagccatggcgccagcgctgtggcgggcctgcaacggactcatggccgccttcttcgcgctggcggccttggtgcaggtaaatgacccagatgcagaggtgtgggtggtggtgtacacaatccctgcagtactgaccctgcttgttggacttaaccctgaagtcacaggtaatgttatttggaaaagtatctctgcaatacacatactcttttgtacggtgtgggctgttggcttggcgtcctacctcttgcatcgtacacaacagaacatcttacatgaggaagaaggcagggagctgtctggtctggtgattattacagcatggattatcctgtgccacagttcctcaaagaatccagttggtggaagaattcaattggctattgccattgtaatcacacttttcccatttatctcatgggtctacatatatattaacaaggaaatgcggtcctcttggccaactcactgcaagacagtaatttaaataaattcaagaacttcgtttttaaaatgaatattttcaatcaattttttataaacattaggggaacaagccaggagtttatttcaggtaatttgggctaatagttttaaaactccaaataactttttaagggtgcatataattcgatgtaagattggatgggacaagtaagagatggtctgatattttccagacgactttctgcagggtcttgtgtcataatgtagtggaaaaggctagagaatagaagtttaaaaatacgagttctaacttaactttgtaactatgtaatttgggcaaatatataaacctcctggtggatatttatctataaaataggattaatgccagatctacttacttacacagtaacaaggatcaatctagataatgtaagaacactctgaagatataaagtgtttggaaagattacggagggctgcccatgattaaaatagaggggagcagggattgggtaatatactgaaatagacattcaagagagggctataccccgatctttttttttttttaagacagtcccactctattgcccaggctggagtgcagtggcatgatcatggctcactgcagtcctgacctcccggggctcaggtgatcctcctacctcagcctcccaagaagctacgactacaagtgtgcaccaccatgcccggctaaatttttttaaattttttgtagaggcagggtttcaccgtgttgtccaggctggtcttgaattcctgagttcaagcgatctgtccaccttggcctcccaaagtgctgggattacaggtgtgagccaccatgcccagtccagccctaaactaatcttatccagagctggcatagtgcagtgaactaaaggagaactctagatgaatcaaatgagcaggcatgtcttggaaagaaagggaagctggatagaataaaggaattagggaccaaacaagaaggcaatagggactataactacattctaaatgagaaataaggtcaaaatctatatacattctttataaatggatgtccaaagtaatcctagggaggagagcttttttttttttcatttccattttcatttaaaaatggatacttgattattggaaaacttacaattgtgtttggaacaacttgggtatttgaatctaattttccaattgcaaattttatgatacctaaatacagataaagtatttccaatgaaaatttagtgtccaaatgagtggggctataaatgtaaaatacactggattttaaagacatggtagaaaaagaacagaaaatattttttgtattgattacatgttgaaacaatattttggctataatgggttaaatatactattaaagttgattttatctgtttctgtttacttttatttacgtggcttacattgcatttctgttggacagtcctgtatttaagtatctagatggcaacattttacatacacaagcatcaaactctgtggtcagatactgttttttctgatctaggaaagagatctgggaaatacttcactcaaaaagaacgagtagtgccttccacaggttaggagagtgtaaatgagtctggtagtttgtctatttttattgtctttattactatagtaaatattctataaatatttgttaaaggaggtatgtgtattttgtttttgttattggcacagtggccactgaatggtgagaaattatctaagattaagacttgaatgagtaaaaagggggaaaacaaatctagttgatattaaaacagtcaaagtgaaacttaagggtcagtaaaatacacataaaggatttgagttttccagtgtatattttgcttacatatttgtggcttttataactcctttagtattaataaactactgaagtcacatgcaaaaaaaaaacagactcatttgcaaattccctgtgggctctatccattgaccaagtcatgtttacttctgtgcttaaagacagtaatgttcaagatgtgctttcatcatgtatgcctctcccatatcagactacgaaattatgtgactattcatagtctctttcgcatcttcagttaagcatataaaaggcacttttggtggaatagtcttttgaagagtattaatgaaattgaatttaagtattattattaaatttaatatttctatta

SEQ ID NO: 7458 - DNA, 3089 bp, Homo sapiens
tctttccttctttctttttctttctttctctttcttcctctctcccctcccgcctgccttccttccttttttccttcttttttttctttcttctttttttttttttttgtgaggaaggtagctttagtgaaaacagggtttggagttgaacctatacgggttcaaattcgacttccgtccaccaccgagacctgcgctccctgagggactcgctttcccatccgcgaaaccaggacggcgccgcctacaccccgcggcgttcggggcgggctgaatgggtcgctgagtgggggctacacccacgcccttcgctccccgcccccgggcggagcgacggccacggcagtgtccccaaggcaccgaaaccgaggcgggggtctcggtccctccgcgcaaggaggaaggcggaccgtacgtggcaggactcaccgccccgcacgtggcaggactcaccgccccgcgccgtgttctccgagccatggcgccagcgctgtggcgggcctgcaacggactcatggccgccttcttcgcgctggcggccttggtgcaggtggtgtacacaatccctgcagtactgaccctgcttgttggacttaaccctgaagtcacaggtaatgttatttggaaaagtatctctgcaatacacatactcttttgtacggtgtgggctgttggcttggcgtcctacctcttgcatcgtacacaacagaacatcttacatgaggaagaaggcagggagctgtctggtctggtgattattacagcatggattatcctgtgccacagttcctcaaagaatccagttggtggaagaattcaattggctattgccattgtaatcacacttttcccatttatctcatgggtctacatatatattaacaaggaaatgcggtcctcttggccaactcactgcaagacagtaatttaaataaattcaagaacttcgtttttaaaatgaatattttcaatcaattttttataaacattaggggaacaagccaggagtttatttcaggtaatttgggctaatagttttaaaactccaaataactttttaagggtgcatataattcgatgtaagattggatgggacaagtaagagatggtctgatattttccagacgactttctgcagggtcttgtgtcataatgtagtggaaaaggctagagaatagaagtttaaaaatacgagttctaacttaactttgtaactatgtaatttgggcaaatatataaacctcctggtggatatttatctataaaataggattaatgccagatctacttacttacacagtaacaaggatcaatctagataatgtaagaacactctgaagatataaagtgtttggaaagattacggagggctgcccatgattaaaatagaggggagcagggattgggtaatatactgaaatagacattcaagagagggctataccccgatctttttttttttttaagacagtcccactctattgcccaggctggagtgcagtggcatgatcatggctcactgcagtcctgacctcccggggctcaggtgatcctcctacctcagcctcccaagaagctacgactacaagtgtgcaccaccatgcccggctaaatttttttaaattttttgtagaggcagggtttcaccgtgttgtccaggctggtcttgaattcctgagttcaagcgatctgtccaccttggcctcccaaagtgctgggattacaggtgtgagccaccatgcccagtccagccctaaactaatcttatccagagctggcatagtgcagtgaactaaaggagaactctagatgaatcaaatgagcaggcatgtcttggaaagaaagggaagctggatagaataaaggaattagggaccaaacaagaaggcaatagggactataactacattctaaatgagaaataaggtcaaaatctatatacattctttataaatggatgtccaaagtaatcctagggaggagagcttttttttttttcatttccattttcatttaaaaatggatacttgattattggaaaacttacaattgtgtttggaacaacttgggtatttgaatctaattttccaattgcaaattttatgatacctaaatacagataaagtatttccaatgaaaatttagtgtccaaatgagtggggctataaatgtaaaatacactggattttaaagacatggtagaaaaagaacagaaaatattttttgtattgattacatgttgaaacaatattttggctataatgggttaaatatactattaaagttgattttatctgtttctgtttacttttatttacgtggcttacattgcatttctgttggacagtcctgtatttaagtatctagatggcaacattttacatacacaagcatcaaactctgtggtcagatactgttttttctgatctaggaaagagatctgggaaatacttcactcaaaaagaacgagtagtgccttccacaggttaggagagtgtaaatgagtctggtagtttgtctatttttattgtctttattactatagtaaatattctataaatatttgttaaaggaggtatgtgtattttgtttttgttattggcacagtggccactgaatggtgagaaattatctaagattaagacttgaatgagtaaaaagggggaaaacaaatctagttgatattaaaacagtcaaagtgaaacttaagggtcagtaaaatacacataaaggatttgagttttccagtgtatattttgcttacatatttgtggcttttataactcctttagtattaataaactactgaagtcacatgcaaaaaaaaaacagactcatttgcaaattccctgtgggctctatccattgaccaagtcatgtttacttctgtgcttaaagacagtaatgttcaagatgtgctttcatcatgtatgcctctcccatatcagactacgaaattatgtgactattcatagtctctttcgcatcttcagttaagcatataaaaggcacttttggtggaatagtcttttgaagagtattaatgaaattgaatttaagtattattattaaatttaatatttctatta

SEQ ID NO: 7459 - DNA, 1585 bp, Homo sapiens
cccgcccaggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagaggacaacatggcctttggaaagcctgccaagtgtcacctccaggaagccttctcacaccccatcttagtccgttctggctgccataacaaaatctcatcaattgggtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctccctgcctctcagaagcaccctgtcccctcctccccaggcctgtgactccggccctggaagcccctttgttcttctgttgaaaggctttggcttcccgctgtagagctgctcccgccaccacctgctggggtcctgcctcagcccagtgcccagtatggggagaggaggacatttgggctcacctgtcaaggtggccctgggaccagagctggtcccagcatggggtgcaccgggtacacttaacgtgtctctataagccaagttgcttcaggaccttcaccactggcctctagaatggtccagaggggctggctgggtccctttgtcagactcctgccggcagctgccctgggggacatgtgtgcccatctggcatcctccagcccgtgcagtccgctcttcactgttccacggcctcccagtgcctcccagcattggacccatctccccctgcagtttgaggccagagaggtgagtggacctgacaagtgccagagtaaccgtgtagacagagcagtgtagacagcactcagccccagccccaggtgtggacctcatgctggtgatggctcccctgggtggcctgccagcacagccagtgccatcagggagctgaaggggctgtcccccacctaactccagctcccccttcacgttgtcaccaaggccctgtgccgcccgcctcgcccccctgctctgtggattcctttgggaagggctccctgggcaggacaataaagagttttgactcc

SEQ ID NO: 7460 - DNA, 1599 bp, Homo sapiens
accagagccggggccagtcggagcggggcgcgcgccgcatggcggaagcggaagggagttctctgctcttgttgccgccgccgccacccccgcccaggatggcggaagtggaggcgccgacggcggccgagacggacatgaagcaatatcaaggctccggcggcgtcgccatggatgtggaacggagtcgcttcccctactgcgtggtgtggacgcccatcccggtgctcacgtggtttttccccatcatcggccacatgggcatctgcacatccacaggagtcattcgggacttcgcgggcccctactttgtctcagaggacaacatggcctttggaaagcctgccaagtactggaagttggaccctgctcaggtctatgctagcgggcccaacgcatgggacacggctgtgcacgacgcctctgaggagtacaagcaccgcatgcacaatctctgctgtgacaactgccactcgcacgtggcattggccctgaatctgatgcgctacaacaacagcaccaactggaatatggtgacgctctgcttcttctgcctgctctacgggaagtacgtcagcgttggggccttcgtgaagacctggctgcccttcatccttctcctgggcatcatcctcaccgtcagcctggtctttaacctccggtgatggctgctcggtggccccacacccaccagggtcccgaggaaacagccgccatcccttttggttccagatttttttctcctcaccccaaaaggcagggttgggcctgctgttgtggaccgggggtcggggctggcaggatggaaggactgaggaccagcatgaagtgggggtttgttgtctccctgcctctcagaagcaccctgtcccctcctccccaggcctgtgactccggccctggaagcccctttgttcttctgttgaaaggctttggcttcccgctgtagagctgctcccgccaccacctgctggggtcctgcctcagcccagtgcccagtatggggagaggaggacatttgggctcacctgtcaaggtggccctgggaccagagctggtcccagcatggggtgcaccgggtacacttaacgtgtctctataagccaagttgcttcaggaccttcaccactggcctctagaatggtccagaggggctggctgggtccctttgtcagactcctgccggcagctgccctgggggacatgtgtgcccatctggcatcctccagcccgtgcagtccgctcttcactgttccacggcctcccagtgcctcccagcattggacccatctccccctgcagtttgaggccagagaggtgagtggacctgacaagtgccagagtaaccgtgtagacagagcagtgtagacagcactcagccccagccccaggtgtggacctcatgctggtgatggctcccctgggtggcctgccagcacagccagtgccatcagggagctgaaggggctgtcccccacctaactccagctcccccttcacgttgtcaccaaggccctgtgccgcccgcctcgcccccctgctctgtggattcctttgggaagggctccctgggcaggacaataaagagttttgactcca

SEQ ID NO: 7461 - DNA, 1288 bp, Homo sapiens
aagccccaccccggaagtcggctggccatggcggcgccttggaggcgatggcccacggggctgctagccgtgctgcggcccctgctcacctgccggcccctgcaaggcacgacgctgcaacgggatgtgctgctctttgagcatgatcggggccgcttcttcaccatcctcgggctgttctgcgcgggccagggcgtcttctgggcttccatggctgtggcagccgtgtcccggcccccggttccggtgcagcctctggatgcggaggtcccaaatcgtggccccttcgacctgcgctccgcgctctggcgctacggtctggccgtcggctgcggcgccatcggagccctcgtactcggtgctggtcttctcttctctctccggtctgtgcgctcagtggtgcttcgagctggagggcagcaggtgaccctcaccactcatgccccctttggcttgggggcccatttcacagttcctttgaagcaggtatcttgcatggcccaccggggtgaagtccctgccatgctacctctgaaagtcaaaggccgacgcttctatttcctcttggacaaaactggacacttccctaacacaaaactctttgacaatactgtgggtgcctaccggagcttgtgaagaaatgacctcaagtcactcacctctccaagaggaggataaaaactgaaccttggggagccaggtgtgttggttcacacctgttgtaatcccagcactttgggagggtgaggcaggagcactgctcgagcccaggctgggcaacatagcgagaccttgtctctatttacaaaaaaaaaaacaaaaaaaaacgccaatcttagaatggagtaacaaccagggtcacacaaggaggtcaagattcattaacaacaaataaaggagcagtcatccctagggcagctgcctaacagtacctctaagtttcagtccatgtctgcttagccttcactccttcctcctatctagttgtactttaacatcaaaaactcactactaagatgaagacagtaatataatattttggtacaaaaacagctgcaggaagaggtggaggggggcctgtcattatgtttcccccccaccccccaacgaaaggaaaactaagactcccaacataaacagggccttgaggggggggattacaggcacttgggcatggagtcttcggctgcaggaagcactccgcttattcttcaggaatgggaaaggcgtgacccaacgagagcatctgtctcagagctccactcagggtcacccctctccagaggcc

SEQ ID NO: 7462 - DNA, 1107 bp, Homo sapiens
gcagtcctgacagcaggctggccctgatagataacggaagtgaggaagggtgagagttatctatcttctctgttttatagactacttcagcttctgctgttaccaatgcctcagcaaccactgaaagttcagatatcacccttcttgtaactaatcaaatcaaggaagagatctacaaaatagtggtggtggttccagctagaaattttcactcacaatggtgcatgtttcaaatagaagtatccagggtatgaacatacttttctcctcctgggccgtagtcttaatggtgatgggaatcaccttagataaatgggttgaattgatttcagaagatgaaagagccaagatgaaccacagtccttggatgatgtgttgccctgctctttggccagaagatgacctgaaagtggtcaggattatgatgacgtcgagccttggcctttccttcctccttaacttaatcctgggtatgaaattcacctatctgattcctcaaaataaatatatacaactcttcactaccatcctcagtttcttctcaggtatctctctgctctgggcactcatactatatcacaataagctgaagcaaggtcaatccatgcacttctctaattataggatcacctggatcatgtatactgcttacttaaatgttttcttcttgtctgtctgtggagtcctctctctcctagagtgcaagttgtctaccagtagctgtacctgcctgaacatccataaatctgacaacgaatgtaaggaatctgagaattctatcgaagatatttcattaccagaatgcactgcaatgcctcgtagcattgtccgtgcacacactgtgaattccctaaacaaaaaagtccaaacacgtcacgtaacctgggctctgtgatttggcaatctatttcttgcagtatatgctcatctttatggaaaaagctttgtgggtgtgtgctgtgtctccaaccatgttgtctctatttggaattatggttggggtttgtaaaaagatctggaagatggttttttaaaaaatcctggcctgctgaacgaatagtttcttctgcaacatttgttgttaatataataaatattatcatataa

SEQ ID NO: 7463 - DNA, 2551 bp, Homo sapiens
ggcattggcagggcgggggcagggccgccgctgctcgcgttacgttcccagagcctgcagcggaggcgcggggctaagcagcggaggggatggggcttccacaagcttctgcatttcccctcacagccccggcgccgcctcccctggctgggccgcggtgcccgttaggccgcgcagggtgagagctagagcgggcgcgggcgggcggcacctcgcccgggactggaagggagggcgcagcggggccacggcggggggattccgctagccgggcggcccgcgagtcccctgagtgcatcagcccccgctgccgcgggaccgcggccgggacggagctccctgcgcgccccccgggggccggcagcggccaggaggcggcgcggggctcggccgctcggccctgcagctccgcgcacccggcagcggcggcggtgcagcctcgggcgttcggacagcctccgagcccatggcggggagcgacgtggacagcgagggccccgcacggaggggcggcgcggcgcggcgtccgggggcccctggcgggccaggaagcgaggcggcagccggctgcccggagccgctgtccactgctgaagcgccggctgagagcgccacgctgcccgcctggatgcgcctctacttctacgggatgcacgggatcaccctggacgtgctggtgtcctcggcccggcgcttcgcccgcagcccggacctgcggatgctaggcttctcctcgccctaccgctgcctgctgcactcgctcacccatttcgccctggagaaggtgtacctgcagcagcggcgctgtcccaacgccttcgtcttcaatttcctcctctacccctcggcccacgtggggctgcagaccctagcgggccaggcgctactactcagcctgggcggcggggcgggggtcgcggtggcgccaggggcgctggacctggcgctgcagtacgtgctggcgctctaccactgccaagtgttcctgaagcgcttcctgcgcttgcggtacgggcgacagaggcggcggcagcagcaacagcagcagcagcagcagcagcagcagcggaggggcgcgctccccgtccctcccggcgcccgggtccctactgcggccggagcccggcggcgacgaccccgtggccccaggggcgccgggggagcccccagccaggggctgcccgacctaccccgctttcttttcttcggaatgcacggctttctggatgagatcttcttcaccttcttcttcaacgtactggggcagggggacgggacaaccagcggccacacgtcgctctggtccttctttatgtacggcagctgcagtttcgtggtggaaaagctctacttccacctccactacagccgcggttggggcacttggaagcgggtgcccatctacgtgatcttcatctacgtgtgggagctgtcctggggtctgggactccgcacgtgcggggcttgttcctgggactattctcactacccgctcaattttatgggcctcatcaccctgatgtatttacctggctggatattccttagtgtgtaccaggacctaatttccaacgtgttgtggagggtgcagtacgtaccagctaactaaaaccaaaaaagaaagaaagaaaaggaaaaagtcactggattcccacgaatggatgcgatttatttttacacatttaaaatgaagtgggttttttagtcctttaatttttatacgctttactaaactcttccaaattgttttattccaccttttagtttttctatttgaaacccgtgtataatatactttgaaacactactcgaaacataattcaaagtactttatttgccaatgttttaaaacatttacaagcccaaacgtttacacgcccaaacagcaaaaccgttataccttaacatcagaatgatgtagtagtgtttacccatctggcaacagatgagtgacagctactaatttttttttttttggcggggggggatctttaaatcagagaccagtgatttttacaagatttggctaaattttctgattcagtgatttgttttactttctttttaatctaatttcattttaattccttgccatatttaccaatgactgaagaaactcaatgtcttgtactcttgagactacagttaatagctcttaaagtgcctccgtctagcacacaagtgaaaagaggctgaaaaatgtgaaagcacgttctatgaacagatttttaaatgagaggtcttttctagcaactcacacaggtgacactgtgttaagatatttgatctccatcctggaaatgattgctttccaatgtgggtaagccttaaacagcaggtgtgttaacgttgatcagatcctgtgttatctatggctgtaaatttttgttactgtgcaataatgtaaaatgtttaccttacatagccgagggccaagtgaaattatatcaccttccacagtgttctaactccaaggacccttttctacatggaacttcaagggcagaaacattacctttgaataaaatgaacctgaatgttcactctaatt

SEQ ID NO: 7464 - DNA, 4068 bp, Homo sapiens
gccaggcggcgtgggggaggcacggcccgcaactcggcgcggggggagccagagcgccgggcttgggggcggggagcaggcggtgcaggagagcgccccgagtcccggcgcgggaggaggagcgggagccagccctggagacggcgctcctagccgcacctgcgcctggcaggcggccggctctgcccagcccctacccacggccccggccccgcaccgggacacatggaagctgccagccccccagccaaggatcagctgagccctagggctgatgcttgcctacgttgctgagaatggcactgaggcccagccaacaaaggttaacccaggacactcctggacagtgatcctgatgtctgttgtgagctgcacactcaagggtgtgataaccagccccagtcggcgccatggcgtctgccgagcccctgacggcgctgtcccgctggtacctgtatgccatccacggctacttctgcgaggtgatgttcacagcggcctgggagttcgtggtgaacttgaactggaagttccctggggtcacgagcgtgtgggccctcttcatctacggcacctccatcctcatcgtggagcgcatgtacctgcggctgcgcggccgctgcccgctgctcctgcgctgcctcatctacacgctctggacctacctgtgggagttcaccaccggcttcatcctgcgccagttcaacgcctgcccctgggactactcccagttcgactttgacttcatgggcctcatcaccctggagtacgccgtgccctggttctgcggggccctcatcatggagcagttcatcatccgcaacaccctccgcctccgcttcgacaaggacgctgagcccggggagcccagcggcgccctagccctggccaacggccatgtcaagactgactgagcaggaagcgggtggggggcctggggatctctcatggaactcatggacaaagagaccaagctggtgaggttgccccatccatgcagcaaaagccctgctccggccaagcctcagccctatagggcacacagagccccctaacgtccgcgggggccggtgttggggggccgtggtcaggtgttgggggatggggtgtggaggcagcagagggacattgggaagggtccatggatcgcggcccagttcaggggttggtaccaggaggcctgtggctgagcagcgatggactatgtagttgactttggaagcagcaggccctgtcctggccaagggacaatgagaatggggccgcaggtgggaggcaaggcctgacctccctccctccgatctggatttagttgagctttggctggttccattaggcaatattcaggtgcttgcttgcaaccaatacctccccaggggcctgctgagctgcagccgaggagagactgggcagccaggaggctgcgtggcagcaacgctggtctgcaagggctgggagaccctcccttggctcctctcccctcccccagggccctgcgctgctcccttggccttctggggcccccgtggtgctggattcccaccaaccttgggcttttggaggtttcaatccccgtgtgttcggtggcgtttcccccttttctgtcttgttttcaaagcctttaccactagcggctctttatccacgtcggtcgccacacctgccccaccccagctccctagccagcacaggagctgccggagatgaagccctgagacacccccaaccctcacccccttgcagcccttccctccactgttccggctggcctgatgcctggggagttcctgagttacacctccctacccccggtctagtgggctgtggcagtgctcccttctcagtggctcagctgagaacaaatgatgccctccaatgcacaggcaggctgggttaggccctgtggatccacagtggggacctagaggcaagtcagtttggtggggaaaagccagagttctaggtcatctattccctgcctggtttattttcaagccaaaactgagcagtctagctttctatgggatggagaagccaggtatccagcattggagactgatggagaatgagaggaagaaagagaggaggaccttgcagctgtggaaggctccttggagcctcctttgtgggagggtatcagttctggttctgccagagcctcagccctggtagcagaacctcagggctgcccctctccccaaactcctcccagcaaggctgaccctttgagctcactccttaaacagtattaaccctgccacactcatgggcattggcaccttggttcccctgccccactttgtcctgtgacaggtccattgctggcagtggacaggtgaaatactcactccagcctacttccggctctgactctcactcctcaaggggaagggtccgttagaaagtggcccaccccatggtacatggtctcttcttgaccacactaggactcttaggtagaaattagccttcccctttttatggatcattacaaagtgacggtatcacctgtggagagaatgtcctcttccctgctggctgccctgcccatactgtgcagggtgtggtggggtgcagggtgtggtggggtgggccacagttgtgtcctaggtctggagaaaagcttgcagactctgcctttggcaggattttctgcagttagccccgtccagagcagaacgaagggtatttcctagcctatttcctgggcaggctcctcaaatccagggatgaactactttctgcagtggccagccctccttttgattttattgtggccccaattccagggctttgggggttacagagaatcaggcttccggtgggagtagattgttttccatctataggtggagaaaattccaggaggagaatattgtctggcttccccgttctctctgggcaattgtttccttggttctctctccaactccatgttgtcttagtctcccagcaccccttcaggccttccatgtgggcccctagaccacactacccaccttcacacttgcattccacaactcagtccagtggccagcttgttgatgcctccataattctcagccagagcaaatccttgattggcccaccaggtcttgctgctccagaagttgccttgtgggcattccctggcaccatttcctctctgggtcctatactttcccaagtgcaggaggtcctgggggtatgcctgtgtgcctggcaacatccagcattgtgtttctgctccatctaggtgtcccatttctccagttgcccctcataaggcatcaaacctccagcaaaggaaggcaacaacccatggcctgaccacgggatctacaggttcagatctcaccagggatagcccagacttcaattcttgcttttttgggtatcagggccccaatcccttagtggccagggactcaaagtttggaataatcccagccctgccaagcattaagggtgctggtggggagtgtttgctggctgttcatgaacctctggtgtcctgggcctctctccactagacatggcagcatctctgagttacagattgcaatgtgttgccctgcatggttgaactgcttcggacatctgctaggcatcccatgtgccctgtcccctcttcaatgccagtgagtcacaatggcctatgcttattcacagcaataatacctagggagtccccatgaagcccttttgtcctggtccctcactctgcgtgggtctcctggggaggcagctgctgagtgggtcagttcatgagaacctgcatttatgaagccctgggctgtgtaggcatcaccctgggatgcagacaggttagaggcccagcccttaggggagccatggcagggagagtgccttccaccctgaggccacccagacctggaggagatgcaggccccagctctgctaaagggcctttgaggtgggtgggactgtctcccagttgggcagctcttgagaaggacacacgaccggtttgtgcgcccattgcctgctctgtgtctccgttggtccctctgtctcttccttttcacatttgtgcacataaaatatactggtgtttgtgttccagga

SEQ ID NO: 7465 - DNA, 699 bp, Homo sapiens
aaggggtgaaagggagcgagcaccgatagcaaggtggcagcctgcacgtccgctccgagggcccttcccaggagcggctggatctgaccgatccccaagtccagggacacatggaagctgccagccccccagccaaggatcagctgagccctagggctgatgcttgcctacgttgctgagaatggcactgaggcccagccaacaaaggttaacccaggacactcctggacagtgatcctgatgtctgttgtgagctgcacactcaagggtgtgataaccagccccagtcggcgccatggcgtctgccgagcccctgacggcgctgtcccgctggtacctgtatgccatccacggctacttctgcgaggtgatgttcacagcggcctgggagttcgtggtgaacttgaactggaagttccctggggtcacgagcgtgtgggccctcttcatctacggcacctccatcctcatcgtggagcgcatgtacctgcggctgcgcggccgctgcccgctgctcctgcgctgcctcatctacacgctctggacctacctgtgggagttcaccaccggcttcatcctgcgccagttcaacgcctgcccctgggactactcccagttcgactttgacttcatgggcctcatcaccctggagtacgccgtgccctggttctgcggggccctcatcatggagcagttcat

SEQ ID NO: 7466 - DNA, 655 bp, Homo sapiens
gtttctgttttagttctgacttgtgccgtggatgtggctgagggcctagggtggggagaagtctccacaggtgggattgaactccccaggcacatggtccttgtggtgctggtggagagagagtcccagagggttcggacatgctccgttaaaaccttttcctcaaggtgataggtacgtgtcaaggtgacccctgtccgccatccggcaggctggaagaagccgggacacatggaagctgccagccccccagccaaggatcagctgagccctagggctgatgcttgcctacgttgctgagaatggcactgaggcccagccaacaaaggttaacccaggacactcctggacagtgatcctgatgtctgttgtgagctgcacactcaagggtgtgataaccagccccagtcggcgccatggcgtctgccgagcccctgacggcgctgtcccgctggtacctgtatgccatccacggctacttctgcgaggtgatgttcacagcggcctgggagttcgtggtgaacttgaactggaagttccctggggtcacgagcgtgtgggccctcttcatctacggcacctccatcctcatcgtggagcgcatgtacctgcggctgcgcggccgctgcccgctgctcctgcgctgcctcatcta

SEQ ID NO: 7467 - DNA, 2812 bp, Homo sapiens
agacgcgagcatgtgcagtttgcagcgcatccgtactatggggacacatggaagctgccagccccccagccaaggatcagctgagccctagggctgatgcttgcctacgttgctgagaatggcactgaggcccagccaacaaaggttaacccaggacactcctggacagtgatcctgatgtctgttgtgagctgcacactcaagggtgtgataaccagccccagtcggcgccatggcgtctgccgagcccctgacggcgctgtcccgctggtacctgtatgccatccacggctacttctgcgaggtgatgttcacagcggcctgggagttcgtggtgaacttgaactggaagttccctggggtcacgagcgtgtgggccctcttcatctacggcacctccatcctcatcgtggagcgcatgtacctgcggctgcgcggccgctgcccgctgctcctgcgctgcctcatctacacgctctggacctacctgtgggagttcaccaccggcttcatcctgcgccagttcaacgcctgcccctgggactactcccagttcgactttgacttcatgggcctcatcaccctggagtacgccgtgccctggttctgcggggccctcatcatggagcagttcatcatccgcaacaccctccgcctccgcttcgacaaggacgctgagcccggggagcccagcggcgccctagccctggccaacggccatgtcaagactgactgagcaggaagcgggtggggggcctggggatctctcatggaactcatggacaaagagaccaagctggtgaggttgccccatccatgcagcaaaagccctgctccggccaagcctcagccctatagggcacacagagccccctaacgtccgcgggggccggtgttggggggccgtggtcaggtgttgggggatggggtgtggaggcagcagagggacattgggaagggtccatggatcgcggcccagttcaggggttggtaccaggaggcctgtggctgagcagcgatggactatgtagttgactttggaagcagcaggccctgtcctggccaagggacaatgagaatggggccgcaggtgggaggcaaggcctgacctccctccctccgatctggatttagttgagctttggctggttccattaggcaatattcagatggccaccattatttctgttttatgggagaggtctgttggcaaagagtcggccacccagatttaccacatttctctgcagaacactcttttgttcaatataagcagagaccttccaccgggggcaggatttgtgatacctgcagtgagccaaggaccaggctagttcctgtgatgctgaagatgttgaagggaagcccataacattacaacgttgaccaatcctccagaaaagaagctctaacagaggaccctggctgtctacggggttggtttccatctctccattcgtgagctccttgaaggcagagaacacttggcttttcttcctatacctccagtccctaatgcagggacatgagagatgcccatttgtgtttgatgaatgaatgagtgaataaatgaatgaatgagtgcctggagatcagagtacatgggatgagtgttcggagttctacagactcaggaagccccagctgacattccaagaagaaggagacacgaaggtgaggggatgccatgcagttagcgtcacatgaagaaaaacaaaatttaaggtatcatccttagaagacggagggatgacagtttcaaggaggatttgttcatcagatgctgggaaggaatttcaacagatgaggaaactgaagagcagagaggttaagtacccccctaccctgccccccaggggacacaacctgctggagtgcaatggcacgatctcagctcactgcaacctctgcctcccgggttcaagcaattctcctgcctcagcctcccaagtagctgagattacagatgcaaggtagagagtggaaggaatgaaggggtgggcgagggcatgaagaagcctccccagctctaatggccactgtctgaaagtgatgcagctcacttccacccacattcgccagatttcaatccatagcctcacttaactgtagggcaggctaggacatatcatctttccatgtgctgagaaaaaatagaaaagaccaagattggtgaaaaggagcaaactagtgacgagaaccttgccatagccatttttttgccactcacagaagccggtctgtaccaagcgagaagtggctataggagaagtggtcctgaggctcatctgccttctcctggtcaccctcccaatatatccctcctgtgctgagctagttttctattacttttcatcacctacatctaaaagagacctacctatctaacacagtctttgtcttactatcataatgctattaatgcaagctaaataataatctttcatcttctttttttctttatctttttcacttgaattgctttaaattcaaatcttcctgctatagtgtgaatgtttgtgttccccccaaatttatgtttaaactttaacctccaagctgatggtattaggaagtggggcttggggaggtgattaggtcatgagggtggaatatttgagaatgagattagtgcccttgtgaattaggcctgagagagatcccctcatctcaccatgtaaggacacagcagaaggtgctatctttgaaccaggaagtgagcccttgccagacactgaacctgccgatacctcaatcttgtccttctcagtctccagaactgtgagaaataaatttctgttgtttataaacc

SEQ ID NO: 7468 - DNA, 523 bp, Homo sapiens
cgggagccagccctggagacggcgctcctagccgcacctgcgcctggcaggcggccggctctgcccagcccctacccacggccccggccccgcaccgggcagtgggcagccatgccgagtcatgaaggtggcatgcagggatgggaaatgctgccttaggagggacacatggaagctgccagccccccagccaaggatcagctgagccctagggctgatgcttgcctacgttgctgagaatggcactgaggcccagccaacaaaggttaacccaggacactcctggacagtgatcctgatgtctgttgtgagctgcacactcaagggtgtgataaccagccccagtcggcgccatggcgtctgccgagcccctgacggcgctgtcccgctggtacctgtatgccatccacggctacttctgcgaggtgatgttcacagcggcctgggagttcgtggtgaacttgaactggaagttccctggggtcacgagcgtgtgggccctcttcatctacggcacctccat

SEQ ID NO: 7469 - DNA, 3941 bp, Homo sapiens
gcagtttgcagcgcatccgtactatggggcagtgggcagccatgccgagtcatgaaggtggcatgcagggatgggaaatgctgccttaggagggacacatggaagctgccagccccccagccaaggatcagctgagccctagggctgatgcttgcctacgttgctgagaatggcactgaggcccagccaacaaaggttaacccaggacactcctggacagtgatcctgatgtctgttgtgagctgcacactcaagggtgtgataaccagccccagtcggcgccatggcgtctgccgagcccctgacggcgctgtcccgctggtacctgtatgccatccacggctacttctgcgaggtgatgttcacagcggcctgggagttcgtggtgaacttgaactggaagttccctggggtcacgagcgtgtgggccctcttcatctacggcacctccatcctcatcgtggagcgcatgtacctgcggctgcgcggccgctgcccgctgctcctgcgctgcctcatctacacgctctggacctacctgtgggagttcaccaccggcttcatcctgcgccagttcaacgcctgcccctgggactactcccagttcgactttgacttcatgggcctcatcaccctggagtacgccgtgccctggttctgcggggccctcatcatggagcagttcatcatccgcaacaccctccgcctccgcttcgacaaggacgctgagcccggggagcccagcggcgccctagccctggccaacggccatgtcaagactgactgagcaggaagcgggtggggggcctggggatctctcatggaactcatggacaaagagaccaagctggtgaggttgccccatccatgcagcaaaagccctgctccggccaagcctcagccctatagggcacacagagccccctaacgtccgcgggggccggtgttggggggccgtggtcaggtgttgggggatggggtgtggaggcagcagagggacattgggaagggtccatggatcgcggcccagttcaggggttggtaccaggaggcctgtggctgagcagcgatggactatgtagttgactttggaagcagcaggccctgtcctggccaagggacaatgagaatggggccgcaggtgggaggcaaggcctgacctccctccctccgatctggatttagttgagctttggctggttccattaggcaatattcaggtgcttgcttgcaaccaatacctccccaggggcctgctgagctgcagccgaggagagactgggcagccaggaggctgcgtggcagcaacgctggtctgcaagggctgggagaccctcccttggctcctctcccctcccccagggccctgcgctgctcccttggccttctggggcccccgtggtgctggattcccaccaaccttgggcttttggaggtttcaatccccgtgtgttcggtggcgtttcccccttttctgtcttgttttcaaagcctttaccactagcggctctttatccacgtcggtcgccacacctgccccaccccagctccctagccagcacaggagctgccggagatgaagccctgagacacccccaaccctcacccccttgcagcccttccctccactgttccggctggcctgatgcctggggagttcctgagttacacctccctacccccggtctagtgggctgtggcagtgctcccttctcagtggctcagctgagaacaaatgatgccctccaatgcacaggcaggctgggttaggccctgtggatccacagtggggacctagaggcaagtcagtttggtggggaaaagccagagttctaggtcatctattccctgcctggtttattttcaagccaaaactgagcagtctagctttctatgggatggagaagccaggtatccagcattggagactgatggagaatgagaggaagaaagagaggaggaccttgcagctgtggaaggctccttggagcctcctttgtgggagggtatcagttctggttctgccagagcctcagccctggtagcagaacctcagggctgcccctctccccaaactcctcccagcaaggctgaccctttgagctcactccttaaacagtattaaccctgccacactcatgggcattggcaccttggttcccctgccccactttgtcctgtgacaggtccattgctggcagtggacaggtgaaatactcactccagcctacttccggctctgactctcactcctcaaggggaagggtccgttagaaagtggcccaccccatggtacatggtctcttcttgaccacactaggactcttaggtagaaattagccttcccctttttatggatcattacaaagtgacggtatcacctgtggagagaatgtcctcttccctgctggctgccctgcccatactgtgcagggtgtggtggggtgcagggtgtggtggggtgggccacagttgtgtcctaggtctggagaaaagcttgcagactctgcctttggcaggattttctgcagttagccccgtccagagcagaacgaagggtatttcctagcctatttcctgggcaggctcctcaaatccagggatgaactactttctgcagtggccagccctccttttgattttattgtggccccaattccagggctttgggggttacagagaatcaggcttccggtgggagtagattgttttccatctataggtggagaaaattccaggaggagaatattgtctggcttccccgttctctctgggcaattgtttccttggttctctctccaactccatgttgtcttagtctcccagcaccccttcaggccttccatgtgggcccctagaccacactacccaccttcacacttgcattccacaactcagtccagtggccagcttgttgatgcctccataattctcagccagagcaaatccttgattggcccaccaggtcttgctgctccagaagttgccttgtgggcattccctggcaccatttcctctctgggtcctatactttcccaagtgcaggaggtcctgggggtatgcctgtgtgcctggcaacatccagcattgtgtttctgctccatctaggtgtcccatttctccagttgcccctcataaggcatcaaacctccagcaaaggaaggcaacaacccatggcctgaccacgggatctacaggttcagatctcaccagggatagcccagacttcaattcttgcttttttgggtatcagggccccaatcccttagtggccagggactcaaagtttggaataatcccagccctgccaagcattaagggtgctggtggggagtgtttgctggctgttcatgaacctctggtgtcctgggcctctctccactagacatggcagcatctctgagttacagattgcaatgtgttgccctgcatggttgaactgcttcggacatctgctaggcatcccatgtgccctgtcccctcttcaatgccagtgagtcacaatggcctatgcttattcacagcaataatacctagggagtccccatgaagcccttttgtcctggtccctcactctgcgtgggtctcctggggaggcagctgctgagtgggtcagttcatgagaacctgcatttatgaagccctgggctgtgtaggcatcaccctgggatgcagacaggttagaggcccagcccttaggggagccatggcagggagagtgccttccaccctgaggccacccagacctggaggagatgcaggccccagctctgctaaagggcctttgaggtgggtgggactgtctcccagttgggcagctcttgagaaggacacacgaccggtttgtgcgcccattgcctgctctgtgtctccgttggtccctctgtctcttccttttcacatttgtgcacataaaatatactggtgtttgtgttccagga

SEQ ID NO: 7470 - DNA, 701 bp, Homo sapiens
gccgccgccgccgccgccgccgggggctcctttcctcccgggcagcggcggctgcagccccccggaccccgcgccgccgcggcggacgccgacacacaatgcgggactaggcgcggcgcgggagtgccaggcggcgtgggggaggcacggcccgcaactcggcgcggggggagccagagcgccgggcttgggggcggggagcaggcggtgcaggagagcgccccgagtcccggcgcgggaggaggagcgggagccagccctggagacggcgctcctagccgcacctgcgcctggcaggcggccggctctgcccagcccctacccacggccccggccccgcaccgggacacatggaagctgccagccccccagccaaggatcagctgagccctagggctgatgcttgcctacgttgctgagaatggcactgaggcccagccaacaaaggttaacccaggacactcctggacagtgatcctgatgtctgttgtgagctgcacactcaagggtgtgataaccagccccagtcggcgccatggcgtctgccgagcccctgacggcgctgtcccgctggtacctgtatgccatccacggctacttctgcgaggtgatgttcacagcggcctgggagttcgtggtgaacttgaactggaagttccctggggtcacgagcgtgtgggccctcttcatctacggcacct

SEQ ID NO: 7471 - DNA, 2889 bp, Homo sapiens
gatggcaaccaggagaagccaaacttggtcccccggctcgcggagtgcctgcgagcggtgctcatggcgctctatgagctcttctctcacccggtcgagcgcagttaccgcgcggggctctgctccaaagccgcgctgttcctgctgctggccgctgcgctcacgtacatcccgccgctgctggtggccttccggagccacgggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacgttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtgcagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcggacacctgcgggcttgtgtgcttttccctcagagacaacggttctttccggttttgctctacacagttccgtatcttcagagctcctgcagaattgtcagggactagtttgtggaaaggtctgagagttcctggaggctataattagctttttgggttttccttctttgccttagcgttgaatttcaggagaaaattgcagtcagttcagacatcttggaaagagtcccatctctggtcaagcagagacttttcctctgttgaactgaggaacacactgtgcatttctaccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaagggcaagggccgcattagcacaggcaatcagggagggccgctgaaggacacttggaccgtccacctgccccagcccaacagtcagtcatctgtcatcagctcagctgagcagccctggatctttgccgtactgtgactgggctctttgccctatttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaacagggtgcccatcagagtggggcgggcagctttgggaaggacacaagaagcagtaagagtgtaaagaggatgctggcctgggcaggccagtccagcctggccactagcagaataccaagcagtccagtggattaccctcgtggctaagcaagtgtctgcaggagcagagatggctggaaggggcctctgcacacggaagatggcttgttcagcccattcacctcctgaggatgtgggcagtctcctccaagaacacatggagctgcttcctgatcccaagcaggtcattgccactggaaggacatggccccggtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaaatgaggccgagcatggtggttcattcctgtaatctcaacactttgggaggccaaggtgggaggatcacttgagcccaggagcttgaggctgcagtgtgctatgattgcaccactgtactgtagcctgggtgacagagtgagaccctatctgttaaaataaataaataaataaataaaaaagtcaaaatgg

SEQ ID NO: 7472 - DNA, 2952 bp, Homo sapiens
ggctcgcggagtgcctgcgagcggtgctcatggcgctctatgagctcttctctcacccggtcgagcgcagttaccgcgcggggctctgctccaaagccgcgctgttcctgctgctggccgctgcgctcacgtacatcccgccgctgctggtggccttccggagccacggtgagcctgccccggccgctgtgccacgaggctccccgggcgcgctcggccagggccggcctccctaaccgcctccctaccgccctctttaactcagggttttggctgaagcggagcagctacgaggagcagccgaccgtgcgcttccaacaccaggtgctgctcgtggccctgctcggacccgaaagcgacgggttcctcgcctggagcacgttccccgccttcaaccggctgcaaggggatcgcctgcgcgtcccgctcgtttcgactagagaagaagacaggaaccaggatgggaagacggacatgttacattttaagctggagcttcccctgcagtccacggagcacgttctcggtgtgcagctcatcctgactttctcctatcgattacacaggatggcgaccctcgtgatgcagagcatggcgtttctccagtcctcctttcctgtcccgggatcccagttatacgtgaacggagacctgaggctgcagcagaagcagccgctgagctgtggtggcctagatgcccgatacaacatatccgtgatcaacgggaccagcccctttgcctatgactacgacctcacccatattgttgctgcctaccaggagaggaacgttaccaccgtcctgaatgatcccaaccccatctggctggtgggcagggccgcagatgctccatttgtgattaatgctatcatccgataccctgtggaagtcatttcttatcagccaggattctgggagatggtaaagttcgcctgggtgcagtatgtcagcatcctgcttatcttcctctgggtgtttgaaagaatcaagatcttcgtgtttcagaatcaggtggtgaccaccattcctgtgacagtgacgccccggggagacttgtgtaaggagcacttatcctagaaaggccatttctgaagactcagcaggaccgtggctgcctcattgtcatcttctgggaacatcttaggaccttttgaaagagcccagcggacacctgcgggcttgtgtgcttttccctcagagacaacggttctttccggttttgctctacacagttccgtatcttcagagctcctgcagaattgtcagggactagtttgtggaaaggtctgagagttcctggaggctataattagctttttgggttttccttctttgccttagcgttgaatttcaggagaaaattgcagtcagttcagacatcttggaaagagtcccatctctggtcaagcagagacttttcctctgttgaactgaggaacacactgtgcatttctaccttctgttgtgagccactcttactcttttcagggctctcttgtgacaaacatgccaatcactagcactttgcacccctgggcttctccatttcccattcacagctttgatttccagagctgaggcctttaactggagacctggaggggcagggcccaagggcaagggccgcattagcacaggcaatcagggagggccgctgaaggacacttggaccgtccacctgccccagcccaacagtcagtcatctgtcatcagctcagctgagcagccctggatctttgccgtactgtgactgggctctttgccctatttttccctctgtctgtgcccctggatggcaggctgaagtcagaggggctgtttcattctcagccccctcagcagcactgggggaagaaagcattgtcacaacaggttctttctggccctcacccaacagcctgggcacttggccctcctcctccttgacagccctcccccttcctgcaaaggacaggggcgacaggggttggtgttgggattggctcccgctgcctgacaaccacaagtttatttggaaggctagcgggaagcccagcggctggcgtttcccttgactaaggaacagggtgcccatcagagtggggcgggcagctttgggaaggacacaagaagcagtaagagtgtaaagaggatgctggcctgggcaggccagtccagcctggccactagcagaataccaagcagtccagtggattaccctcgtggctaagcaagtgtctgcaggagcagagatggctggaaggggcctctgcacacggaagatggcttgttcagcccattcacctcctgaggatgtgggcagtctcctccaagaacacatggagctgcttcctgatcccaagcaggtcattgccactggaaggacatggccccggtgatccatgcttcatgcccacccagaaacacacccctcagtgtgtgcctcagtttactttggagatcagttgtcgtttttagtgctcctttaggcttactaaaacagttttggaaacaaagctattttgaagtattcaagcagaggaattccctaacactgacccccttgtctttttttaatattcaggctgttttatatgcctaaatttttttcttaagatctaaacgaaaaatagtttcttgtttaaattcacataaggcaatgagatatggaaagatgacaagatacgtataaacattggtttgcattttattaaattattctaatgcaaatcttgtataaagaacccatgatgttttgtaactttctaattaaaatgttcaaaatgaggccgagcatggtggttcattcctgtaatctcaacactttgggaggccaaggtgggaggatcacttgagcccaggagcttgaggctgcagtgtgctatgattgcaccactgtactgtagcctgggtgacagagtgagaccctatctgttaaaataaataaataaataaataaaaaagtcaaaatgg

SEQ ID NO: 7473 - DNA, 2945 bp, Homo sapiens
cttataagtcctgattggctaagccctggtcacgagaccgtaaaagagcaacgtctgtctcagagcgactcccacagcgtccttagcaaccagccttggttcccagcggctcagagcgcagcgaatttatgatttatgaatatgcctgttaacaaatcacctatgattaatacatgtggaggcatatcttccccttatcatgaagagctctggaaattaaattttcaacatttaagtggagaaaggggtcataaatcaaggccaacattttcaatcacaaaagaattcatcttgagattcaatcaaacacaaaattccaaagagaaggaagaattgttggaactagctagaaaaatcattctcagatgtaagagaaaattgggtctcaaaaccctgggctctggaaggcatgtgcatcttcctgctgcatggactgaagtaatatatctggctcaatgcaaaggggaaatccaagatgaatctttaaatatgctttatgcatctctggaccatgcttcctttgattatgatcatctgcctgccttattttttgttgcggaatcggttttatacagactgtgttgtgatgcatccctcaaaacatatttatattcagttgaaataaagctagcaaagattggctatttggtcttcttacgactttttatatttttcctgcatggtcatctagaaagttttaaacaacatttacttaggcttcaaccatatttatacgcactttctttctctggagcatcatatcacaagtatccaaacatcttttcaaatgtgcaattcatcctgaaagcctcggaaattataggtaaaagagaactccgttctgaatccatttttagacctgtggaagataagaaaagatatgagaacacagattctgatatgggaggatatgaaattaaccacctgctctggcactgtgttgctgcttggtcttgtgttcagaataacagtcctcagttgaataacgtgcttgaacatctcgtcttccataagacacagcttcaaaagaaatgctggttggattcagtactggctttactggtccttggggaggctgccaaattaaacatggcctgcttgaaagctttaatggacgtagtgagagattttgtttcaagcattatgtctgttcaaaatcaggaagaaagttgcaaggtagatgatttttcctgggcctggaatgtagtctacatatatacagtaattcttgcagaaatctgcttgtatgcagccacttctgatttgcgaaaaactgctttaattggtttctgtcactgtaaaagttcacaaaaaaatattttatacttggacaaatcagtacctccagaattaaaggaaacaagtattttaagtcttttggaatatttctcttcaaaaatgtcagagaactgtgatcaagtagtctggactggttactatggcttagtgtataacctggtgaaaatttcatgggaacttcaaggagacgaagaacaggatggacttagaaacatgatatggcaaacattgcagaaaacaaaggattatgaggaagatgtacgaatccaaaatgcaatcaatatagctcagggaacatccttctgtatcagaaattcccatgtttccatatccagatttcttcaccaaggcagataaagagttggcaaaaatcattgaccatcactggcaggaagagctaaagatccgagaaaaagaagatgcaatatgcaaggcccaagaacttaaagataaaaagttagcagagaaaaatcactttcaagaagttatgaagaaaagagaagagaaactacataagcaaaccaagccctatgaacttccttataggaaggaagtaatttaattagaaaagaaaatgtcacctcccaaaattgaggactacatggcagaaatacataggatgaaaaataccaagatagctacatagtaagagaactttcttgtcattaaatggaggtattgtttagaaagaatttgttttcctgatacaagctgtttgtttaatagttatttcttagttctaaattaatgaccaacttttaatcacacttgaatgaagtgatttcactagtcaaaaatttccaagactacatctagtatttttctcaattgacctttatctcatgattgtacagcatacttgataactgattctcagaacattgatattcatcaaacaaacagtttgatggaaattcattacaaattaattaatgggtcaccagataagaattatttcttgaaaacagaatgaacataaactaacaatcctgtaattactattattcaaataaaaacagtatggcatcttatttgattggcattttatagtcaatttataccaaaccaaacaaaccctatttcagagatttgaatctgggagggctggtcatcttagattgattggcttgatctttaacagatgccagaggggattcctgagagatggtggttttactctgttctgtgagtttatgagaatgaattcttatgaacctggaaggtccaggagcaactgctgaagacattcatagaaataggagttattttagaaatggaacttcacttcatctgaagttctgaacctatgagtaagagtaatagggtggagtttttgtgatgtcttatattcctttcctgaaaactgaaaaatatagataatactcatacctcgatttcacacagatgacttggtgatactcaagagacagagacttttatcaggggtgtcaaactcaaatgactaccaggtcagaaaggtaacataaattagtgaagccggctaaggaatacctatcccatatagagaaatttcccatcactcggttacattccaaaatgtatgtcagtattgtaaaatcatccagcctttcaagaagcttttaaatgggattatttttcaaaataaaagtagctaagtaaccaaa

SEQ ID NO: 7474 - DNA, 2501 bp, Homo sapiens
agcaaccagccttggttcccagcggctcagagcgcagcgaatttatgatttatgaatatgcctgttaacaaatcacctatgattaatacatgtggaggcatatcttccccttatcatgaagagctctggaaattaaattttcaacatttaagtggagaaaggggtcataaatcaaggccaacattttcaatcacaaaagaattcatcttgagattcaatcaaacacaaaattccaaagagaaggaagaattgttggaactagctagaaaaatcattctcagatgtaagagaaaattgggtctcaaaaccctgggctctggaaggcatgtgcatcttcctgctgcatggactgaagtaatatatctggctcaatgcaaaggggaaatccaagatgaatctttaaatatgctttatgcatctctggaccatgcttcctttgattatgatcatctgcctgccttattttttgttgcggaatcggttttatacagactgtgttgtgatgcatccctcaaaacatatttatattcagttgaaataaagctagcaaagattggctatttggtcttcttacgactttttatatttttcctgcatggtcatctagaaagttttaaacaacatttacttaggcttcaaccatatttatacgcactttctttctctggagcatcatatcacaagtatccaaacatcttttcaaatgtgcaattcatcctgaaagcctcggaaattataggtaaaagagaactccgttctgaatccatttttagacctgtggaagataagaaaagatatgagaacacagattctgatatgggaggatatgaaattaaccacctgctctggcactgtgttgctgcttggtcttgtgttcagaataacagtcctcagttgaataacgtgcttgaacatctcgtcttccataagacacagcttcaaaagaaatgctggttggattcagtactggctttactggtccttggggaggctgccaaattaaacatggcctgcttgaaagctttaatggacgtagtgagagattttgtttcaagcattatgtctgttcaaaatcaggaagaaagttgcaaggtagatgatttttcctgggcctggaatgtagtctacatatatacagtaattcttgcagaaatctgcttgtatgcagccacttctgatttgcgaaaaactgctttaattggtttctgtcactgtaaaagttcacaaaaaaatattttatacttggacaaatcagtacctccagaattaaaggaaacaagtattttaagtcttttggaatatttctcttcaaaaatgtcagagaactgtgatcaagtagtctggactggttactatggcttagtgtataacctggtgaaaatttcatgggaacttcaaggagacgaagaacaggatggacttagaaacatgatatggcaaacattgcagaaaacaaaggattatgaggaagatgtacgaatccaaaatgcaatcaatatagctcaggctgagttaaatgacccaactgatcctttcactagatatagtacaaatatttcatcaaatgtaggagaagaagttttctccaaatatattgggtggagaattgccaacactctttccaaactattctttccccccattgaggcccattttcttcctttgaagaaaccatcaataaaaaaggatcaaacaaaatatccaaataaaaagctggagtctgtgaaaaagcaagttctacatttcactgtaagggaacatccttctgtatcagaaattcccatgtttccatatccagatttcttcaccaaggcagataaagagttggcaaaaatcattgaccatcactggcaggaagagctaaagatccgagaaaaagaagatgcaatatgcaaggcccaagaacttaaagataaaaagttagcagagaaaaatcactttcaagaagttatgaagaaaagagaagagaaactacataagcaaaccaagccctatgaacttccttataggaaggaagtaatttaattagaaaagaaaatgtcacctcccaaaattgaggactacatggcagaaatacataggatgaaaaataccaagatagctacatagtaagagaactttcttgtcattaaatggaggtattgtttagaaagaatttgttttcctgatacaagctgtttgtttaatagttatttcttagttctaaattaatgaccaacttttaatcacacttgaatgaagtgatttcactagtcaaaaatttccaagactacatctagtatttttctcaattgacctttatctcatgattgtacagcatacttgataactgattctcagaacattgatattcatcaaacaaacagtttgatggaaattcattacaaattaattaatgggtcaccagataagaattatttcttgaaaacagaatgaacataaactaacaatcctgtaattactattattcaaataaaaacagtatggcatcttatttgatt

SEQ ID NO: 7475 - DNA, 1573 bp, Homo sapiens
aatttggaacttaatgggcctttgcgtcctccttccctgagcctccttttattccagacttctcagtgtgagtctgtgcgtccctccgacgatctcagggagtggggtgccttcatctgcctgttccctgttcctcaggctgacgctcccgctgtcctccccgcctcccctcactccttttctccctcccttcctccttgtggggaggctcttggccagggtccctgagcccgggcgggtgctggcagaggacgcagaaggggtgaggtcacgtctcccttgagccccgagccgctggcttttcagagcctcgccacaagccggcggccagagccccagaccacacagaccgtgcgctcctccgccctcccggcgccgccggcctcgcccatgtctcagtacgcccctagcccggacttcaagagggctttggacagcagtcccgaggccaacactgaagatgacaagaccgaggaggacgtgcccatgcccaagaactacctgtggctcaccatcgtctcgtgtttttgccctgcgtaccccatcaacatcgtggctttggtcttttccatcatgtctctgaacagctacaacgatggagactacgaaggagccaggcggcttgggcggaatgctaagtgggtagccatcgcctccatcatcattggccttctcatcatcggcatttcttgtgcagttcacttcacaaggaatgcctgaggaaccagcggtcagtgggctgtgagcgtggaggatggacctcatccacacacaccccaaaggagtttctaaggaatggatccttgacttcagactgtgagatcttttcctccaggactctccagaggcaggtccctggcaaatgaacaagaaaaaaaaaaaaaaaaagtccaaaatttaggcaatccaagctgcacagccggatcagccaaagtcattgatttgtaaaaatgaaaagaaaacagaaaaaagaaaaatgaagtctcactgtctcagtttagcgaatcccgttgtgtccactcctgtcctccagaggcgagcctcaggaaatcacataacttttcactgaggggatccagggggtctccatatagggggagatggaggtttctaggaagagcagcaggtgctggtatttacaatgttgagcacaaacatttgcagcatgtttaaaattgtctagtagagttcaagttgtggatttgcttttccttttattcttataaccttcagtaactcctcctctgggagtcagcactcccatgcccagagttcacccatctggtcatcaaacactcaaagaaggggcttttctggccttttgtcttgatgcttatatttccaaataggccccctcccttgcttgcatccacgttggtcaacttgaccaaaacctcactcttcactcaaacaggctctgagaatggacttagtggccaattctaggtacatgagcacttcctgtatcccagttttgggaataaactggctgtatttatagaatgtgctttttttttttcaatttctcactctctctcctatctctagcaagtctcaggcaagatctttgatt

SEQ ID NO: 7476 - DNA, 1082 bp, Homo sapiens
gccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagtgagtaagacccaggggcaacagtctaccctttgagtgggccgaacccacttccagctctgctgcctccaggaagcccctgggccatgaagtgctggcagtgagcggatggacctagcacttcccctctctggccttagcttcctcctctcttatggggataacagctacctcatggatcacaataagagaacaagagtgaaagagttttgtaaccttcaagtgctgttcagctgcggggatttagcacaggagactctacgctcaccctcagcaacctttctgccccagcagctctcttcctgctaacatctcaggctcccagcccagccaccattactgtggcctgatctggactatcatggtggcaggttccatggactgcagaactccagctgcatggaaagggccagctgcagactttgagccagaaatgcaaacgggaggcctctgggactcagtcagagcgctttggctgaatgaggggtggaaccgagggaagaaggtgcgtcggagtggcagatgcaggaaatgagctgtctattagccttgcctgccccacccatgaggtaggcagaaatcctcactgccagcccctcttaaacaggtagagagctgtgagccccagccccacctgactccagcacacctggcgagtagtagctgtcaataaatctatggtaaacagacaa

SEQ ID NO: 7477 - DNA, 721 bp, Homo sapiens
agacagcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagttccatggactgcagaactccagctgcatggaaagggccagctgcagactttgagccagaaatgcaaacgggaggcctctgggactcagtcagagcgctttggctgaatgaggggtggaaccgagggaagaaggtgcgtcggagtggcagatgcaggaaatgagctgtctattagccttgcctgccccacccatgaggtaggcagaaatcctcactgccagcccctcttaaacaggtagagagctgtgagccccagccccacctgactccagcacacctggcgagtagtagctgtcaataaatctatggtaaacaga

SEQ ID NO: 7478 - DNA, 1866 bp, Homo sapiens
ggaagtagaagacagcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagttccatggactgcagaactccagctgcatggaaagggccagctgcagactttgagccagaaatgcaaacgggaggcctctgggactcagtcagagcgctttggctgaatgaggggtggaaccgagggaagaaggtagagagctgtgagccccagccccacctgactccagcacacctggcgagtagtagctgtcaataaatctatggtaaacagacaagaggaggtggaaggccatacagaatggagccgtgagtatggccagcctccagctctcagccaggaggtccccaaccccaaggaaggaagaaactggaaattaggaactgcttcctcatttaacaaggtaggaagttaggagatcatttactttcaatcacaagggaggagaactgttcctggggcccaaggctgccagtttccagctcagagctcctcccaccccaacatactgtttcctgatccaacagcttacctgatccaagggctcctctgtctgagtgtcttcatcatctgctacttccagggcccccgctgtctccttccttcggtggggagctccatatactcctataactcctaaagaggggaggcagcactgggtgatgcccaggctgaagagccctcagcattcctgccctggaccttcatgctagcccctttccctcccctgaacctggttctgcattccccaccacctcccaggatggcaaggaagtgagaggtgggcctttggtcccacccccatcccctctatatcccacccctgaagtcttatcgctttaagcactgccctttccaggtgcttcttttcatgtgatgaggccctgtgaagaagggacaggatatacagacgggggcagctggagacagttatgatgagtgccggctttgtgtctgagcattctgctcccatggacatccccaacaacagcagggaccaacctatgtcactgtcaaagggcagctgagaagggcctgagccccagggacccctcacctgatgggaatgagagtgtggggagcttgcttcttggctgaatggtctgctggggtctggcatagaaagcagatggcttaattcggtctggttcctttggagagggctgggttacctgggccctgtggccttgggcctagagaagggacactgggcttggaccctgattgctggccattcttacctttcctactccccagttcaggcttcagagagcccctgacgcctgcaggaacatggcagaggagacaccgtctgtcttcacaaagtacgtcctccctccttgctgcctcttcccaccagcctgacttatccagggacagagcagtagatgcctggcactcctcgatgcccagtgaaaccagactgtgcttccccacccccaccaccatgccccatgctcactggctcatttcttgggagggcttagagctggataatataagttcccttgg

SEQ ID NO: 7479 - DNA, 969 bp, Homo sapiens
cagcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagttccatggactgcagaactccagctgcatggaaagggccagctgcagactttgagccagaaatgcaaacgggaggcctctgggactcagtcagagcgctttggctgaatgaggggtggaaccgagggaagaaggtagagagctgtgagccccagccccacctgactccagcacacctggcgagtagtagctgtcaataaatctatggtaaacagacaagaggttagtaagtattcttttattgtgacaaaccctctcccaggcttagtcagctactcctttctctggccagagaatcccataaggaaatagcccccacagccagggctgctctgctcagaggaagggaaggctgggctgtgggtttaggagcaggagaacggggagggctgaggaggccgcagtgtaccctgtgagcccagcggaggtgctggctcctgaggaacaagctgctggaggctaaggacaaaaggtggccagagtagtggtccccagttgccctctggagctgctggctctcaagatggcagagctggggctgaggctgagatagcagccccagccccagg

SEQ ID NO: 7480 - DNA, 1412 bp, Homo sapiens
cggaagtagaagacagcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacagatctgaccctggctgtgcccatctgtaactctctggctatcatcttcacactgattgttgggaaggcccttggagaagatattggtggaaaacgagcagttgctggcatggtgctcaccgtgataggaatttcactctgcatcacaagctcagttccatggactgcagaactccagctgcatggaaagggccagctgcagactttgagccagaaatgcaaacgggaggcctctgggactcagtcagagcgctttggctgaatgaggggtggaaccgagggaagaaggtagagagctgtgagccccagccccacctgactccagcacacctggcgagtagtagctgtcaataaatctatggtaaacagacaagaggaggtggaaggccatacagaatggagccgtgagtatggccagcctccagctctcagccaggaggtccccaaccccaaggaaggaagaaactggaaattaggaactgcttcctcatttaacaaggtgcttcttttcatgtgatgaggccctgtgaagaagggacaggatatacagacgggggcagctggagacagttatgatgagtgccggctttgtgtctgagcattctgctcccatggacatccccaacaacagcagggaccaacctatgtcactgtcaaagggcagctgagaagggcctgagccccagggacccctcacctgatgggaatgagagtgtggggagcttgcttcttggctgaatggtctgctggggtctggcatagaaagcagatggcttaattcggtctggttcctttggagagggctgggttacctgggccctgtggccttgggcctagagaagggacactgggcttggaccctgattgctggccattcttacctttcctactccccagttcaggcttcagagagcccctgacgcctgcaggaacatggcagaggagacaccgtctgtcttcacaaagtacgtcctccctccttgctgcctcttcccaccagcctgacttatccagggacagagcagtagatgcctggcactcctcgatgcccagtgaaaccagactgtgcttccccacccccaccaccatgccccatgctcactggctcatttcttgggagggcttagagctggataatataagttcccttgga

SEQ ID NO: 7481 - DNA, 933 bp, Homo sapiens
atgggtctccgccccttcgttcccggaagtagaagacagcggcgttgccatggcggcgtctctggggcaggtgttggctctggtgctggtggccgctctgtggggtggcacgcagccgctgctgaagcgggcctccgccggcctgcagcgggttcatgagccgacctgggcccagcagttgctacaggagatgaagaccctcttcttgaatactgagtacctgatgccctttctcctcaaccagtgtggatcccttctctattacctcaccttggcatcgacagatctgaccctggctgtgcccatctgtaactctctggctatcatcttcacactgattgttgggaaggcccttggagaagatattggtggaaaacctgttttgcttccttgtggccatcagagttcccttcccctggacagtctggagaaagacagaggctggggtttgggattgaagaccagaccccatctgagcccttcctccagccctgtaccagctcctactggcatggctgagctcagaccctcctgatttctgcctattatcccaggagcagttgctggcatggtgctcaccgtgataggaatttcactctgcatcacaagctcagttccatggactgcagaactccagctgcatggaaagggccagctgcagactttgagccagaaatgcaaacgggaggcctctgggactcagtcagagcgctttggctgaatgaggggtggaaccgagggaagaaggtagagagctgtgagccccagccccacctgactccagcacacctggcgagtagtagctgtcaataaatctatggtaaacagacaagaggttagtaagtattcttttattgtgacaaaccctctcccaggcttagtcagctactcctttctctggccagagaatcccataaggaaatagcccccaca

SEQ ID NO: 7482 - DNA, 2409 bp, Homo sapiens
gtcctagaaggttctttctgcctgttttctccccccccgcccggctgtggggcccagccactgcacttcaccggatgccgtctggttggtcctcaggactgatacagaccaggaccccagggccagcccgtgccaggctcctatgcttccaggagcacgggtgggtggtcctgctgcctggccggccatcctcctggggtcggtctctggccgatcctccctcctcctctcaagccctgcacagcccggccaggcaggtgcatcttgtttggctgctgaggagccgggggttcagggaaattaaggaacgtgcccagggacccggggccagcccgtggggacgctgggattggagcccaagccccaggttcgccgcgcggctctcgacttcctctcctttcccccaggggcgagctcagcgaccgcagagaggtggggtcgatctccctgcgaccccagggggcccgcgaggccagtgcgcgggcaggagcggggacgtgctcagaagagccgggcgccgccgcgcccgcccgccccccgtcccccggctcccggctccgcgcgccccccgccgcccccggggccctgctacccccgacccgtcccctcccgccggccgcccccatggcccggctgggcgcgctgctcctggccgccgccctgggtgcactgctcagcttcgcgctcctggccgccgcggtcgccagcgactactggtacatcctggaggtggcggacgccggcaatggcagcgcctggcccgggcgcgcagagctgctctcctcgcactcggggctctggcgcatctgcgaagtgctgcaccgtgcagtcattgtggtcctgcccctgagcctggtccttctcgtgtgtggctggatctgcggcctgctcagctccctggcccagagcgtgtctctgctgcttttcaccggctgctacttcctgctggggagtgtcctgacactggcgggggtcagcatctacatcagctactcgcacctggcctttgcggagacggtgcagcagtatggcccgcagcacatgcagggcgtccgcgtcagcttcggctggtccatggccctggcctggggctcctgtgccttggaggcattcagcggaaccctcctgctctcagctgcctggaccctcagcctgagccccccaatctgtggtcatctgagtccccagcaggtgggagggagagggggagactgaggcccagagcggcagagggacccacccagatcgcctggcgccagagagatgccgtctcaggccaaggcctccctggcctctgttctgtccactctccccgaagggcaggcttggtggagaagaggctgatgagagggcccgagagcccctccgatttgcaggggtggggggcaaggagctgagcgatccagatgtacccctctgccccctcccttgttctcaagcctgctaggtacttttcactgagcacttccgggaagagcaggcacccagatctctgtccttgtcctggcacaggctgctgctgcttccggcccccgacccttcctctctgcagcaacccgggggaggtatgccactgtgagtgccctggtgggcacactgagctggcagagatggaagtcccagaagggtggggtgggggtgtcatgccatggtggaggagtttggggccactccttgcctgcctcaaagggggcctggctgagggtgcttcttgaccacaggggccagggctgcctagggtggcgcagggctgggcctggagtttgggatgcaggcttgttaaacacagggcagaaccccaggttgggaggggctcagtttgcaggcccaggcccgcaggcccactgctggtcccagggtgagacaggtgagaagagggatggccagcacacacttgagtccccttgggccacaaaggctggggcacgcccaccgttatgcagatggacagttgaggtggctgcaggagaagggttcccagggcctgtacaacacgtggaagcactaaacggccccgtttggggtttgggggcccttcccgagtcttgagaggtcttgagaggtgtgctggggaaggtggcagcctcttgtagcttgatcttcctccaccctgccccacccctaggtctctttattgattcaaaggttaaggaagctcctgggggcttgagggggtggcacagttttggtggggcccagtgaggacaaatctggggggtgagcagggcctcctcttcctcctggtgtttgaacgtttaccattccatgtgggaccattgtgccaatttgtccttaagtaaatcacttgtgctgtgtgcagtataagccttttatttttcttagaacttttcaaaataggtaacacatgcctgtctgtcataaacagtacaaacgtgagcaaacactgtc

SEQ ID NO: 7483 - DNA, 2271 bp, Homo sapiens
gtcctagaaggttctttctgcctgttttctccccccccgcccggctgtggggcccagccactgcacttcaccggatgccgtctggttggtcctcaggactgatacagaccaggaccccagggccagcccgtgccaggctcctatgcttccaggagcacgggtgggtggtcctgctgcctggccggccatcctcctggggtcggtctctggccgatcctccctcctcctctcaagccctgcacagcccggccaggcaggtgcatcttgtttggctgctgaggagccgggggttcagggaaattaaggaacgtgcccagggacccggggccagcccgtggggacgctgggattggagcccaagccccaggttcgccgcgcggctctcgacttcctctcctttcccccaggggcgagctcagcgaccgcagagaggtggggtcgatctccctgcgaccccagggggcccgcgaggccagtgcgcgggcaggagcggggacgtgctcagaagagccgggcgccgccgcgcccgcccgccccccgtcccccggctcccggctccgcgcgccccccgccgcccccggggccctgctacccccgacccgtcccctcccgccggccgcccccatggcccggctgggcgcgctgctcctggccgccgccctgggtgcactgctcagcttcgcgctcctggccgccgcggtcgccagcgactactggtacatcctggaggtggcggacgccggcaatggcagcgcctggcccgggcgcgcagagctgctctcctcgcactcggggctctggcgcatctgcgaaggtgtcctgacactggcgggggtcagcatctacatcagctactcgcacctggcctttgcggagacggtgcagcagtatggcccgcagcacatgcagggcgtccgcgtcagcttcggctggtccatggccctggcctggggctcctgtgccttggaggcattcagcggaaccctcctgctctcagctgcctggaccctcagcctgagccccccaatctgtggtcatctgagtccccagcaggtgggagggagagggggagactgaggcccagagcggcagagggacccacccagatcgcctggcgccagagagatgccgtctcaggccaaggcctccctggcctctgttctgtccactctccccgaagggcaggcttggtggagaagaggctgatgagagggcccgagagcccctccgatttgcaggggtggggggcaaggagctgagcgatccagatgtacccctctgccccctcccttgttctcaagcctgctaggtacttttcactgagcacttccgggaagagcaggcacccagatctctgtccttgtcctggcacaggctgctgctgcttccggcccccgacccttcctctctgcagcaacccgggggaggtatgccactgtgagtgccctggtgggcacactgagctggcagagatggaagtcccagaagggtggggtgggggtgtcatgccatggtggaggagtttggggccactccttgcctgcctcaaagggggcctggctgagggtgcttcttgaccacaggggccagggctgcctagggtggcgcagggctgggcctggagtttgggatgcaggcttgttaaacacagggcagaaccccaggttgggaggggctcagtttgcaggcccaggcccgcaggcccactgctggtcccagggtgagacaggtgagaagagggatggccagcacacacttgagtccccttgggccacaaaggctggggcacgcccaccgttatgcagatggacagttgaggtggctgcaggagaagggttcccagggcctgtacaacacgtggaagcactaaacggccccgtttggggtttgggggcccttcccgagtcttgagaggtcttgagaggtgtgctggggaaggtggcagcctcttgtagcttgatcttcctccaccctgccccacccctaggtctctttattgattcaaaggttaaggaagctcctgggggcttgagggggtggcacagttttggtggggcccagtgaggacaaatctggggggtgagcagggcctcctcttcctcctggtgtttgaacgtttaccattccatgtgggaccattgtgccaatttgtccttaagtaaatcacttgtgctgtgtgcagtataagccttttatttttcttagaacttttcaaaataggtaacacatgcctgtctgtcataaacagtacaaacgtgagcaaacactgtc

SEQ ID NO: 7484 - DNA, 2272 bp, Homo sapiens
gtcctagaaggttctttctgcctgttttctccccccccgcccggctgtggggcccagccactgcacttcaccggatgccgtctggttggtcctcaggactgatacagaccaggaccccagggccagcccgtgccaggctcctatgcttccaggagcacgggtgggtggtcctgctgcctggccggccatcctcctggggtcggtctctggccgatcctccctcctcctctcaagccctgcacagcccggccaggcaggtgcatcttgtttggctgctgaggagccgggggttcagggaaattaaggaacgtgcccagggacccggggccagcccgtggggacgctgggattggagcccaagccccaggttcgccgcgcggctctcgacttcctctcctttcccccaggggcgagctcagcgaccgcagagaggtggggtcgatctccctgcgaccccagggggcccgcgaggccagtgcgcgggcaggagcggggacgtgctcagaagagccgggcgccgccgcgcccgcccgccccccgtcccccggctcccggctccgcgcgccccccgccgcccccggggccctgctacccccgacccgtcccctcccgccggccgcccccatggcccggctgggcgcgctgctcctggccgccgccctgggtgcactgctcagcttcgcgctcctggccgccgcggtcgccagcgactactggtacatcctggaggtggcggacgccggcaatggcagcgcctggcccgggcgcgcagagctgctctcctcgcactcggggctctggcgcatctgcgaaggtgtcctgacactggcgggggtcagcatctacatcagctactcgcacctggcctttgcggagacggtgcagcagtatggcccgcagcacatgcagggcgtccgcgtcagcttcggctggtccatggccctggcctggggctcctgtgccttggaggcattcagcggaaccctcctgctctcagctgcctggaccctcagcctgagccccccaatctgtggtcatctgagtccccagcaggtgggagggagagggggagactgaggcccagagcggcagagggacccacccagatcgcctggcgccagagagatgccgtctcaggccaaggcctccctggcctctgttctgtccactctccccgaagggcaggcttggtggagaagaggctgatgagagggcccgagagcccctccgatttgcaggggtggggggcaaggagctgagcgatccagatgtacccctctgccccctcccttgttctcaagcctgctaggtacttttcactgagcacttccgggaagagcaggcacccagatctctgtccttgtcctggcacaggctgctgctgcttccggcccccgacccttcctctctgcagcaacccgggggaggtatgccactgtgagtgccctggtgggcacactgagctggcagagatggaagtcccagaagggtggggtgggggtgtcatgccatggtggaggagtttggggccactccttgcctgcctcaaagggggcctggctgagggtgcttcttgaccacaggggccagggctgcctagggtggcgcagggctgggcctggagtttgggatgcaggcttgttaaacacagggcagaaccccaggttgggaggggctcagtttgcaggcccaggcccgcaggcccactgctggtcccagggtgagacaggtgagaagagggatggccagcacacacttgagtccccttgggccacaaaggctggggcacgcccaccgttatgcagatggacagttgaggtggctgcaggagaagggttcccagggcctgtacaacacgtggaagcactaaacggccccgtttggggtttgggggcccttcccgagtcttgagaggtcttgagaggtgtgctggggaaggtggcagcctcttgtagcttgatcttcctccaccctgccccacccctaggtctctttattgattcaaaggttaaggaagctcctgggggcttgagggggtggcacagttttggtggggcccagtgaggacaaatctggggggtgagcagggcctcctcttcctcctggtgtttgaacgtttaccattccatgtgggaccattgtgccaatttgtccttaagtaaatcacttgtgctgtgtgcagtataagccttttatttttcttagaacttttcaaaataggtaacacatgcctgtctgtcataaacagtacaaacgtgagcaaacactgtca

SEQ ID NO: 7485 - DNA, 1786 bp, Homo sapiens
atggcccggctgggcgcgctgctcctggccgccgccctgggtgcactgctcagcttcgcgctcctggccgccgcggtcgccagcgactactggtacatcctggaggtggcggacgccggcaatggcagcgcctggcccgggcgcgcagagctgctctcctcgcactcggggctctggcgcatctgcgaagtgctgcaccgtgcagtcattgtggtcctgcccctgagcctggtccttctcgtgtgtggctggatctgcggcctgctcagctccctggcccagagcgtgtctctgctgcttttcaccggctgctacttcctgctggggagtgtcctgacactggcgggggtcagcatctacatcagctactcgcacctggcctttgcggagacggtgcagcagtatggcccgcagcacatgcagggcgtccgcgtcagcttcggctggtccatggccctggcctggggctcctgtgccttggaggcattcagcggaaccctcctgctctcagctgcctggaccctcagcctgagccccccaatctgtggtcatctgagtccccagcaggtgggagggagagggggagactgaggcccagagcggcagagggacccacccagatcgcctggcgccagagagatgccgtctcaggccaaggcctccctggcctctgttctgtccactctccccgaagggcaggcttggtggagaagaggctgatgagagggcccgagagcccctccgatttgcaggggtggggggcaaggagctgagcgatccagatgtacccctctgccccctcccttgttctcaagcctgctaggtacttttcactgagcacttccgggaagagcaggcacccagatctctgtccttgtcctggcacaggctgctgctgcttccggcccccgacccttcctctctgcagcaacccgggggaggtatgccactgtgagtgccctggtgggcacactgagctggcagagatggaagtcccagaagggtggggtgggggtgtcatgccatggtggaggagtttggggccactccttgcctgcctcaaagggggcctggctgagggtgcttcttgaccacaggggccagggctgcctagggtggcgcagggctgggcctggagtttgggatgcaggcttgttaaacacagggcagaaccccaggttgggaggggctcagtttgcaggcccaggcccgcaggcccactgctggtcccagggtgagacaggtgagaagagggatggccagcacacacttgagtccccttgggccacaaaggctggggcacgcccaccgttatgcagatggacagttgaggtggctgcaggagaagggttcccagggcctgtacaacacgtggaagcactaaacggccccgtttggggtttgggggcccttcccgagtcttgagaggtcttgagaggtgtgctggggaaggtggcagcctcttgtagcttgatcttcctccaccctgccccacccctaggtctctttattgattcaaaggttaaggaagctcctgggggcttgagggggtggcacagttttggtggggcccagtgaggacaaatctggggggtgagcagggcctcctcttcctcctggtgtttgaacgtttaccattccatgtgggaccattgtgccaatttgtccttaagtaaatcacttgtgctgtgtgcagtataagccttttatttttcttagaacttttcaaaataggtaacacatgcctgtctgtcataaacagtacaaacgtgagcaaacactgtca

SEQ ID NO: 7486 - DNA, 1187 bp, Homo sapiens
agaagagccgggcgccgccgcgcccgcccgccccccgtcccccggctcccggctccgcgcgccccccgccgcccccggggccctgctacccccgacccgtcccctcccgccggccgcccccatggcccggctgggcgcgctgctcctggccgccgccctgggtgcactgctcagcttcgcgctcctggccgccgcggtcgccagcgactactggtacatcctggaggtggcggacgccggcaatggcagcgcctggcccgggcgcgcagagctgctctcctcgcactcggggctctggcgcatctgcgaagggcagaacggctgcatcccgctggtcgacccttttgccagtgagagcctggacgtctccacctcggtgcagcacctcatcttgctgcaccgtgcagtcattgtggtcctgcccctgagcctggtccttctcgtgtgtggctggatctgcggcctgctcagctccctggcccagagcgtgtctctgctgcttttcaccggctgctacttcctgctggggagtgtcctgacactggcgggggtcagcatctacatcagctactcgcacctggcctttgcggagacggtgcagcagtatggcccgcagcacatgcagggcgtccgcgtcagcttcggctggtccatggccctggcctggggctcctgtgccttggaggcattcagcggaaccctcctgctctcagctgcctggaccctcagcctgagccccccaatctgtggtcatctgagtccccagcaggtgggagggagagggggagactgaggcccagagcggcagagggacccacccagatcgcctggcgccagagagatgccgtctcaggccaaggcctccctggcctctgttctgtccactctccccgaagggcaggcttggtggagaagaggctgatgagagggcccgagagcccctccgatttgcaggggtggggggcaaggagctgagcgatccagatgtacccctctgccccctcccttgttctcaagcctgctaggtacttttcactgagcacttccgggaagagcaggcacccagatctctgtccttgtcctggcacaggctgctgctgcttccggcccccgacccttcctctctgcagcaacccgggggaggtatgccactgtgagtgccctggtgggcacactgagctggcaga

SEQ ID NO: 7487 - DNA, 2272 bp, Homo sapiens; identical to SEQ ID NO: 7484

SEQ ID NO: 7488 - DNA, 2606 bp, Homo sapiens
agtcccaggttcttggcagcttgcttttcctcaggatggcttctggaaggctcattaagttcgtggtttttgagctcctagagtttgccgctttctccatccccacactcgtgatcacagaacagtttgccaccgcctaccaaggaacaagggctagatctgacaacacacactactggctgatcatctcctgttctattgcctatgttgcgttagtgactctactgatctgggttcctgtaaaagttatcctgcacaagaaacgttatatttacagaaaaattaaaggatggagacctgttctgatgatgtgtgtggtcctcaccacactgccctgcctcaccttttccatagcagtgactgaggttcaaaagagcattaatgggtccgctgatgtcttacctgatatgttacctgacctgcccgtatctctggttctgttatccctgatcatggttgatattattgaaaaactcaggatatatcctcttagagggagtcaaaagagtagtgaaaatggacacatccattcaacctctttgcaacacataaaaactgtgacggagcaagtgaggcaaagtccagaaaacgctgcatctccccaggcaaccaacagcacccaggtgtcgcagccatcaggagccatgacacggagccaggagtctgtgttcatgggaccccaggagccctcctgtgactccggaatcctgagaatgatgtcccggcgagatgtccgggcagagttattcttatggagctttctcctgtggtctgacacgatagaaatggtgcgtgtggctggtcaccccaacgtgtacaagtcaagctggctatacccagtctacatattcagttttatttctctccttcgaattacattcactccccaaaaccctcttctcaattccctgagcgtcctgctgcaagatttaccattcgtttttgttagacttggtttaatcattgccctggggactatcacacccgtactgggcctgtgtaaaaatatcctcgtgactctctcttacatttacttcaattacctaaccagaatcaggattttttctgcctttgaaatgtctccattttaaaaaggaaatgggatctagtaaggcctctttgtgatacctgtgtgcacatttgtaatccttctttttttcttggggcgtaggtgtttgcactataaaggaaatgactagattgtagagaataagccatttttactaactctagcatatcagtttttttttttacatatacaaatggtgctaaatttaagtaaagtaatattcttataagttggctctcaggtatttctagaaaatgttagcagctaattttagttagttatgtatactgaggtccccaacccctggaccatggtcccagtactggtccgtgatctgttagcaagcagaccgcacagcacgtggtgaacctcaaactgagcgttcccgcctgcattccgcctcctgtcagatcagcagcagcattagatcctcataggagcccaaaccctattgtgaactgcgtatgcaagggatctagctttcgctctttaagaaaatctaatacctgatgatctgaggtgggacagtttcatcccagaacccaaccccacccccaaccctggctgtggaaaaattgtcttccacaaaactagtccctggtgccaaaaaggttggggaccactgatgtataccacgctttttctaagaatactcttcaacggagccctttaaaaaactaagaaccttttccatcaagttagcccaagaataagatttttatcttttatatagatagcattatatgaattgattgattaaatttagttttaaaaaacacacttgaaattattgaataatttttaggttatacttttttttttttttttgagacgatgtctcgctcttgtcccctaggctggagtgcgatggcgcgttctcagctcactgcaacctgggaggcagaggttgcaatgagctgagattgcgccattgcacaccagcctgggtgacaagagtctcaaaaaaaaaattataatacaagtaattactttcgaattctgccatgggtatctttttattattaagaaaagcctgtcatcaagggattcatttatgatattcctaaatatgaaaatattttgtgtaagtatatatttatctccatattagaacttagcaacagtgctcagataaactcaaaagtattacttgagtttagaatgcattttgtatctaatattttaatatgaatgtgcctgatattttcggaagtcacaacactatacaaataatgaaggcatgtacagaagattatgtgtaggaggaaaattgagtagctaatttaatttcatttaatattttacttagagtgtatacatgtttatagactgcaagtctatgggatttaatagatattacagcaaattacactgcgaaaacattgatagttctacactgtaattaaatgttatatatattattaaaattattaggttggtgcaaaagtaattgaggtttttgccattgaaagtggtggtgcatgcctgtaatcccagctactcgggaggctgaatcagaattgcttgaacccggagg

SEQ ID NO: 7489 - DNA, 5464 bp, Homo sapiens
caaagagggagtcccaggttcttggcagcttgcttttcctcaggatggcttctggaaggctcattaagttcgtggtttttgagctcctagagtttgccgctttctccatccccacactcgtgatcacagaacagtttgccaccgcctaccaaggaacaagggctagatctgacaacacacactactggctgatcatctcctgttctattgcctatgttgcgttagtgactctactgatctgggttcctgtaaaagttatcctgcacaagaaacgttatatttacagaaaaattaaaggatggagacctgttctgatgatgtgtgtggtcctcaccacactgccctgcctcaccttttccatagcagtgactgaggttcaaaagagcattaatgggtccgctgatgtcttacctgatatgttacctgacctgcccgtatctctggttctgttatccctgatcatggttgatattattgaaaaactcaggatatatcctcttagagggagtcaaaagagtagtgaaaatggacacatccattcaacctctttgcaacacataaaaactgtgacggagcaagtgaggcaaagtccagaaaacgctgcatctccccaggcaaccaacagcacccaggtgtcgcagccatcaggagccatgacacggagccaggagtctgtgttcatgggaccccaggagccctcctgtgactccggaatcctgagaatgatgtcccggcgagatgtccgggcagagttattcttatggagctttctcctgtggtctgacacgatagaaatggtgcgtgtggctggtcaccccaacgtgtacaagtcaagctggctatacccagtctacatattcagttttatttctctccttcgaattacattcactccccaaaaccctcttctcaattccctgagcgtcctgctgcaagatttaccattcgtttttgttagacttggtttaatcattgccctggggactatcacacccgtactgggcctgtgtaaaaatatcctcgtgactctctcttacatttacttcaattacctaaccagaatcaggattttttctgcctttgaaatgtctccattttaaaaaggaaatgggatctagtaaggcctctttgtgatacctgtgtgcacatttgtaatccttctttttttcttggggcgtaggtgtttgcactataaaggaaatgactagattgtagagaataagccatttttactaactctagcatatcagtttttttttttacatatacaaatggtgctaaatttaagtaaagtaatattcttataagttggctctcaggtatttctagaaaatgttagcagctaattttagttagttatgtatactgaggtccccaacccctggaccatggtcccagtactggtccgtgatctgttagcaagcagaccgcacagcacgtggtgaacctcaaactgagcgttcccgcctgcattccgcctcctgtcagatcagcagcagcattagatcctcataggagcccaaaccctattgtgaactgcgtatgcaagggatctagctttcgctctttaagaaaatctaatacctgatgatctgaggtgggacagtttcatcccagaacccaaccccacccccaaccctggctgtggaaaaattgtcttccacaaaactagtccctggtgccaaaaaggttggggaccactgatgtataccacgctttttctaagaatactcttcaacggagccctttaaaaaactaagaaccttttccatcaagttagcccaagaataagatttttatcttttatatagatagcattatatgaattgattgattaaatttagttttaaaaaacacacttgaaattattgaataatttttaggttatacttttttttttttttttgagacgatgtctcgctcttgtcccctaggctggagtgcgatggcgcgttctcagctcactgcaacctgtatctcccgggttcaagcgattctcctgcctcagcctcccaagtagctgggaatacaggcacctgccaccacgctggctaatttttgtatttttagtagagacgaggtttcaccatgttggccaggctggtctcaaactcctgacctcaggtgatctgcccacctcggccttccaaagtgctgggattacaggtgtgagccaccacgcccggctggattatactttttaaaaatttgaaaattgtagttttaggggttccttcaaaggtggaattatattctttattccattgtggcaagggacttttattcaataaattgatttcagcataaaaagcaattcactttaacagatatttggctcagtttaaggcttagctgtattgccagtactgaagtactaatatgagtgttgtttagtataatgaagtcaaggtacatcagtaataccaagataaagtttcataataaaaagccataaagtgaagacagagatttcaaagtaaaagaatattttatttgtggaatttgatactttgataaataatcaaagtacaagccctgtttaaaattaaaagttcggcttacaaatataatagccaatgtatcagtgtcttatgtgatactatatcatggatatattgatgttataaaataattagatacagagtcatgcaacttgctttcaccctgttgggacactctgaacagtcagcactgttcatttgatagtaattttcagatgctagagagatttgtgagaggctgataatgcaagagtaatgatttatgtagccagtttcttcaatgatctgtgataacaaatcattaagaatgagacatatggcttaagaatgaagcttaagaatttgacatatggccggctgtggtggctcacacgtgtaatcccagcactttgggaggttgaggcaggtagatcactggagtccaggagtctgagaccagcctgggcaacatggagagattctacctctacaaaaaatacaaaaattagctgggcatggtgatctgcaactatagtcccagctacttaggaggctggggcaggaagattgcttgagcccaggaggtcaaggctacagtgagctatgatcatgccactgcactccagactgggcaacagagtgacacccatctaaaaaaaataaaagagaatttgacgttgtgttattctacgctccaccaaatacctctccccttgccaccctgtctccctttccctctgttttaggatttttctcacactgtaaaagaagatttactcacagttgttaaaagcttgccttccagctttctaatttgaggtaggttctataacctctgtgggtccccgtttccacatgtaaaagatgaacataatactagtactacattaatagggttaggagggttaaagggtaaagagtcctttgagcacattttctggcaaaccataataacttgataaatgctaagcattggaacgggtaccaagtctccaagaaacaagtatctcaatgcagttttagaaatttcctgttttattcttttctgtggccctgctcaccctctgggaataatcatttcaactttgcatttgtgaaaaataatacatacaatcttaaggttacttcagactatactttttcatcgaggagtattgtattcaaaagtgatcgatctgctgaatatataaattaaaatggacacaagccttcattcatcagacatttgagtgtctgtcctctgagttcccatagaatctgaattacaccactttattcacacttacattatgtgtttacttttctgagtgtcctattaatctttattccttaaaggaaagcctgagggcatcttgtttaacaatgcatctctctcttcatcaatcaacgctgcaggtgcttacaagacttataacttaaaaaaattataatacaaggctcagcgcagtgcctcaagtgccaacagtttcggaggccttggcaggcggatcacttgaggccaagagttcgagactagcctggccaacatggtgaaacaccgtctgtactaaaaatacaaaaattagctgggtgtggtggcacgcgcctgtagtctcagctacttgggaggctgaggcaggagaatcacttgaacctgggaggcagaggttgcaatgagctgagattgcgccattgcacaccagcctgggtgacaagagtctcaaaaaaaaaattataatacaagtaattactttcgaattctgccatgggtatctttttattattaagaaaagcctgtcatcaagggattcatttatgatattcctaaatatgaaaatattttgtgtaagtatatatttatctccatattagaacttagcaacagtgctcagataaactcaaaagtattacttgagtttagaatgcattttgtatctaatattttaatatgaatgtgcctgatattttcggaagtcacaacactatacaaataatgaaggcatgtacagaagattatgtgtaggaggaaaattgagtagctaatttaatttcatttaatattttacttagagtgtatacatgtttatagactgcaagtctatgggatttaatagatattacagcaaattacactgcgaaaacattgatagttctacactgtaattaaatgttatatatattattaaaattattaggttggtgcaaaagtaattgaggtttttgccattgaaagtggtggtgcatgcctgtaatcccagctactcgggaggctgaatcagaattgcttgaacccggagggcagaggttgcagtgagctgagatctcgccactatgctccagcctgggcaacagattgagactctgtctcaaaaaaaaaaaaaagtcaagtacagttagttaaaggaatgtgcatttaaaaattaatctatgattaggctattaatatatagtctaataattttattgcattataattataaagtagttttataattttataaaattttattgatgctgtaatttttataaaattttatttattttataattttacaaaaaattctaatacctgtaatacactttttagtgccttttctttctaaaagttaatgtttgaaattacaatgtgtaaatgttatctcgtcttgtttttcttattagggccccatttcactgaatgacaattgcaatgaggcataggaaagaaaagggaaatgaaattgcttgctgaagtcctactatgttctgggcactatgctgtttgcctaatacataattgccttgtgctgtgtaccttggagcagggccttacatagtgaatatatcaatagttgttcacaaaaagagcaatataccacttagaagctacaaaacttaaaaatggctacttatactccatagaagatatagtaaataatagaagaaaaaaatgaaatggctaaagacattttgttttacaatggggctgtttttacatgttaattaaaattctatgtttaaacaaa

SEQ ID NO: 7490 - DNA, 2607 bp, Homo sapiens
agtcccaggttcttggcagcttgcttttcctcaggatggcttctggaaggctcattaagttcgtggtttttgagctcctagagtttgccgctttctccatccccacactcgtgatcacagaacagtttgccaccgcctaccaaggaacaagggctagatctgacaacacacactactggctgatcatctcctgttctattgcctatgttgcgttagtgactctactgatctgggttcctgtaaaagttatcctgcacaagaaacgttatatttacagaaaaattaaaggatggagacctgttctgatgatgtgtgtggtcctcaccacactgccctgcctcaccttttccatagcagtgactgaggttcaaaagagcattaatgggtccgctgatgtcttacctgatatgttacctgacctgcccgtatctctggttctgttatccctgatcatggttgatattattgaaaaactcaggatatatcctcttagagggagtcaaaagagtagtgaaaatggacacatccattcaacctctttgcaacacataaaaactgtgacggagcaagtgaggcaaagtccagaaaacgctgcatctccccaggcaaccaacagcacccaggtgtcgcagccatcaggagccatgacacggagccaggagtctgtgttcatgggaccccaggagccctcctgtgactccggaatcctgagaatgatgtcccggcgagatgtccgggcagagttattcttatggagctttctcctgtggtctgacacgatagaaatggtgcgtgtggctggtcaccccaacgtgtacaagtcaagctggctatacccagtctacatattcagttttatttctctccttcgaattacattcactccccaaaaccctcttctcaattccctgagcgtcctgctgcaagatttaccattcgtttttgttagacttggtttaatcattgccctggggactatcacacccgtactgggcctgtgtaaaaatatcctcgtgactctctcttacatttacttcaattacctaaccagaatcaggattttttctgcctttgaaatgtctccattttaaaaaggaaatgggatctagtaaggcctctttgtgatacctgtgtgcacatttgtaatccttctttttttcttggggcgtaggtgtttgcactataaaggaaatgactagattgtagagaataagccatttttactaactctagcatatcagtttttttttttacatatacaaatggtgctaaatttaagtaaagtaatattcttataagttggctctcaggtatttctagaaaatgttagcagctaattttagttagttatgtatactgaggtccccaacccctggaccatggtcccagtactggtccgtgatctgttagcaagcagaccgcacagcacgtggtgaacctcaaactgagcgttcccgcctgcattccgcctcctgtcagatcagcagcagcattagatcctcataggagcccaaaccctattgtgaactgcgtatgcaagggatctagctttcgctctttaagaaaatctaatacctgatgatctgaggtgggacagtttcatcccagaacccaaccccacccccaaccccggctgtggaaaaattgtcttccacaaaactagtccctggtgccaaaaaggttggggaccactgatgtataccacgctttttctaagaatactcttcaacggagccctttaaaaaactaagaaccttttccatcaagttagcccaagaataagatttttatcttttatatagatagcattatatgaattgattgattaaatttagttttaaaaaacacacttgaaattattgaataatttttaggttatactttttttttttttttgagacgatgtctcgctcttgtcccctaggctggagtgcgatggcgcgttctcagctcactgcaacctgggaggcagaggttgcaatgagctgagattgcgccattgcacaccagcctgggtgacaagagtctcaaaaaaaaaattataatacaagtaattactttcgaattctgccatgggtatctttttattattaagaaaagcctgtcatcaagggattcatttatgatattcctaaatatgaaaatattttgtgtaagtatatatttatctccatattagaacttagcaacagtgctcagataaactcaaaagtattacttgagtttagaatgcattttgtatctaatattttaatatgaatgtgcctgatattttcggaagtcacaacactttatacaaataatgaaggcatgtacagaagattatgtgtaggaggaaaattgagtagctaatttaatttcatttaatattttacttagagtgtatacatgtttatagactgcaagtctatgggatttaatagatattacagcaaattacactgcgaaaacattgatagttctacactgtaattaaatgttatatatattattaaaattattaggttggtgcaaaagtaattgaggtttttgccattgaaagtggtggtgcatgcctgtaatcccagctactcgggaggctgaatcagaattgcttgaacccggagg

SEQ ID NO: 7491 - DNA, 5465 bp, Homo sapiens
caaagagggagtcccaggttcttggcagcttgcttttcctcaggatggcttctggaaggctcattaagttcgtggtttttgagctcctagagtttgccgctttctccatccccacactcgtgatcacagaacagtttgccaccgcctaccaaggaacaagggctagatctgacaacacacactactggctgatcatctcctgttctattgcctatgttgcgttagtgactctactgatctgggttcctgtaaaagttatcctgcacaagaaacgttatatttacagaaaaattaaaggatggagacctgttctgatgatgtgtgtggtcctcaccacactgccctgcctcaccttttccatagcagtgactgaggttcaaaagagcattaatgggtccgctgatgtcttacctgatatgttacctgacctgcccgtatctctggttctgttatccctgatcatggttgatattattgaaaaactcaggatatatcctcttagagggagtcaaaagagtagtgaaaatggacacatccattcaacctctttgcaacacataaaaactgtgacggagcaagtgaggcaaagtccagaaaacgctgcatctccccaggcaaccaacagcacccaggtgtcgcagccatcaggagccatgacacggagccaggagtctgtgttcatgggaccccaggagccctcctgtgactccggaatcctgagaatgatgtcccggcgagatgtccgggcagagttattcttatggagctttctcctgtggtctgacacgatagaaatggtgcgtgtggctggtcaccccaacgtgtacaagtcaagctggctatacccagtctacatattcagttttatttctctccttcgaattacattcactccccaaaaccctcttctcaattccctgagcgtcctgctgcaagatttaccattcgtttttgttagacttggtttaatcattgccctggggactatcacacccgtactgggcctgtgtaaaaatatcctcgtgactctctcttacatttacttcaattacctaaccagaatcaggattttttctgcctttgaaatgtctccattttaaaaaggaaatgggatctagtaaggcctctttgtgatacctgtgtgcacatttgtaatccttctttttttcttggggcgtaggtgtttgcactataaaggaaatgactagattgtagagaataagccatttttactaactctagcatatcagtttttttttttacatatacaaatggtgctaaatttaagtaaagtaatattcttataagttggctctcaggtatttctagaaaatgttagcagctaattttagttagttatgtatactgaggtccccaacccctggaccatggtcccagtactggtccgtgatctgttagcaagcagaccgcacagcacgtggtgaacctcaaactgagcgttcccgcctgcattccgcctcctgtcagatcagcagcagcattagatcctcataggagcccaaaccctattgtgaactgcgtatgcaagggatctagctttcgctctttaagaaaatctaatacctgatgatctgaggtgggacagtttcatcccagaacccaaccccacccccaaccccggctgtggaaaaattgtcttccacaaaactagtccctggtgccaaaaaggttggggaccactgatgtataccacgctttttctaagaatactcttcaacggagccctttaaaaaactaagaaccttttccatcaagttagcccaagaataagatttttatcttttatatagatagcattatatgaattgattgattaaatttagttttaaaaaacacacttgaaattattgaataatttttaggttatactttttttttttttttgagacgatgtctcgctcttgtcccctaggctggagtgcgatggcgcgttctcagctcactgcaacctgtatctcccgggttcaagcgattctcctgcctcagcctcccaagtagctgggaatacaggcacctgccaccacgctggctaatttttgtatttttagtagagacgaggtttcaccatgttggccaggctggtctcaaactcctgacctcaggtgatctgcccacctcggccttccaaagtgctgggattacaggtgtgagccaccacgcccggctggattatactttttaaaaatttgaaaattgtagttttaggggttccttcaaacgtggaattatattctttattccattgtggcaagggacttttattcaataaattgatttcagcataaaaagcaattcactttaacagatatttggctcagtttaaggcttagctgtattgccagtactgaagtactaatatgagtgttgtttagtataatgaagtcaaggtacatcagtaataccaagataaagtttcataataaaaagccataaagtgaagacagagatttcaaagtaaaagaatattttatttgtggaatttgatactttgataaataatcaaagtacaagccctgtttaaaattaaaagttcggcttacaaatataatagccaatgtatcagtgtcttatgtgatactatatcatggatatattgatgttataaaataattagatacagagtcatgcaacttgctttcaccctgttgggacactctgaacagtcagcactgttcatttgatagtaattttcagatgctagagagatttgtgagaggctgataatgcaagagtaatgatttatgtagccagtttcttcaatgatctgtgataacaaatcattaagaatgagacatatggcttaagaatgaagcttaagaatttgacatatggccggctgtggtggctcacacgtgtaatcccagcactttgggaggttgaggcaggtagatcactggagtccaggagtctgagaccagcctgggcaacatggagagattctacctctacaaaaaatacaaaaattagctgggcatggtgatctgcacctatagtcccagctacttaggaggctggggcaggaagattgcttgagcccaggaggtcaaggctacagtgagctatgatcatgccactgcactccagactgggcaacagagtgacacccatctaaaaaaaataaaagagaatttgacgttgtgttattctacgctccaccaaatacctctccccctgccaccctgtctccctttccctctgttttaggatttttctcacactgtaaaagaagatttactcacagttgttaaaagcttgccttccagctttctaatttgaggtaggttctataacctctgtgggtccccgtttccacatgtaaaagatgaacataatactagtactacattaatagggttaggagggttaaagggtaaagagtcctttgagcacattttctggcaaaccataataacttgataaatgctaagcattggaacgggtaccaagtctccaagaaacaagtatctcaatgcagttttagaaatttcctgttttattcttttctgtggccctgctcaccctctgggaataatcatttcaactttgcatttgtgaaaaataatacatacaatcttaaggttacttcagactatactttttcatcgagcagtattgtattcaaaagtgatcgatctgctgaatatataaattaaaatggacacaagccttcattcatcagacatttgagtgtctgtcctctgagttcccatagaatctgaattacaccactttattcatacttacattatgtgtttacttttctgagtgtcctattaatctttattccttaaaggaaagcctgagggcatcttgtttaacaatgcatctctctcttcatcaatcaacgctgcaggtgcttacaagacttataacttaaaaaaattataatacaaggctcagcgcagtgcctcaagtgccaacagtttcggaggccttggcaggcggatcacttgaggccaagagttcgagactagcctggccaacatggtgaaacaccgtctgtactaaaaatacaaaaattagctgggtgtggtggcacgcgcctgtagtctcagctacttgggaggctgaggcaggagaatcacttgaacctgggaggcagaggttgcaatgagctgagattgcgccattgcacaccagcctgggtgacaagagtctcaaaaaaaaaattataatacaagtaattactttcgaattctgccatgggtatctttttattattaagaaaagcctgtcatcaagggattcatttatgatattcctaaatatgaaaatattttgtgtaagtatatatttatctccatattagaacttagcaacagtgctcagataaactcaaaagtattacttgagtttagaatgcattttgtatctaatattttaatatgaatgtgcctgatattttcggaagtcacaacactttatacaaataatgaaggcatgtacagaagattatgtgtaggaggaaaattgagtagctaatttaatttcatttaatattttacttagagtgtatacatgtttatagactgcaagtctatgggatttaatagatattacagcaaattacactgcgaaaacattgatagttctacactgtaattaaatgttatatatattattaaaattattaggttggtgcaaaagtaattgaggtttttgccattgaaagtggtggtgcatgcctgtaatcccagctactcgggaggctgaatcagaattgcttgaacccggagggcagaggttgcagtgagctgagatctcgccactatgctccagcctgggcaacagattgagactctgtctcaaaaaaaaaaaaaagtcaagtacagttagttaaaggaatgtgcatttaaaaattaatctatgattaggctattaatatatagtctaataattttattgcattataattataaagtagttttataattttataaaattttattgatgctgtaatttttataaaattttatttattttataattttacaaaaaattctaatacctgtaatacactttttagtgccttttctttctaaaagttaatgtttgaaattacaatgtgtaaatgttatctcgtcttgtttttcttattagggccccatttcactgaatgacaattgcaatgaggcataggaaagaaaagggaaatgaaattgcttgctgaagtcctactatgttctgggcactatgctgtttgcctaataaataattgccttgtgctgtgtaccttggagcagggccttacatagtgaatatatcaatagttgttcacaaaaagagcaatataccacttagaagctacagaacttaaaaatggctacttatactccatagaagatatagtaaataatagaagaaaaaaatgaaatggctaaagacattttgttttacaatggggctgtttttacatgttaattaaaattctatgtttaaacaaa

SEQ ID NO: 7492 - DNA, 718 bp, Homo sapiens
ggccccgcccgatgtccatgagcgcgaacaccatgatcttcatgattctgggggcgtcggtcgtgatggccatcgcgtgcttgatggacatgaacgcgctgctggaccgattccacaactacatcctcccgcacctgcggggcgaggaccgcgtctgccactgcaactgtggccggcaccatatccactacgtgatcccgtacgacggggaccagtcggtggtggacgcctccgagaactactttgtgacggacagtgtgaccaagcaggagatcgacctcatgctggggctgctgctgggcttttgcatcagctggttcctggtgtggatggacggcgtcctgcactgcgccgtgcgcgcctggagagccggacggcgctacgatggctcgtggacctggctgcccaagctgtgcagcctgcgggagctgggccggcggccgcacaggcccttcgaggaggccgccgggaacatggtacacgtgaagcagaaactctaccacaatggccaccccagcccgcggcacctgtgagccgcacggggacttaccggggccaccgagccaaccggctgctgtacagatgtaaaagggacctcgtggacgcccgggccggcgggactggacagcagccctgggcccaggttgtccggggctgtggccggccgggagagtccagtggaaggtgctgtctcttctttttataaagggggttgggg

SEQ ID NO: 7493 - DNA, 717 bp, Homo sapiens
agggaagcgctgacctctgcggaggcggcgggggccccgcccgatgtccatgagcgcgaacaccatgatcttcatgattctgggggcgtcggtcgtgatggccatcgcgtgcttgatggacatgaacgcgctgctggaccgattccacaactacatcctcccgcacctgcggggcgaggaccgcgtctgccactgcaactgtggccggcaccatatccactacgtgatcccgtacgacggggaccagtcggtggtggacgcctccgagaactactttgtgacggacagtgtgaccaagcaggagatcgacctcatgctggggctgctgctgggcttttgcatcagctggttcctggtgtggatggacggcgtcctgcactgcgccgtgcgcgcctggagagccggacggcgctacgatggctcgtggacctggctgcccaagctgtgcagcctgcgggagctgggccggcggccgcacaggcccttcgaggaggccgccgggaacatggtacacgtgaagcagaaactctaccacaatggccaccccagcccgcggcacctgtgagccgcacggggacttaccggggccaccgagccaaccggctgctgtacagatgtaaaagggacctcgtggacgcccgggccggcgggactggacagcagccctgggcccaggttgtccggggctgtggccggccgggagagtccagtggaagg

SEQ ID NO: 7494 - DNA, 2934 bp, Homo sapiens
ccaggggatttgggcaggcaccgtggatccccgagaaggggacgagttgacagatgtgcgtgaggaggtctctggtcggcctcaccttttgtacctgctacctggcttcttacctcacgaacaagtatgtgctgtctgtcttgaaatttacctaccctacattattccaagggtggcagacgctcattggtggacttttgcttcatgtgtcctggaaactgggctgggtagagatcaacagcagttcaagatctcatgttcttgtgtggcttcctgcttcagtgctgtttgtgggtataatctatgctgggtccagagcattgtccagactggccattcctgtgtttctcactttgcataatgtagctgaagttatcatctgtgggtaccagaagtgttttcagaaagagaaaacatctcctgcaaagatctgtagtgccctcctcctcctggccgcagcaggatgccttcccttcaatgactcccagtttaatccagatggatatttttgggctataattcacttactctgtgtaggggcttataaaattctacagaagtcccagaaacccagtgcattaagtgacattgaccagcaatacttaaactatatattcagtgtggtgctcctggcatttgcatctcatcccacaggtgatctcttcagcgtcctggacttcccattcctgtacttctacagattccatggtagctgctgtgccagtggatttttgggattctttctcatgttcagtacagtgaagctaaaaaaccttctggccccagggcagtgtgcagcctggattttctttgctaagataatcacagctggcttatcaatattgctgtttgatgcgatcctgaccagtgcaaccacgggatgcctcctgctcggtgcgcttggagaggccttgctggttttctcagagcggaagagctcctgaacaagacggtcaagagaaagactcacaggctgctgcgggagaacagcttgtacacctgtgtacgagcccctggtctcatagctccctgttggatgtgtcagaaagaggaatgcaaggacagtgaggccaggtgggcagtgccatcaccctcacccaagtgaatgtggtggtggctgatgaggccgaggccctggtgcttcaaggagcaccctttctgggggtctgcaggtcactgcagaggagcggtctgttacatcttcccatttggagaacctctctcaaccgtgctgtagctggttctgcagaaacaggaagtacaggatttcatgggctggctctgctcgcctcgactgagcttcacacctctggatgccacatgctctctcccaaacactgctttcagtgcaaggtagtgggcctaaggggtttggttgtcttttttttttttcatttttaaaattttaaatttttatttattattattttttagagacaaggcctcactctatcgcctaggctgaagcacagtggtgcgatcacagctcgctacagccttgacctcctaggatcaagccatcctcctgcctcagcatccacagtagctgatgtgcaccaccagacccgtctcattttttctatttttattattttagagatggggatctcactgtgttggccaggctggtctcaaactcctgggctcaagcaatcctcccaccttggcctcaaagtattgagattacaggcatgagccactgcacccggcctttctcatttttatttttaaattgacagacgtaacagtgcgcatttatcacgcacaacacaatgctttgggaatggttaaatctagctcacaaatgcattacctcacacggttgtcatttttgtggtgaggcttggttgtatgttttgtttcattcatgtttttacatccttggagtctcctctgggtccgtcctttctttgctgtcatgctggcttgcctaaggcccaccgccacctgcgtacgagcattttaaactctagagtgagtgacagcctttttatggttggtgttactatttatttcctgcctctaaacttctcgtggtccttataaacttgtcaggatgtgtgttgcgttgaattctgcatgtcctttttttgcccaccctcaggttaagctggtactaacttatccccagaggaaacagggtttatgagcactgacagatgtcttccctgggcaaaaaaaaaaaaaatagtatatgtatacacacacacatacacatttatatttatatttcttaaagcttttaatccctttcattccctgatatctcagagatttcaaatcattgaacactgaagtatatttttcaggccagatgaaaaattgtattaaaaccctattcctggtcaggcgcagtggctcacgcctataatcccagcactttgggaggccgaagtaagcagatcacctgaggtcgggagttcaagacaaacctggccaacatggtgaaaccctgtctctactaaaactacaaaaaaattagcctgatgtggtgttgtgtgcctgtagtcccagctacttaggaggctgaggtaggagaattgcttgaacctgggaggcggaggttgcagtgagccaaaattacgccactgcactccagcctgggcaacagagcgagacagtctcaaaaacaacaacaacaacaaaaaccctattccttgcctttgtaggagtcaaaataaatgaacttcttttttcttttttttattattatactttaagttctggggtacacgtgcagaatgtgcaggtttgttacataggtatgcacgtgccatggtggtttgctgcacccatcaacctgtcacctacattaggtatttcccctaatgttatccctcccctagccctccatcccctgacaggccctggtgtgtgatgttcccctccctatgtccatgtgttctcattgctccaaaataaatgaatttacac

SEQ ID NO: 7495 - DNA, 481 bp, Homo sapiens
gtctctgggcggctgctgccgctgccgctgctgctgctgcgggggtcgggcggcggccaggggatttgggcaggcaccgtggatccccgagaaggggacgagttgacagatgtgcgtgaggaggtctctggtcggcctcaccttttgtacctgctacctggcttcttacctcacgaacaagtatgtgctgtctgtcttgaaatttacctaccctacattattccaaggatctcatgttcttgtgtggcttcctgcttcagtgctgtttgtgggtataatctatgctgggtccagagcattgtccagactggccattcctgtgtttctcactttgcataatgtagctgaagttatcatctgtgggtaccagaagtgttttcagaaagagaaaacatctcctgcaaagatctgtaggttgcaccttgaaagaacaagacaaaaccaaacttcaagactatcctcctgtttaaaaggagactag

SEQ ID NO: 7496 - DNA, 1404 bp, Homo sapiens
gctgctgctgcgggggtcgggcggcggccaggggatttgggcaggcaccgtggatccccgagaaggggacgagttgacagatgtgcgtgaggaggtctctggtcggcctcaccttttgtacctgctacctggcttcttacctcacgaacaagtatgtgctgtctgtcttgaaatttacctaccctacattattccaagggtggcagacgctcattggtggacttttgcttcatgtgtcctggaaactgggctgggtagagatcaacagcagttcaaggccattcctgtgtttctcactttgcataatgtagctgaagttatcatctgtgggtaccagaagtgttttcagaaagagaaaacatctcctgcaaagatctgtaggttgcaccttgaaagaacaagacaaaaccaaacttcaagactatcctcctgtttaaaaggagactagcaggtgtcaaagagaggcggtaaagctcatgatacctgatgtaatcagtgccctcctcctcctggccgcagcaggatgccttcccttcaatgactcccagtttaatccagatggatatttttgggctataattcacttactctgtgtaggggcttataaaattctacagaagtcccagaaacccagtgcattaagtgacattgaccagcaatacttaaactatatattcagtgtggtgctcctggcatttgcatctcatcccacaggtgatctcttcagcgtcctggacttcccattcctgtacttctacagattccatggtagctgctgtgccagtggatttttgggattctttctcatgttcagtacagtgaagctaaaaaaccttctggccccagggcagtgtgcagcctggattttctttgctaagataatcacagctggcttatcaatattgctgtttgatgcgatcctgaccagtgcaaccacgggatgacagaggaccagagggatggcacggagagtaggctccacacacagagagacattttctctttcaccagtgtacccaaggcaggatggcagtgcccagcacacagtaggtgctcaccaggctgcagagacggggtttcaccacgctgcccaggctggtcttgaacttctgagctcaagcgatccacttgcctcagcctcccaaagttatcggattacaggcatgagccaccatgcctggtccaaaacaatgcatgttaaaaacttagagcctggcacccagcaaacaatcaaggcatctattaccatcttatcatccttgtaactttatcatctcttctggaaatatgctccaacccagaagaatctacttcttagtctaaactttctgcgaccgtgttcctaaaatccagtgttcttttccagctatgaagtccacaacatgacctccctccaggtcctga

SEQ ID NO: 7497 - DNA, 829 bp, Homo sapiens
gatgtgcgtgaggaggtctctggtcggcctcaccttttgtacctgctacctggcttcttacctcacgaacaagtatgtgctgtctgtcttgaaatttacctaccctacattattccaagggtggcagacgctcattggtggacttttgcttcatgtgtcctggaaactgggctgggtagagatcaacagcagttcaagatctcatgttcttgtgtggcttcctgcttcagtgctgtttgtgggtataatctatgctgggtccagagcattgtccagactggccattcctgtgtttctcactttgcataatgtagctgaagttatcatctgtgggtaccagaagtgttttcagaaagagaaaacatctcctgcaaagatctgtagtgccctcctcctcctggccgcagcaggatgccttcccttcaatgactcccagtttaatccagatggatatttttgggctataattcacttactctgtgtagtgacattgaccagcaatacttaaactatatattcagtgtggtgctcctggcatttgcatctcatcccacaggtgatctcttcagcgtcctggacttcccattcctgtacttctacagattccatggtagctgctgtgccagtggatttttgggattctttctcatgttcagtacagtgaagctaaaaaaccttctggccccagggcagtgtgcagcctggattttctttgctaagataatcacagctggcttatcaatattgctgtttgatgcgatcctgaccagtgcaaccacgggatgcctcctgctcggtgcgcttggagaggccttgctggttttctcag

SEQ ID NO: 7498 - DNA, 944 bp, Homo sapiens
agattgcacaggaggaggcggtagcggaacctttctcctccgcctggttctcgcttccacccgggcccagttggggacggacgcactagaggcgacctaaacatggagacagcgggcgctgcaactgggcagccggcctctgggctggaggctccggggtccacgaatgaccggcttttcctggttaaaggtggaattttccttggtaccgttgctgcagcgggaatgctagctggatttattacaacattatcattggctaaaaagaaaagccctgaatggttcaataagggaagtatggccacggctgcattaccggaaagcgggtcttcccttgccttgcgagctctgggctggggctccctgtatgcatggtgtggggttggtgtgattagcttcgcagtctggaaagctttaggagttcacagtgtaagtaactactgtcttgtccctggtatctacatgtttattctgcttactgtgttctaaatttttctggttttcaaatttatttgcatgtagtttggtcactgtctagggagatgatgacagagtacgtgactaaattcttacaaataactagacaacttcttattactaataaatacaatttttgaaggtggtaaaacttcaaatataattaagtaatgactaatttatagctaatgttctatataaattgacattagggcgagtgcagtgggttatgcctgtaatcccagcaccttgggagcctgcggcaggcaaatcacttgagctctgaagtccaaaaccagcctgggcaatgtaaagaaaccctgtctctataaaaaaattagctgggtgtggtggcatgcgcctatagtcctagctactcagaaggctgagggaggaggatcacctgagcctcacaggctgaggctgcagtgtgccaagatcattgcgcttcagccttggcagcgggg

SEQ ID NO: 7499 - DNA, 1799 bp, Homo sapiens
agattgcacaggaggaggcggtagcggaacctttctcctccgcctggttctcgcttccacccgggcccagttggggacggacgcactagaggcgacctaaacatggagacagcgggcgctgcaactgggcagccggcctctgggctggaggctccggggtccacgaatgaccggcttttcctggttaaaggtggaattttccttggtaccgttgctgcagcgggaatgctagctggatttattacaacattatcattggctaaaaagaaaagccctgaatggttcaataagggaagtatggccacggctgcattaccggaaagcgggtcttcccttgccttgcgagctctgggctggggctccctgtatgcatggtgtggggttggtgtgattagcttcgcagtctggaaagctttaggagttcacagtatgaacgactttcgaagtaaaatgcaatcaatatttccaacaattcccaagaactccgaatcggctgttgagtgggaggaaacattgaaatccaaatgagatgagcatggatgaatttcaaaatgcttgttacagaaaggggtggctctggagacaccatgacagcaaaaggactgggactgatttctcccaggaacatgggcagattgctgactgaaccagtgcactggatagcattcagcctcatcacaggagagtatgtgtgtgcgtgctgggggagggtaaagttttcccacagttaagaagactatttaaaaatagtaattacaggaataacttccttatgtggaggggaccccataggaaatgattctgtttgtaacagttgaagcaaatttcatactaaaaaagtttataataaaagtatgataagaaaatatttataaaacagaccccctaatagcaatagtactgcaatgtgtctaattaaaggagtttcaagagcctttcttgtcaatatatgacagaacttggaagtcttattctgattagccagactacaaagtgacagtcacctggtaagtcctgtatggtaggaagtgggtgtggctctcgggtcctaaatgtggtctgtgctttacagccatcacacacatgctagttatttacctgatgcccttgcttgaaggccctataaattcttatacttaaaacaaaaagccagtaatgagttgtgatcaccccaaaaggcacagttgggctaaaataatgatgatatcaggggtaaacatatttttttgagaagttggtctggatctctgaacactgacaatttgtcattttgtctcagttgtcaaagtaaaaaaagcccagttgtcatccgtcttcaatatttttaaccagaaagtcacctgagtacggagtcccaatataaagtatttgggaccacctccctaacaaagctgttagggtaaattctgtgtgcacgcccaactccctcctgtcttccacagtctcctacaaaaaaaacagatggagaataatgtctacatgcaattgtttttactgcaattgtattttaaaatattttcaagaagagaaatactttaatatgtcaatatgtccagagaaaaaacctgtagttaaatatcagttgtgcaatttcttcctacttgcctaggctctaattagtcagcaatcaggtttaataaaggacatttgaaatttctgttatcatgaaaccttttattctaagggagatttttaaatgaaatgacaagaacttaatgtaatacttttctctagaccatgttaccctgttaaaattgctgtattgttaatgaaacaggtgtaatcagcatctggaattc

SEQ ID NO: 7500 - DNA, 725 bp, Homo sapiens
cgaggtaggagtgccgctgtgggcagtgggcggcggcagcggacgagcggccaggctgaccacctctgcctgactcagatgcctaagggccgggccggcagcctgcccacgacctccatcggctggcgcttccagctctggttcctaggactcacctgcccggagcgccacctggccagacgcctcaagaacaatagcttctacccatttgtgcagcaggagccaaacggtgcagaagcaagagacctgggtcttcctcgtgtacggcgtgggcgtgggcctgtggctcgtgatctcgtcgctgccgcggcgccgcctggtgctgaaccacacgcgcggcgtgtaccacttctccatccagggccgcaccgtgtgccagggccccttgcatctggtctacgtgcgcctggcgctcagctccgatgcccacggaaggtgcttcttccacctggtcctcggcggccacaggttggagcccctggtgctggtgcagctgtcggagcactacgagcaaatggaatacttgggccgttacatcgcccggaaactcaacatcaactacttcgactacctggccacctcctaccggcacgtggttcgccactggccaccccctggcgctggcactgtgatgggcaagagccccatgggtcacaagcccagctcctctcagtccagcctggaggtgtgactctgagggcctcccccacctcgggactgtgttc

SEQ ID NO: 7501 - DNA, 1041 bp, Homo sapiens
acagaggcccgggggcggggataccggacagggatggagactggccccgagattgggagggggatgggcagcgctggagaataacgccctggagacagggcagcgcagccccagactccctggaaaacccagcagtctggaaaagctgggtttggactcacccctctttgaagagttctcaggaagtttgggggaggggcgagccgcgcaccagttctaccggcatcgggcgctgagggtgagaagggaccacaagcagcagcaggtctcagtgcttgtcatattcctgctcaccggtgggctccgggcacgcccggcagggtcctgggggcgcaggcaaggggacgtaggcagagtgctccggccagcatggagggactggtcttccttaacgccctggccactcggttgctgttcctgctgcactcgctggtcggggtctggcgagtgaccgaggtgaagaaggagccgcggtactggctgcttgcgctgctcaacctcttgctcttcctggagactgcgctcaccctcaagttcaagcgcggcagaggctacaaatggttttcaccagccatatttttatatctgattagcatcgttccatcattatggcttcttgaattgcaccatgagacccagtattgcagtatccaggctgaaggaacatcacagaataccagcagaaaagaagacttcaatcaaacattgacatccaatgaacaaaccagtagagctgatgatctcattgagacggccaaagtttttgtgaataacttatctacagtatgtgagaaagtttggacattgggactccatcagacattcctgttaatgctaataattggaagatggcttctacccattggaggcgggatcactcgagatcaactctctcaacttcttcttatgtttgtggggacagcggctgacatactggaattcacaagtgagaccctagaagaacaaaatgtgaggctctgttggaaaaattccactaatagaagacatactaaccccaagtggcaacttgttctattttga

SEQ ID NO: 7502 - DNA, 5151 bp, Homo sapiens
acagaggcccgggggcggggataccggacagggatggagactggccccgagattgggagggggatgggcagcgctggagaataacgccctggagacagggcagcgcagccccagactccctggaaaacccagcagtctggaaaagctgggtttggactcacccctctttgaagagttctcaggaagtttgggggaggggcgagccgcgcaccagttctaccggcatcgggcgctgagggtgagaagggaccacaagcagcagcaggtctcagtgcttgtcatattcctgctcaccggtgggctccgggcacgcccggcagggtcctgggggcgcaggcaaggggacgtaggcagagtgctccggccagcatggagggactggtcttccttaacgccctggccactcggttgctgttcctgctgcactcgctggtcggggtctggcgagtgaccgaggtgaagaaggagccgcggtactggctgcttgcgctgctcaacctcttgctcttcctggagactgcgctcaccctcaagttcaagcgcggcagaggctacaaatggttttcaccagccatatttttatatctgattagcatcgttccatcattatggcttcttgaattgcaccatgagacccagtattgcagtatccaggctgaaggaacatcacagaataccagcagaaaagaagacttcaatcaaacattgacatccaatgaacaaaccagtagagctgatgatctcattgagacggccaaagtttttgtgaataacttatctacagtatgtgagaaagtttggacattgggactccatcagacattcctgttaatgctaataattggaagatggcttctacccattggaggcgggatcactcgagatcaactctctcaacttcttcttatgtttgtggggacagcggctgacatactggaattcacaagtgagaccctagaagaacaaaatgtgaggaatagtcctgcactagtctatgccatccttgttatatggacttggagcatgctgcagtttccacttgacctggcagtacagaacgttgtgtgccctgtgtctgtgacagagaggggattccccagcctgttcttttgccagtacagtgccgatctgtggaacatcggaatcagcgtcttcatacaagatggccccttccttgtcgtgcgtctcatactgatgacctatttcaaagtgatcaatcagatgctggtgttctttgccgcgaagaacttcctcgtggtggtgttgcaactctaccgcttggtggtgctggcattggcagtccgtgcttcgttgagaagtcagtcagaaggcctgaaaggagaacatggttgccgggcacagacctctgagagtgggccctctcagcgggactggcagaacgagtctaaggagggcctggctattcctttgcggggctccccagtcacctccgacgactcccaccacaccccttagttattgattgacagtggtctgcggctagaacctgactccctggttcttcttacagggaggatcctttttctcctccaaccttggcgtataataattttcaaaagaacaacataaaaaggtgatcttaaaccaaagctgaggaattttcttttttcaactgaatagaaggaactttgattagtgactattgctacaacttctgtgtgatggtatcagatgttatagttgttcaacgactaagtgatttgtttgtcttgaactgtttgaaaagctatggaagaggttacagtgacatgccctcgaaagatttggtgcagaccaactgtcgcggctgttacctggaaatagagaagctttgaactttgcctccattgtcagactatttcgtctgatcttttctgcaatgttcctctgacatcaaaaaatgtacattcagtgaatgcagaacaaatgaagggaaaagtgcctttaaaattacctcactgtgggctggaagaagcgaaaatctctgcccagcttccgtatcatagagagccctattcatcgctgcccaggccttcccaggaaaatcattttttctgggctgatgttgtattctgccatggcgcatatgttcttacagaaattttattgcttttgtcttgggtgctacaaaattcacagcaagccattttggttacatatctactggttgcaaggcaggaaatattggtgaaatgctagcaaagtcacaatttctactctgaacatgatttgcagtgttcatcagtatttttctgaaccctgctttaccattttctatattgccaagttgaatcatgtgggctgatgcagggaagctctgaagcagtgaataaaggtgtttcgggccctgtaagtgtttccatggtttctggtgtctgccagcagtagtgaacaaagctgcagcttctttgaaccgcgactactggaagtggcctttgctctcagggaacatggtgatggagggttgcatcagctccacccatggccaacagcccttgttgagtgacgggagtcggaatgtgctaccccgttgtgggaatcaggcaattcgctttattttcttgcattaagacttcattttcccagtattgaaatagccatacttttcctttacatacctctatactttccagatggaggtgattcagaaccttttaaagtgatttttgcctttaaagatacagtgtgaaaatttgctcgggtgtgtagcagtaattacacgaggcaaacagttccaaaactgttcttttaggttcaaaacctaattcccccagattagtatactcgagaattcaaagggacatttaaggtggggtatgcccttaatttggtatgacttattgacaaccagttgggacaattttatctgtaactctctgggtgacatgatacctattcgaaacattttatacaaacttttatagacaaattgtgtttttatacagagtcatgcatattttctcataaatggcttcttcagtgccattgttatatgttttttatttctttcttccttgtgcttctaattttaacaatataatgactataaaatgacacatggaactaatggaatacatttatgattttccataataattttatgaaagttaagatcaagaaattatatttatatgaagtaaatcacttgacaacttttaagggcatgttatttgaagtgctcagcagttgaaagcaaaataataactgctatttataaaaatgcctcagcagaatctgtttttatgttgactgctttatgttgaatattttcttccacaacatgtatgtgctgcttattattgcagatttgctcatggcatacttttcatgttttaatttttttcttccagcaaaataaacactgaggccctaaaaatagataaagtataaagtagtacggctgttgcaaggatatttttaaatgctttcaaatctgagacttggcttggcttcgtgaatgagtttctagtgtttaaattaaagtattttgtaattagactcctcgtgggcttgagaaataaaaagcctgtccaaagtctagctttatttagagggtcaggaagtcaaagagcacccaggaccatcttggcaattaatagcggcaaaaatagacccagcttctgcaaggttttccaggaaaatctgcttggggcagcatttgttaacctagctgccagtactcctactctcttatactggctgcttttataataggaaaaaaaaatatgcatttgcttagtttatttgaataaaagctctaaacctaggttatatattagccattcctaagactcctgattaaatattacaaatttgttcagttcatagcgtagactgctaaatactgtaatgtttcaaaacatccaactgtttgttataaagtggctagaacatcaattacctcccatgtgtggacatcctgggacttgtttacattttatctgtaataagataactgactcacaacacctgtataatgtgatgcaagtcatcctctctatcataacccctccccccaacacacagtaggtcactccccaacccctgaagaaagtggcttatttgaggttgttggtgctgttggtattattgccatagttgttatttaattgcttgattaaactcagtcaaatatccttcctaaaaacatgtcattccacttgtgaaagaaaacacaatgtgcatgtttcaatgatactgtgcggaaacacacctcatgatcatcttgtgggtttcttttgcccttactggatgactctcagaggacatgacttgacatagtaacattagtaaactgtctttatctttgattattcttttaatttttatttgagctgtttcaatagcataatgaaataaaattttgaattggccaataacatgctttataatcttccagtgaagagtctgatacaaatttactcttggcactgttgtagttccactaacaaatagcacttcagaccttatagaaccatatagatatggccaaggaatagcaggattcactattataatactaattgttaactcattatttaattgaacatttccaaagctctggaaaggcatgcatttgtaggtgcacatgctttaagatttctatccatctttcagagttgaatgtaataatgtttggtatttaattcttgataattcttaaccaacttttcctgttacaggagagaaagaattgcaaatgccaggcatctgtccactttagccctcctccaatgctaagaaagagggatggtgacgtatactacagagacgcaaatgaaacaccaaacagtcttgaattacaagaaaaaaaggggattttttttttttctaatttcagacttggctttttacttagaggacattctgatttgctctcagaaacatctgatttggggttaaactaggcggctggaggatgtttacagctttgaggcttcaaataagtttccatatgcagggagtaactttaaacaatgtttgaataattaactgctaagtcttatattttatgtgtatctatttcatcctctgtctctttcttactagaataccatataagaatattttctctgcagtatttatatttatactattttgctatgagtggcctttgtattttattatatgcattaaatagtgtgtgcacaa

SEQ ID NO: 7503 - DNA, 2610 bp, Homo sapiens
agttctaccggcatcgggcgctgagggtgagaagggaccacaagcagcagcaggtctcagtgcttgtcatattcctgctcaccggtgggctccgggcacgcccggcagggtcctgggggcgcaggcaaggggacgtaggcagagtgctccggccagcatggagggactggtcttccttaacgccctggccactcggttgctgttcctgctgcactcgctggtcggggtctggcgagtgaccgaggtgaagaaggagccgcggtactggctgcttgcgctgctcaacctcttgctcttcctggagactgcgctcaccctcaagttcaagcgcggcagaggctacaaatggttttcaccagccatatttttatatctgattagcatcgttccatcattatggcttcttgaattgcaccatgagacccagtattgcagtatccaggctgaaggaacatcacagaataccagcagaaaagaagacttcaatcaaacattgacatccaatgaacaaaccagtagagctgatgatctcattgagacggccaaagtttttgtgaataacttatctacagtatgtgagaaagtttggacattgggactccatcagacattcctgttaatgctaataattggaagatggcttctacccattggaggcgggatcactcgagatcaactctctcaacttcttcttatgtttgtggggacagcggctgacatactggaattcacaagtgagaccctagaagaacaaaatgtgaggaatagtcctgcactagtctatgccatccttgttatatggacttggagcatgctgcagtttccacttgacctggcagtacagaacgttgtgtgccctgtgtctgtgacagagaggggattccccagcctgttcttttgccagtacagtgccgatctgtggaacatcggaatcagcgtcttcatacaagatggccccttccttgtcgtgcgtctcatactgatgacctatttcaaagtgatcaatcagatgctggtgttctttgccgcgaagaacttcctcgtggtggtgttgcaactctaccgcttggtggtgctggcattggcagtccgtgcttcgttgagaagtcagtcagaaggcctgaaaggagaacatggttgccgggcacagacctctgagagtgggccctctcagcgggactggcagaacgagtctaaggagggcctggctattcctttgcggggctccccagtcacctccgacgactcccaccacaccccttagttattgattgacagtggtctgcggctagaacctgactccctggttcttcttacagggaggatcctttttctcctccaaccttggcgtataataattttcaaaagaacaacataaaaaggtgatcttaaaccaaagctgaggaattttcttttttcaactgaatagaaggaactttgattagtgactattgctacaacttctgtgtgatggtatcagatgttatagttgttcaacgactaagtgatttgtttgtcttgaactgtttgaaaagctatggaagaggttacagtgacatgccctcgaaagatttggtgcagaccaactgtcgcggctgttacctggaaatagagaagctttgaactttgcctccattgtcagactatttcgtctgatcttttctgcaatgttcctctgacatcaaaaaatgtacattcagtgaatgcagaacaaatgaagggaaaagtgcctttaaaattacctcactgtgggctggaagaagcgaaaatctctgcccagcttccgtatcatagagagccctattcatcgctgcccaggccttcccaggaaaatcattttttctgggctgatgttgtattctgccatggcgcatatgttcttacagaaattttattgcttttgtcttgggtgctacaaaattcacagcaagccattttggttacatatctactggttgcaaggcaggaaatattggtgaaatgctagcaaagtcacaatttctactctgaacatgatttgcagtgttcatcagtatttttctgaaccctgctttaccattttctatattgccaagttgaatcatgtgggctgatgcagggaagctctgaagcagtgaataaaggtgtttcgggccctgagagaaagaattgcaaatgccaggcatctgtccactttagccctcctccaatgctaagaaagagggatggtgacgtatactacagagacgcaaatgaaacaccaaacagtcttgaattacaagaaaaaaaggggattttttttttttctaatttcagacttggctttttacttagaggacattctgatttgctctcagaaacatctgatttggggttaaactaggcggctggaggatgtttacagctttgaggcttcaaataagtttccatatgcagggagtaactttaaacaatgtttgaataattaactgctaagtcttatattttatgtgtatctatttcatcctctgtctctttcttactagaataccatataagaatattttctctgcagtatttatatttatactattttgctatgagtggcctttgtattttattatatgcattaaatagtgtgtgcacaacttt

SEQ ID NO: 7504 - DNA, 728 bp, Homo sapiens
aggcagttgcgggttgcaggagttcaggaaaggaggtgggactagagtcaacctggaatagctctacagtaacaatggcagcctttttgttgctgggacatccatacaggcaacttagctggtgaaaggactctggattggttggcagtctgcttttttttttccaaggtgatcactttactgtagaagaaatgaggttaacagaaaagagtgagggagaacaacaactcaagcccaacaactctaatgcacccaatgaagatcaagaagaagaaatccaacagtcagaacagcatactccagcaaggcagcgaacacaaagagcagacacacagccatccagatgtcgattgccttcacgtaggacacctacaacatccagcgacagaacgatcaaccttcttgaagtccttccgtggcctactgagtggattttcaacccctatcgattgcctgctctttttgagctttatcctgaatttcttctggtgtttaaagaagccttccatgacatatcccattgtctgaaagcccagatggaaaagatcggactgcccatcatactccacctcttcgcactctccaccctctacttctacaagtttttccttcctacaattctttccctttctttctttattcttcttgtacttctgcttctgctttttattattgtcttcattctgatcttcttctgattcttttgtttcaataaacagcaatgagca

SEQ ID NO: 7505 - DNA, 6743 bp, Homo sapiens
aataacctggagccggcggcgtaggttggctctttagggcttcaccccgaagctccaccttcgctcccgtctttctggaaacaccgctttgatctcggcggtgcgggacaggtacctcccggctgctgcgggtgccctggatccagtcggctgcaccaggcgagcgagacccttccctggtggaggctcagagttccggcagggtgcatccggcctgtgtgtggcgcgaggcagggaagccggtacccgggtcctggccccagcgctgacgttttctctcccctttcttctctcttcgcggttgcggcgtcgcagacgctagtgtgagcccccatggcagatacgaccccgaacggcccccaaggggcgggcgctgtgcaattcatgatgaccaataaactggacacggcaatgtggctttctcgcttgttcacagtttactgctctgctctgtttgttctgcctcttcttgggttgcatgaagcagcaagcttttaccaacgtgctttgctggcaaatgctcttaccagtgctctgaggctgcatcaaagattaccacacttccagttaagcagagcattcctggcccaggctttgttagaggacagctgccactacctgttgtattcactcatctttgtaaattcctatccagttacaatgagtatcttcccagtcttgttattctctttgcttcatgctgccacatatacgaaaaaggtccttgacgcaaggggctcaaatagtttacctctgctgagatctgtcttggacaaattaagtgctaatcaacaaaatattctgaaattcattgcttgcaatgaaatattcctgatgcctgcgacagtttttatgctttttagtggtcaaggaagtttgctccaaccttttatatactatagatttcttacccttcgatattcgtctcgaagaaacccatattgtcggaccttatttaatgaactgaggattgttgttgaacacataataatgaaacctgcttgcccactgtttgtgagaagactttgtctccagagcattgcctttataagcagattggcaccaacagttccatagtttaacatctagttaagctacaaatatagtataagcattattagcagctggtacttctgctaggggttgtaaattccaggtgttacactgacctcaatccaatttacataatttacataaatgcatctcggtggaaaaataatcattttcttggcatgttaaatcaagcttaaaaagttttgagaaaattttactgcgctgtgttgctaatggttaaagaagtctgtatctagtgataaatataccagtttttttaaaaagatgctgttgtgcctatatcatgaagtacattaatttctcatgtaaaaaaaatagctctaaaatttgtttcaacctaattggtaacctgagtttatatctggcatgaattcattatggtgatacacatatgtgaattcagtacattttgagacagtattctaccattcagtaattttggttaatgattttaacacttctcagtgtatttaatttcaaattgtttttttaattggttttatgctgctttgttaggacagatgtgttttgaatgtaccattataagaagaattctatgtatcttaaactatgatcttctaaaattttatttccgtaagtacttctgtggccttgagtattttttaaaaggctcaactgtaagcctcttagccagttggataaatatttggggtcacctagccattgaaagcagaaagcagtagtgacacagctttcccttcaaagagccattgagaaacatttctcaaacaggaaatccttcttttactaatgtggacatatagattattcgtattatagtttgtagaactacctagttcagaatcttgactgccagttttcttggtttcttaggcttgaattttcatagacaattgcaacagtttagatgccttttgaaaggaatgtaatgaagattcagcatctgactatatgtgtgtctatcctgaaataataatggagagtatactgtagattacatgtttacccatcaaatctgacttaaaaggttaaatggaaggttttataggtaaggtaattgattgggaatggggtagggggaggagttgtgggggaataatgtgcatttcagtctcaacgcatagataaatttaggggaattggatgtattattcaactttgatttgggttgtaaaatgtgttaaatcctgttcattgaactcccatcaactcttataaaattcatgctgatcttcattaccgttgcatgattggaaatgtttaaaacattgtacagttttagtatagagaaatgtaatggtttttgtgaccagtttctgtctgcatgtaatttggatttctcaaatacattcattagtaatttatcagtaacattagttttatttttgttcatctccttatctataaaaaggggatattcttaggataaatacatgaaaaattatacttgatagcttaactataatcagctatttttgtatttttgtaatatttgtccactaagctggagaagcagcctcatacagttgattttgtgtatgtggctagtcttattgtcactatgtaagtaatccaatggttttagaaactaaactttctagagcaataaaatgactataatgttaagtaaacataatgttgatttctaattatgttttaaaaaatgaagtcttgaattatatcaagaaattttggcagctgaagtcatgtttattttgaagctgttagttttttcctataatttaaaaagatcttttagatttatagaagagtcagaaatgtacaagagagtttttttgttgttgtttttgttttttgagacagagtctgtctctgtcgccaaggctggagtgcagtggcgcaatcctggctcactgtagcctctgcctcctgggttcaagtgcttctcctgcctcagcctcccgagtagctgggactacaggtgcacgccaccacgcctgtagtcccagctgtattgtaaaaatacaaaattttagtatttttagtagagacagggtttcaccatgttggccaggatggtctcgatctcctgacctcgtgatctgcctgcctcggcctcccaaagtgccgggattacaggtgtgagccaccgcgccctgccaagaagagttcttttgcataccctttactcaggtcctctcatgttaacgttttacataactgtagaacatttatctaaagtaagatattagcccagaacaatactactaactgaagtataaaacttatttgaatttcaacagtttttttttcatttcttattttccttttgtgtgctctgtttataccatgatccatgatttttttaaaatcatgattgtcttttaaagatctgtgtgtctctgttttgagtttttcctgtttattttgaaaagtactgttggtcaagataattggtcaataatccatgttggttttaacaaaaagcattttaacattaaaaatattacagtataaaataacactctgtgctttaaattgaggttttatgtcattttagcagaattataatatttctgatatactcatgtttgacaagttgaaacagatttgtttcttaaaggaaggtttaatatacaaaaaaaggtaatcttaaacttacgaaaaagtaaattttacaatttgagcattactagatgtttagtttgcatgaactcatagttagaaattctgcaataggaatatctacaaccggctgatttggaatttgaaattatagtgttacatgtatacctatcaaattaaaattaaggaaatacaatagcaatatatagaatgaatgtagtaacagaaattaactctttactgcatcattgaacttattgttagttacaggtttaaaagaagttcatttaacatccagtgtgtctaattcttctggaagtggtgtagtaccattgttcttctggcatttttaaatattaaacctttttggatagatggaagccttatacaaaatctactttattttagcaaggattctctgtccttttgtatagttggtaccttactaatttaaactctaatatcaatctaaagagaaatttattatgcaatttgtatttaggtttttttttttttttttggaatgaagttcagaggtagatcctcctggaagaaagaaagcaagcgaactttttaaagaaaattagacttgaatatttaagaatgtcccttacagagaaaaggccaactataatactaagctaaaagttatgaaaaattaataggttcttttatagagctaagaatgatgaaaccatcaatacttccttcttcctaaaaatccagatcaaaacttcaggttaggtttctaagtttaggacatgaatattatttttttctggaaaagaagatgagtatatgtgtaataagacaagtagaactgagagatttagttttttttttttttaagttttagttcagaataacattaattttgagagattgaggtaaagaaccttaactaatgctaaggagtttattttgattaacataggttattctgaccaccacctcttccttccttaatctccttagaatctgacagtctcaaagctgtcacacaaattagactaattttgacactttgaaatgaaaacttcaaggaagaagtagccacggacagttatgtttataatcagtaggtggcactctttcctcaggtagccccccattttcacatgatgtgtttgaaggttaaatgccaccaaaagtgctgagtcagctataaaactaagtccctgaattccatggcccttttaaatatgtaatcattcaagattgaaaaaaaaaattaagcattttttgtttgtttgcttgtttgtttttgagacggagtttcactcttgttggccaggctggagtgcaatggcgccatctcagctcactgcaacctctgcctcccggattcaagcaattctccttcagccctccaagtagctggggttacaggtgcccgccaccatgcccagctaatttttgtatttttagtagagacaggatttcaccatgttcaccatgttggtcaggctggtcttgaactcctggcctcaagtgatctgcccgcctcgacctcccagagtgctgggattataggtgtgagccactaagcctggctgagacaactagtttcccttaactcattggaattctctaggattaggagaattccacagagcctatatgatattatagctcaacatttagtataccaaaggcatacccgtgtaaatctaggagttatttccagagattgttttaaggagcagtcttatattcagggtagaaagttatgattggatctgctgttaaggagaacaaaggagcttctaaaggtttgggaggtttactggtagtaactattctaggaaatatttatgttttaaggtgatgttcacatgggttctttagaaggaacatagtcaagtgtgatggattaactctatatagtctttctcctcttgtgcgtgtaggaaatctgacctgcagtgtcagttgatgtgacaagagataaagaaagcacagtattttaaaatctaaagcagattcctttcttagaaaacaataggaaaaaattatagatggatgtctttgctgaaatctaacaattagctcatattccatgagaaagagtggcctaagaattatttcatgttacctagccttctgaagctactcacttgatgtgcctagcactttgaaactaaccttttctttctttgttcatgacagtttaattccaaatatttactattttctcttgtaactgttagaacagttccttttgacattaatttttgcctacatatatatttttaagttgagaccaaatcggtgaagtgttgagcaagtaacatttatgatgtgtgtatattggaacaaatgtaaaagggttacaaagattagaaacagagtcataaaaaatggcttgatttataaaggcattacttttggtgctttatataatggcatatattgaactaaaaatttgtatatacagtatgtcagcatttcttagtaacttctcttgaatccatttttaatatctaatattgtacaggttggggagttacattcttcaggccaatactatccagactatataaatttataaaataaattgaaaaattcattcccctgtattcaagaccaaagcacataaatgctaatgtagggctcagaggggaaatacagttctcctgcatatttgagaaaatgtgaagtcctttcaagaaaatctaataaacataataatcatagcctgctgacactaaggaaaaaggacctcattcactctttcttttatgcagtgatttactggtccctactgatttccaaattggatcacgatagtaaattatccatgctggtacctgtgaaagtaagccctgggatccatatttgttttgtgttctgcttaaatcagcaagaatgataaatttgatggtgtgaaattggaagtatcaagggctttctttggtgattgagggaaataatgtctctacttgtaatttattgtgaccctttttcactgtatatgctttgtatgtctaatatttatttcaatgcaaattcaattgttccttcatctgtattgttatatctaagattttattgatgttaaaatctaattgtggaataaaaatctctctggaatttagcag

SEQ ID NO: 7506 - DNA, 7482 bp, Homo sapiens
acggaaatgaaaggagcacttccgggttcggcaataacctggagccggcggcgtaggttggctctttagggcttcaccccgaagctccaccttcgctcccgtctttctggaaacaccgctttgatctcggcggtgcgggacaggtacctcccggctgctgcgggtgccctggatccagtcggctgcaccaggcgagcgagacccttccctggtggaggctcagagttccggcagggtgcatccggcctgtgtgtggcgcgaggcagggaagccggtacccgggtcctggccccagcgctgacgttttctctcccctttcttctctcttcgcggttgcggcgtcgcagacgctagtgtgagcccccatggcagatacgaccccgaacggcccccaaggggcgggcgctgtgcaattcatgatgaccaataaactggacacggcaatgtggctttctcgcttgttcacagtttactgctctgctctgtttgttctgcctcttcttgggttgcatgaagcagcaagcttttaccaacgtgctttgctggcaaatgctcttaccagtgctctgaggctgcatcaaagattaccacacttccagttaagcagagcattcctggcccaggctttgttagaggacagctgccactacctgttgtattcactcatctttgtaaattcctatccagttacaatgagtatcttcccagtcttgttattctctttgcttcatgctgccacatatacgaaaaaggtccttgacgcaaggggctcaaatagtttacctctgctgagatctgtcttggacaaattaagtgctaatcaacaaaatattctgaaattcattgcttgcaatgaaatattcctgatgcctgcgacagtttttatgctttttagtggtcaaggaagtttgctccaaccttttatatactatagatttcttacccttcgatattcgtctcgaagaaacccatattgtcggaccttatttaatgaactgaggattgttgttgaacacataataatgaaacctgcttgcccactgtttgtgagaagactttgtctccagagcattgcctttataagcagattggcaccaacagttccatagtttaacatctagttaagctacaaatatagtataagcattattagcagctggtacttctgctaggggttgtaaattccaggtgttacactgacctcaatccaatttacataatttacataaatgcatctcggtggaaaaataatcattttcttggcatgttaaatcaagcttaaaaagttttgagaaaattttactgcgctgtgttgctaatggttaaagaagtctgtatctagtgataaatataccagtttttttaaaaagatgctgttgtgcctatatcatgaagtacattaatttctcatgtaaaaaaaatagctctaaaatttgtttcaacctaattggtaacctgagtttatatctggcatgaattcattatggtgatacacatatgtgaattcagtacattttgagacagtattctaccattcagtaattttggttaatgattttaacacttctcagtgtatttaatttcaaattgtttttttaattggttttatgctgctttgttaggacagatgtgttttgaatgtaccattataagaagaattctatgtatcttaaactatgatcttctaaaattttatttccgtaagtacttctgtggccttgagtattttttaaaaggctcaactgtaagcctcttagccagttggataaatatttggggtcacctagccattgaaagcagaaagcagtagtgacacagctttcccttcaaagagccattgagaaacatttctcaaacaggaaatccttcttttactaatgtggacatatagattattcgtattatagtttgtagaactacctagttcagaatcttgactgccagttttcttggtttcttaggcttgaattttcatagacaattgcaacagtttagatgccttttgaaaggaatgtaatgaagattcagcatctgactatatgtgtgtctatcctgaaataataatggagagtatactgtagattacatgtttacccatcaaatctgacttaaaaggttaaatggaaggttttataggtaaggtaattgattgggaatggggtagggggaggagttgtgggggaataatgtgcatttcagtctcaacgcatagataaatttaggggaattggatgtattattcaactttgatttgggttgtaaaatgtgttaaatcctgttcattgaactcccatcaactcttataaaattcatgctgatcttcattaccgttgcatgattggaaatgtttaaaacattgtacagttttagtatagagaaatgtaatggtttttgtgaccagtttctgtctgcatgtaatttggatttctcaaatacattcattagtaatttatcagtaacattagttttatttttgttcatctccttatctataaaaaggggatattcttaggataaatacatgaaaaattatacttgatagcttaactataatcagctatttttgtatttttgtaatatttgtccactaagctggagaagcagcctcatacagttgattttgtgtatgtggctagtcttattgtcactatgtaagtaatccaatggttttagaaactaaactttctagagcaataaaatgactataatgttaagtaaacataatgttgatttctaattatgttttaaaaaatgaagtcttgaattatatcaagaaattttggcagctgaagtcatgtttattttgaagctgttagttttttcctataatttaaaaagatcttttagatttatagaagagtcagaaatgtacaagagagtttttttgttgttgtttttgttttttgagacagagtctgtctctgtcgccaaggctggagtgcagtggcgcaatcctggctcactgtagcctctgcctcctgggttcaagtgcttctcctgcctcagcctcccgagtagctgggactacaggtgcacgccaccacgcctgtagtcccagctgtattgtaaaaatacaaaattttagtatttttagtagagacagggtttcaccatgttggccaggatggtctcgatctcctgacctcgtgatctgcctgcctcggcctcccaaagtgccgggattacaggtgtgagccaccgcgccctgccaagaagagttcttttgcataccctttactcaggtcctctcatgttaacgttttacataactgtagaacatttatctaaagtaagatattagcccagaacaatactactaactgaagtataaaacttatttgaatttcaacagtttttttttcatttcttattttccttttgtgtgctctgtttataccatgatccatgatttttttaaaatcatgattgtcttttaaagatctgtgtgtctctgttttgagtttttcctgtttattttgaaaagtactgttggtcaagataattggtcaataatccatgttggttttaacaaaaagcattttaacattaaaaatattacagtataaaataacactctgtgctttaaattgaggttttatgtcattttagcagaattataatatttctgatatactcatgtttgacaagttgaaacagatttgtttcttaaaggaaggtttaatatacaaaaaaaggtaatcttaaacttacgaaaaagtaaattttacaatttgagcattactagatgtttagtttgcatgaactcatagttagaaattctgcaataggaatatctacaaccggctgatttggaatttgaaattatagtgttacatgtatacctatcaaattaaaattaaggaaatacaatagcaatatatagaatgaatgtagtaacagaaattaactctttactgcatcattgaacttattgttagttacaggtttaaaagaagttcatttaacatccagtgtgtctaattcttctggaagtggtgtagtaccattgttcttctggcatttttaaatattaaacctttttggatagatggaagccttatacaaaatctactttattttagcaaggattctctgtccttttgtatagttggtaccttactaatttaaactctaatatcaatctaaagagaaatttattatgcaatttgtatttaggtttttttttttttttttggaatgaagttcagaggtagatcctcctggaagaaagaaagcaagcgaactttttaaagaaaattagacttgaatatttaagaatgtcccttacagagaaaaggccaactataatactaagctaaaagttatgaaaaattaataggttcttttatagagctaagaatgatgaaaccatcaatacttccttcttcctaaaaatccagatcaaaacttcaggttaggtttctaagtttaggacatgaatattatttttttctggaaaagaagatgagtatatgtgtaataagacaagtagaactgagagatttagttttttttttttttaagttttagttcagaataacattaattttgagagattgaggtaaagaaccttaactaatgctaaggagtttattttgattaacataggttattctgaccaccacctcttccttccttaatctccttagaatctgacagtctcaaagctgtcacacaaattagactaattttgacactttgaaatgaaaacttcaaggaagaagtagccacggacagttatgtttataatcagtaggtggcactctttcctcaggtagccccccattttcacatgatgtgtttgaaggttaaatgccaccaaaagtgctgagtcagctataaaactaagtccctgaattccatggcccttttaaatatgtaatcattcaagattgaaaaaaaaaattaagcattttttgtttgtttgcttgtttgtttttgagacggagtttcactcttgttggccaggctggagtgcaatggcgccatctcagctcactgcaacctctgcctcccggattcaagcaattctccttcagccctccaagtagctggggttacaggtgcccgccaccatgcccagctagtttttgtatttttagtagagatgaggtttcaccatgttggccaggctggtcttgaactcctgacctcgtgatccccccacctcggccttccaaagtgctggattacaggcgtgagccactgtgcctggcttgcatttttaaaatactgaattattcaaaagaagtaccctgtcaatatgtgctttctaggaaaacagtaaaataggccacaatttggagtgacaccattcagatcaaggtctatccagttttttcttttcatgctaagtgcctacatcaccgaaacacactaatataaaattatcctttctccttcattttcagatgtgtaaaaaatggtacttaaagtgttttcatgatcattttgtaggtagactagatatagcccgttgaacctcttttaaaatttagacttttgatagtaatataaaagcatattgaaatttgtagatattatatgaggaatggcacctagatttgaaaattatgcttggcttgtagagacaactagtttctctcgctcttttttttttttttttttttttttttgagacagattctcactcagttgcccaggctggagtgcagtggtgcagtcttggctcactgcaacctctgcctcctgggttaaagcgattctcatgcctcagcctccctagtagctgagactacaggcgtgcaccaccacgcccagctaatttttgtatttttagtagagacaggatttcaccatgttcaccatgttggtcaggctggtcttgaactcctggcctcaagtgatctgcccgcctcgacctcccagagtgctgggattataggtgtgagccactaagcctggctgagacaactagtttcccttaactcattggaattctctaggattaggagaattccacagagcctatatgatattatagctcaacatttagtataccaaaggcatacccgtgtaaatctaggagttatttccagagattgttttaaggagcagtcttatattcagggtagaaagttatgattggatctgctgttaaggagaacaaaggagcttctaaaggtttgggaggtttactggtagtaactattctaggaaatatttatgttttaaggtgatgttcacatgggttctttagaaggaacatagtcaagtgtgatggattaactctatatagtctttctcctcttgtgcgtgtaggaaatctgacctgcagtgtcagttgatgtgacaagagataaagaaagcacagtattttaaaatctaaagcagattcctttcttagaaaacaataggaaaaaattatagatggatgtctttgctgaaatctaacaattagctcatattccatgagaaagagtggcctaagaattatttcatgttacctagccttctgaagctactcacttgatgtgcctagcactttgaaactaaccttttctttctttgttcatgacagtttaattccaaatatttactattttctcttgtaactgttagaacagttccttttgacattaatttttgcctacatatatatttttaagttgagaccaaatcggtgaagtgttgagcaagtaacatttatgatgtgtgtatattggaacaaatgtaaaagggttacaaagattagaaacagagtcataaaaaatggcttgatttataaaggcattacttttggtgctttatataatggcatatattgaactaaaaatttgtatatacagtatgtcagcatttcttagtaacttctcttgaatccatttttaatatctaatattgtacaggttggggagttacattcttcaggccaatactatccagactatataaatttataaaataaattgaaaaattcattcccctgtattcaagaccaaagcacataaatgctaatgtagggctcagaggggaaatacagttctcctgcatatttgagaaaatgtgaagtcctttcaagaaaatctaataaacataataatcatagcctgctgacactaaggaaaaaggacctcattcactctttcttttatgcagtgatttactggtccctactgatttccaaattggatcacgatagtaaattatccatgctggtacctgtgaaagtaagccctgggatccatatttgttttgtgttctgcttaaatcagcaagaatgataaatttgatggtgtgaaattggaagtatcaagggctttctttggtgattgagggaaataatgtctctacttgtaatttattgtgaccctttttcactgtatatgctttgtatgtctaatatttatttcaatgcaaattcaattgttccttcatctgtattgttatatctaagattttattgatgttaaaatctaattgtggaataaaaatctctctggaatttagcagatacaaaaa

SEQ ID NO: 7507 - DNA, 867 bp, Homo sapiens
aaaggagcacttccgggttcggcaataacctggagccggcggcgtaggttggctctttagggcttcaccccgaagctccaccttcgctcccgtctttctggaaacaccgctttgatctcggcggtgcgggacaggtacctcccggctgctgcgggtgccctggatccagtcggctgcaccagacgctagtgtgagcccccatggcagatacgaccccgaacggcccccaaggggcgggcgctgtgcaattcatgatgaccaataaactggacacggcaatgtggctttctcgcttgttcacagtttactgctctgctctgtttgttctgcctcttcttgggttgcatgaagcagcaagcttttaccaacgtgctttgctggcaaatgctcttaccagtgctctgaggctgcatcaaagattaccacacttccagttaagcagagcattcctggcccaggctttgttagaggacagctgccactacctgttgtattcactcatctttgtaaattcctatccagttacaatgagtatcttcccagtcttgttattctctttgcttcatgctgccacatatacgaaaaaggtccttgacgcaaggggctcaaatagtttacctctgctgagatctgtcttggacaaattaagtgctaatcaacaaaatattctgaaattcattgcttgcaatgaaatattcctgatgcctgcgacagtttttatgctttttagtggtcaaggaagtttgctccaaccttttatatactatagatttcttacccttcgatattcgtctcgaagaaacccatattgtcggaccttatttaatgaactgaggattgttgttgaacacataataatgaaacctg

SEQ ID NO: 7508 - DNA, 1092 bp, Homo sapiens
aaaggagcacttccgggttcggcaataacctggagccggcggcgtaggttggctctttagggcttcaccccgaagctccaccttcgctcccgtctttctggaaacaccgctttgatctcggcggtgcgggacagacgctagtgtgagcccccatggcagatacgaccccgaacggcccccaaggggcgggcgctgtgcaattcatgatgaccaataaactggacacggcaatgtggctttctcgcttgttcacagtttactgctctgctctgtttgttctgcctcttcttgggttgcatgaagcagcaagcttttaccaacgtgctttgctggcaaatgctcttaccagtgctctgaggctgcatcaaagattaccacacttccagttaagcagagcattcctggcccaggctttgttagaggacagctgccactacctgttgtattcactcatctttgtaaattcctatccagttacaatgagtatcttcccagtcttgttattctctttgcttcatgctgccacatatacgaaaaaggtccttgacgcaaggggctcaaatagtttacctctgctgagatctgtcttggacaaattaagtgctaatcaacaaaatattctgaaattcattgcttgcaatgaaatattcctgatgcctgcgacagtttttatgctttttagtggtcaaggaagtttgctccaaccttttatatactatagatttcttacccttcgatattcgtctcgaagaaacccatattgtcggaccttatttaatgaactgaggattgttgttgaacacataataatgaaacctgcttgcccactgtttgtgagaagactttgtctccagagcattgcctttataagcagattggcaccaacagttccatagtttaacatctagttaagctacaaatatagtataagcattattagcagctggtacttctgctaggggttgtaaattccaggtgttacactgacctcaatccaatttacataatttacataaatgcatctcggtggaaaaataatcattttcttggcatgttaaatcaagcttaaaaagttttgagaaaattttactg

SEQ ID NO: 7509 - DNA, 2195 bp, Homo sapiens
tttgaagtttccgtctttcctttagggcttcatttaacttcgagactgtccttttggcctgtgagcacacgtagggcattaggacccagcgtttgttgtagtgagagtggttgaatctcgatctctcaatttttctctcgagctccctcctctccctttgtcattctagctgcctgctgcctccgcagcgtccccccagctctccctgtgctaactgcctgcaccttggacagagcgggtgcgcaaatcagaaggattagttgggacctgccttggcgaccccatggcatcccccagaaccgtaactattgtggccctctcagtggccctgggactcttctttgttttcatggggactatcaagctgacccccaggctcagcaaggatgcctacagtgagatgaaacgtgcttacaagagctatgttcgagccctccctctgctgaagaaaatggggatcaattccattctcctccgaaaaagcattggtgcccttgaagtggcctgtggcatcgtcatgacccttgtgcctgggcgtcccaaagatgtggccaacttcttcctactgttgctggtgttggctgtgctcttcttccaccagctggtcggtgatcctctcaaacgctacgcccatgctctggtgtttggaatcctgctcacttgccgcctgctgattgctcgcaagcccgaagaccggtcttctgagaagaagcctttgccagggaatgctgaggagcaaccctccttatatgagaaggcccctcagggcaaagtgaaggtgtcatagaaaagtggaagtgcaaagagtggaccttccaggcagttgcgtccatgacaccaggaagatgtcagtgtgtgtttttcatttgatttatttatcttggggaaagtgaaaaatgtaatctgcaagttaatgaccctattggcttgtgtacatctatatgctaaaatgacttccccacattgacatttgtgcgccacctttaatcactctggggcaactctcacatcttgctgcatgtacatgtatacggctactattgaagtgtaattgtgagatggactccaacaagcatgtgactgtgagattgtgtgtgggaaaatgtatttaactactctgtgtgtgtgtgtgtgtgtgtgtgcgcgcgcgcgcgcacgcgcacacactcacgcacacacaagcagagaaggcgctgatcttgaactaatcctgcacaggcatccttccctttatagattgattccagcaaaggcggaataaaacaaatttcctatgaagagaatcctgatatgaaacaagtcatgtagtctcatggccgggaatctctccacagatactaacaacttaaacttactactttaggagaaaaaaaaaaacattcaatttcggacactgagttatatatgaaattaattaggctctagtccaacagttgtttacattttaaatagtccatattgaatttaattaaaacaagggatgcatgcagtcaaattgatagtttaattcttcaagtgataatataggaagtttcaccttgcctttgtccaagccccacctattaaaaccctttactcacagtttgaaactgaagcagtaaacttgtttccagacatctttttcagattgtcttaagcccaaagttgcctcacttccactattctcagcagccaaccaggatttggcagctgctccactgttacggttgagggaacagggatcagtcctgttagaagtctgtgagcctcaaactctacctgttctctgcaatcatccaaaatttgaaaaagaagctatatccagtgtttcactgccaaacagattcactactcttactgattcttcactgagctttgctagtataagcagagttccaagtctcccctagggttgtctctacatttctttatcattccagtgggtagggtttagctgggggaaggacatttcataagggttagttggactgagcagtatggacatttgcttttttcattacgtactgttgtttttccttgttaggtgtgctttggtggttttaatattattgtgccagggatggggaaatggggggggttgtgtgggaagagtacttattattgtgttttcttcagtgtaattgttcttggtaattgatacctctctgttttatttctctcattctttcaaaataaaactttttgaaatttggagg

SEQ ID NO: 7510 - DNA, 853 bp, Homo sapiens
attctagctgcctgctgcctccgcagcgtccccccagctctccctgtgctaactgcctgcaccttggacagagcgggtgcgcaaatcagaaggattagttgggacctgccttggcgaccccatggcatcccccagaaccgtaactattgtggccctctcagtggccctgggactcttctttgttttcatggggactatcaagctgacccccaggctcagcaaggatgcctacagtgagatgaaacgtgcttacaagagctatgttcgagccctccctctgctgaagaaaatggggatcaattccattctccaccagctggtcggtgatcctctcaaacgctacgcccatgctctggtgtttggaatcctgctcacttgccgcctgctgattgctcgcaagcccgaagaccggtcttctgagaagaagcctttgccagggaatgctgaggagcaaccctccttatatgagaaggcccctcagggcaaagtgaaggtgtcatagaaaagtggaagtgcaaagagtggaccttccaggcagttgcgtccatgacaccaggaagatgtcagtgtgtgtttttcatttgatttatttatcttggggaaagtgaaaaatgtaatctgcaagttaatgaccctattggcttgtgtacatctatatgctaaaatgacttccccacattgacatttgtgcgccacctttaatcactctggggcaactctcacatcttgctgcatgtacatgtatacggctactattgaagtgtaattgtgagatggactccaacaagcatgtgactgtgagattgtgtgtgggaaaatgtatttaactactctgtgtgtgtgtgtgtgtgtg

SEQ ID NO: 7511 - DNA, 1688 bp, Homo sapiens
gcgatcgaggctgcagcgcggccgccgggcgcagcatgactgccgtcggcgtgcaggcccagaggcctttgggccaaaggcagccccgccggtccttctttgaatccttcatccggaccctcatcatcacgtgtgtggccctggctgtggtcctgtcctcggtctccatttgtgatgggcactggctcctggctgaggaccgcctcttcgggctctggcacttctgcaccaccaccaaccagacgatctgcttcagagacctgggccaggcccatgtgcccgggctggccgtgggcatgggcctggtacgcagcgtgggcgccttggccgtggtggccgccatttttggcctggagttcctcatggtgtcccagttgtgcgaggacaaacactcacagtgcaagtgggtcatgggttccatcctcctcctggtgtctttcgtcctctcctccggcgggctcctgggttttgtgatcctcctcaggaaccaagtcacactcatcggcttcaccctaatgttttggtgcgaattcactgcctccttcctcctcttcctgaacgccatcagcggccttcacatcaacagcatcacccatccctgggaatgaccgtggaaattttaggccccctccagggacatcagattccacaagaaaatatggtcaaaatgggacttttccagcatgtggcctctggtggggctgggttggacaagggccttgaaacggctgcctgtttgccgataacttgtgggtggtcagccagaaatggcccgggggcctctgcacctggtctgcagggccagaggccaggagggtgcctcagtgccaccaactgcacaggcttagccagatgttgattttagaggaagaaaaaaacattttaaaactccttcttgaattttcttccctggactggaatacagttggaagcacaggggtaactggtacctgagctagctgcacagccaaggatagttcatgcctgtttcattgacacgtgctgggataggggctgcagaatccctggggctcccagggttgttaagaatggatcattcttccagctaagggtccaatcagtgcctaggactttcttccaccagctcaaagggccttcgtatgtatgtccctggcttcagctttggtcatgccaaagaggcagagttcaggattccctcagaatgccctgcacacagtaggtttccaaaccatttgactcggtttgcctccctgcccgttgtttaaaccttacaaaccctggataaccccatcttctagcagctggctgtgcctctgggagctctgcctatcagaaccctaccttaaggtgggtttccttccgagaagagttcttgagcaagctctcccaggagggcccacctgactgctaatacacagccctccccaaggcccgtgtgtgcatgtgtctgtcttttgtgagggttagacagcctcagggcaccatttttaatcccagaacacatttcaaagagcacgtatctagacctgctggactctgcagggggtgagggggaacagcgagagcttgggtaatgattaacacccatgctggggatgcatggaggtgaagggggccaggaaccagtggagatttccatccttgccagcacgtctgtacttctgttcattaaagtgctccctttctagtcctttttctgcccagaa

SEQ ID NO: 7512 - DNA, 1623 bp, Homo sapiens
agctgcgggggcgcagtcgccgggccgcgggcggcgggacggacgaggccggggccccgggtggcacccggcaggcgggcaggcgggcgccatggagctgctctcggcgctgagcctgggcgaactggcgctcagcttctcgcgggtgccgctcttccccgtcttcgacctcagttacttcatcgtctccatcctctacctcaagtatgagccaggagcagtcgaactgtcccggcgccaccccatcgcgtcctggctgtgcgccatgctgcattgcttcgggagctacatcctggctgatctgctccttggggagccactgatcgattacttcagcaacaactccagcatcctgctggcctcagctgtctggtacttgattttcttctgccccctggacctcttctacaagtgtgtctgcttcctgcctgtgaaactcatcttcgtggccatgaaggaggtggtgcgagtccgcaagatcgcggtgggcatccatcacgcccatcaccactaccaccacgggtggttcgtcatgattgcaactgggtgggtcaaaggttctggtgtcgccctcatgtccaactttgagcagctgctccgaggggtctggaagccagagaccaacgagatcctgcacatgtctttccccaccaaggccagcctgtatggagccatcctcttcaccctccagcagacccgctggctcccagtgtccaaagccagcctcatcttcatcttcaccttgttcatggtgtcctgtaaggtgtttctgacagccacccactcacacagctccccctttgatgccctggagggctacatctgccccgtgctgtttggttcggcctgcgggggtgaccatcaccacgacaaccatggtgggtcccacagcggtggtgggccaggagctcagcattcggccatgcccgccaagtccaaggaggagttgagcgagggctccaggaagaagaaggccaagaaggcggattagggggtggcccaaggggcaccggggagaggacccggacccaggaccctctgagctgggaggcttcctgcgctcagatctatcctttcctggccttgacttccccatctgcaaatcagggtcattggctcaccctccagggctgatgtgggggttgagatatggggatgaggatgaagaacttttgtagaaatcggggttccctctttctctctgccaggaccccatagagtcacagcttttggaggggttcacagaatcctggcagcagctccagtcaagaatgtcactggttggcatgatattcttagttgtatttttccttctttaaaattgcatcttgaccaggcacagtggctcatgcctataatcctagcactttgggaggccgaggcgggcagatcacctgaggtcaggagttcaagaccagcttggccaacatggtgaaaccccatctctaccaaaaatacaaaaattagccagacgtggtggtgcacgcctttaatcccagctactcgggaggctgaggcaggagaatcacatgaatccaggaggtggaggttgcagtgagctgagatcttcccactgcactccagcctggccaataagacctgtctccagcaagaccctgtctc

SEQ ID NO: 7513 - DNA, 3956 bp, Homo sapiens
gcagtgtttcctccacaggggtctcagtctgggctctaaagagctcctccaccaagtttctaaattttaataatttcagcctattgttcccccagagtagtaactgctttctggaactgaactctgtgataatgtagtatttactttttgccttttcaataacctagttaacaattttatacctactgagttctatttaaataatggtattttctatctcctgactggacagatacccaggagtagggtttgaacttcctactttctggtttgcatatatcttattaagataactaaagtacttgctacttgccagtcttcagacccggtcagtgtaatgtcatcagtgcagcagatcagtgtgatgtgtgatttctcaatgtgatcaaaatctctggactattttagagagcaagagtgttaacatagacctgaagcaagactgtaatggttgaacaaagcacaaagtgcttctgagattttttgcaaattaataggaagaaaaaagcatttgcttccaagttataagaattgtgttgatttgaccccgtaaaaatactacatcttgaatactagctgcaattacagtcacgacctttctgtgtttataattcatagctattctccaagatccatctgtcttatatttagatcaaacaggagcagctgcattggcatggaagaatcctatttcaagctggtttactgctatgctccactgttttggtggaggaattttatcctgtctactgcttgcagagcctccattgaagtttcttgcaaaccacactaacatattactggcatcttcaatctggtatattacatttttttgcccgcatgacctagtttcccagggctattcatatctacctgttcaactactggcttcgggaatgaaggaagtgaccagaacttggaaaatagtaggtggagtcacacatgctaatagctattacaaaaatggctggatagtcatgatagctattggatgggcccgaggtgcaggtggtaccattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgtgattatttgaatagttttatattaataaaagaagacaaaattttttaaatgttagaaaaagcagatctgtcattgcaaagtaacaaaaattttaagcttttaaaaatgtagatttttcatatttttaaaatttgaatctatttgagctttagttcagcagaattaaatttttacttgacattatcattaaaattgctaggtatggagaacaattcctattttattttgaacactgagaagagtaaacttttcctaaaacactttatattataaatgaaaataaattgctagtttatattttagatataaacatcatattttttattaatacctacatcaaatggaaaatatctgaaattttttttccatagcaggtattttctactagaagtagttttactacttttcatttagaacagagtatgagtcttaatctgaagtctttttcatgcccttgttttaaaaaaactactttttttggcctcaaaaaaatcaagggtgtaatttttaataaattgttaatcctatgttttgtaattttcattttaggagcttgacttatttttttctctctcataaaaacacatttgttttaattgtaggagaaattttctcagcattttgcatgttctttctaatctttgttggtctgaatatattggtagtaattactgtaattattcaacaaaaagcatatccgttcaaaaatttttccactatgtcttttttctagtggctactgttttagttttctagttgaatatctctgacaagctttcgtatggttttgttatattttcatctacatgtaatgtgttattaattttattaaatgaaaactaatcaccttcatgtggaaatgctctgagaattgtccttaggcatttggtagtaaccagctaaccaagaagaaacagagaaaccagaacttcatatggcagtccatttagatgaagaatgatgatataaaatctggttccttcttagcaaaataaaaaacaaacaagaaaagatactaaatgatgttaattttcttactttatgatttagaagtccagttataatattaaaactctgtgacatagtttcttttaccaaaaccatgaacctactccccgtatcaggtattttcgatggtttagaagtactcaagtcacatcacattcaagttagaagttttttttttgttgttgttattttaaatttttaacaaatataaacaccagcagatactattacttgcttaaaaaattgggagggggcacttttcatagtcttggaatgctaagaagttttatttttaatattgtgacagaaagctttaagtatttaagagctctgtattatatttgatactcttacagttaaaaacttttcaaaattaatacattgttaattattgaccagttttgaagtttgggtttaactgtagttgaaatggaaggactcttgttttacacttgtattaaagataaatttattaaaataagttatttagcaccaatggagtattacattatttttatgttttatatttttcttgaggtagagtttcagaactcatctagtattttgactaatatagtatatattcagtgattactgttcaaatgggacattggtagaaactttattaatctatgcaagtatcctataaccctcaattcaaggctcttttgtaaaaaatgtactggagaacatggcttaggcctgaaacccatcctgaatctattcaggtcacctgtagagtcttgacttggatttgcaaagcagattgttagactccttacccaatgtgaagtgtgaataaggcctataggcctgcctcacacagctaatcagaggtggcactgagaaagtcaagtcctaataggtctccttaaaaaaaaaaaggagacaaaaagctggcaagaacatgagccagcttccctcagtgctgtcactctcaagtaaaacatggccaaatgaatatcaaactggtttatcagattagtcactcttccttactgagggagtatcaagtaagggctggagagagaccagatatgtggagttgttggctttcagtggaaatggtagcctccctgtgggtagagaccaaaaggtagagagatgacagaagggagactctgattagtgtattttttttttgtctattccttaaagcccagacacctttccattaaaatctacttcaaatcacaagttgattacaattgagtggaacatcccatgttgtaaatggaataatgtgttcagaatgctctttctttcccccaataaagccctttatagtgttt

SEQ ID NO: 7514 - DNA, 3525 bp, Homo sapiens
gctggagccggcgcggaggagcgggcggccgcggctgtgccctctcctactcctcaccgcgcgagcgcggggaaccagtagccgcggctgcttcggttgccgcggtcggtggtcgttatggattctccatgggacgagttggctctggccttctcccgcacgtccatgtttcccttttttgacatcgcgcactatctagtgtcagtgatggcggtgaaacgtcagccgggagcagctgcattggcatggaagaatcctatttcaagctggtttactgctatgctccactgttttggtggaggaattttatcctgtctactgcttgcagagcctccattgaagtttcttgcaaaccacactaacatattactggcatcttcaatctggtatattacatttttttgcccgcatgacctagtttcccagggctattcatatctacctgttcaactactggcttcgggaatgaaggaagtgaccagaacttggaaaatagtaggtggagtcacacatgctaatagctattacaaaaatggctggatagtcatgatagctattggatgggcccgaggtgcaggtggtaccattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgtgattatttgaatagttttatattaataaaagaagacaaaattttttaaatgttagaaaaagcagatctgtcattgcaaagtaacaaaaattttaagcttttaaaaatgtagatttttcatatttttaaaatttgaatctatttgagctttagttcagcagaattaaatttttacttgacattatcattaaaattgctaggtatggagaacaattcctattttattttgaacactgagaagagtaaacttttcctaaaacactttatattataaatgaaaataaattgctagtttatattttagatataaacatcatattttttattaatacctacatcaaatggaaaatatctgaaattttttttccatagcaggtattttctactagaagtagttttactacttttcatttagaacagagtatgagtcttaatctgaagtctttttcatgcccttgttttaaaaaaactactttttttggcctcaaaaaaatcaagggtgtaatttttaataaattgttaatcctatgttttgtaattttcattttaggagcttgacttatttttttctctctcataaaaacacatttgttttaattgtaggagaaattttctcagcattttgcatgttctttctaatctttgttggtctgaatatattggtagtaattactgtaattattcaacaaaaagcatatccgttcaaaaatttttccactatgtcttttttctagtggctactgttttagttttctagttgaatatctctgacaagctttcgtatggttttgttatattttcatctacatgtaatgtgttattaattttattaaatgaaaactaatcaccttcatgtggaaatgctctgagaattgtccttaggcatttggtagtaaccagctaaccaagaagaaacagagaaaccagaacttcatatggcagtccatttagatgaagaatgatgatataaaatctggttccttcttagcaaaataaaaaacaaacaagaaaagatactaaatgatgttaattttcttactttatgatttagaagtccagttataatattaaaactctgtgacatagtttcttttaccaaaaccatgaacctactccccgtatcaggtattttcgatggtttagaagtactcaagtcacatcacattcaagttagaagttttttttttgttgttgttattttaaatttttaacaaatataaacaccagcagatactattacttgcttaaaaaattgggagggggcacttttcatagtcttggaatgctaagaagttttatttttaatattgtgacagaaagctttaagtatttaagagctctgtattatatttgatactcttacagttaaaaacttttcaaaattaatacattgttaattattgaccagttttgaagtttgggtttaactgtagttgaaatggaaggactcttgttttacacttgtattaaagataaatttattaaaataagttatttagcaccaatggagtattacattatttttatgttttatatttttcttgaggtagagtttcagaactcatctagtattttgactaatatagtatatattcagtgattactgttcaaatgggacattggtagaaactttattaatctatgcaagtatcctataaccctcaattcaaggctcttttgtaaaaaatgtactggagaacatggcttaggcctgaaacccatcctgaatctattcaggtcacctgtagagtcttgacttggatttgcaaagcagattgttagactccttacccaatgtgaagtgtgaataaggcctataggcctgcctcacacagctaatcagaggtggcactgagaaagtcaagtcctaataggtctccttaaaaaaaaaaaggagacaaaaagctggcaagaacatgagccagcttccctcagtgctgtcactctcaagtaaaacatggccaaatgaatatcaaactggtttatcagattagtcactcttccttactgagggagtatcaagtaagggctggagagagaccagatatgtggagttgttggctttcagtggaaatggtagcctccctgtgggtagagaccaaaaggtagagagatgacagaagggagactctgattagtgtattttttttttgtctattccttaaagcccagacacctttccattaaaatctacttcaaatcacaagttgattacaattgagtggaacatcccatgttgtaaatggaataatgtgttcagaatgctctttctttcccccaataaagccctttatagtgttt

SEQ ID NO: 7515 - DNA, 502 bp, Homo sapiens
gctggagccggcgcggaggagcgggcggccgcggctgtgccctctcctactcctcaccgcgcgagcgcggggaaccagtagccgcggctgcttcggttgccgcggtcggtggtcgttatggattctccatgggacgagttggctctggccttctcccgcacgtccatgtttcccttttttgacatcgcgcactatctagtgtcagtgatggcggtgaaacgtcagccggggtctcactgtgttgtctaggctgagtgcattggcactatcatggctcactgcagcctggaactcctgggctcagtgattcttccactttagcctcctgagtagctgagactacaggagcagctgcattggcatggaagaatcctatttcaagctggtttactgctatgctccactgttttggtggaggaattttatcctgtctactgcttgcagagcctccattgaagtttcttgcaaaccacactaacatattactggcatcttcaatctg

SEQ ID NO: 7516 - DNA, 721 bp, Homo sapiens
tatcctgtctactgcttgcagagcctccattgaagtttcttgcaaaccacactaacatattactggcatcttcaatctggtatattacatttttttgcccgcatgacctagtttcccagggctattcatatctacctgttcaactactggcttcgggaatgaaggaagtgaccagaacttggaaaatagtaggtggagtcacacatgctaatagctattacaaaaatggctggatagtcatgatagctattggatgggcccgaggtgcaggtggtaccattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagtctctgaattggagatgatctgtggctgtaattcagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaata

SEQ ID NO: 7517 - DNA, 451 bp, Homo sapiens
ctggatagtcatgatagctattggatgggcccgaggtgcaggtggtaccattataacgaattttgagaggttggtaaaaggagattggaaaccagaaggtgatgaatggctgaagatgtcataccctgccaaggtaaccctgctggggtcagttatcttcacattccagcacacccagcatctggcaatatcaaagcataatcttatgttcctttataccatctttattgtggccacaaagtagtctctgaattggagatgatctgtggctgtaattcaggtaacaaatattggaggcaaaatctcttcacatgtagtctcttccagtcctcaaatgttgagccgtgtatatttttttctaacagctttattgagatatattttccatactgtgttagtctgttctcatgctgctaataaagacatacctgatactgggtaatttataaag

SEQ ID NO: 7518 - DNA, 4369 bp, Homo sapiens
gcactcgcggctggggcagaccgcggtcgcgtagctgacgtcatcgccgtgcgctgccacgtctgctcagctccgcggtaatggaggctagggatgggtgctgaagtatcaggctctggctctagctttagctctggcactggaactgcgtcggagtctgggtctgagtctggcagcccgaagcctggacaccttttcttgattctctaggcgggggctgcctgcgtccaagcagctggtttgcagcgttccaacgctgggagggagttcccttacctggggtccagtctgtaaagttgtcgccgctttctagggaccccgccccaccggctgggactcttccatgcagttgaaactggttgacaaccattaacctgggttgcaactacaggtggcactggaagcagactggttcctggacatgcccggtggaaggaggggccctagtcggcaacagctaagccgttcagctttaccttctttgcagactttggttggtggaggctgtggcaatggaacaggcttgagaaacaggaatggtagtgctattggccttccagtcccacctatcacagccttaatcaccccaggtcctgttcgtcattgccaaattcctgacttgcctgtggatgggagcctactctttgaattcctttttttcatctacctgttggttgctcttttcattcagtacatcaacatttataaaacagtgtggtggtatccttacaatcatcctgcttcttgtacatcactgaattttcatctcattgattatcatctggcagcattcatcacagtgatgcttgcgaggaggcttgtatgggctctcatctcagaggctactaaggcaggtgcagcatcaatgattcactacatggttctgatatcagctcgcttggtactactcactttgtgtggatgggtactttgttggaccctcgtcaatctctttcgaagccattcagtcctcaatctccttttccttggctacccgtttggtgtttatgttcctctttgctgttttcatcaagatagtagagcacatcttcttctcacagactacaactatgtggttcagcacgaggcagtagaggaaagtgcctcgactgtgggaggcttggccaaatccaaagactttctctccttgttgctggagtcgctaaaagaacagtttaataatgccacacccatccccacccacagttgtcccctatctccagacctcattcgcaatgaagtagaatgtctgaaagcagatttcaaccacagaatcaaggaggttctcttcaactccctcttcagtgcctactatgttgcatttctccccctgtgttttgtgaagagtacccagtactatgacatgcgctggtcatgtgagcacctcattatggtgtggatcaatgcttttgtcatgctcaccacgcaactgttgccatccaaatactgtgatttgctacataaatcagctgctcacctgggcaagtggcagaagttggaacatgggtcctacagcaatgctccacagcacatttggtcagaaaatacaatatggcctcaaggggtgctggtgcggcacagcagatgtttatatagagccatggggccttacaacgtggcagtgccttcagatgtatctcatgcccgcttttatttcttatttcatcgaccattaaggctgttaaatctgctcatccttattgagggcagtgtcgtcttctatcagctctattccttgctgcggtcggagaagtggaaccacacactttccatggctctcatcctcttctgcaactactatgttttatttaaacttctccgggacagaatagtattaggcagggcatactcctacccactcaacagttatgaactcaaggcaaactaagctgcctctcaacaatgagggagaactcagataaaaatattttcatacgttctatttttttcttgtgatttttataaatatttaagatattttatattttgtatactattatgttttgaaagtcgggaagagtaagggatattaaatgtatccgtaaacaaggtgatgtgatctttcatgtgttagtatattcgaataatatacatatgagaggtatgcctgtccagtaaagagattgatttgtttgtatggctctggaataactcattcgtttatgaacacatctcatgtattacttgacacagtacctttggtatgtctgcttttctttcaatcctcattatctttagccctcagctggccagtacttattgctaaagaaagggagatcaatggagttgcctaccagcacccattctcttttagttcagctggctaatagtattggaatacattgggaaaagagtgggttaaagtcctaggtggggttctctttgttgcctaccaggagaaagcagtaggcttcctttctaagatacggactcagctggtctattttaccctgtgacatttaaatatacttttgaataagctactatcctgaggctgagggttttgctgccacttttcctgtgtttccacttctgcttccaaagattttcctcttagttgtttgaaataatactttgccagacaggaagtctttagactgcccacattcatgaagaagatgatgtgtggctggatcagtaggagaagctgagtgcaaatgccatgtgggctagagtatgggaaggttgaaaattccaagtaactgggagagtgggcaagtcctcagctgaacaatcttggatgtagtctagcagcaacccacctacaatggcgttatgtttggagttatgaggggaagtgaaagataagaattacctacagctttgtactcagataatttatatccaaaatttgtgttttaaatttcatactccagaactttcatgtttatgagtattagccttttaagttatgggaggtgatatacttagtccattgatgttgtcacttgtcatctaaacttatgagaccttgtcttagagaatctaaaatatattgtcatatgttttctgtgctgagtttggtttgttacactgtgaagcttttggtgaaacaaaataagacttatgaagtaaaaagaccaatcatgtcgttgacaagctggctctgaaaataattcttgcagaagagttcctgaaaggcttcaccaaggggaagtattgtgaggagtgtttgtaaaaccaaggtacccaatatcagttttatgtttaaatcaataattgtttctttaaatattttgatgtgtatactttttttttaagttaacattatttggcattcagtctgagtctgttcaaccattcaacaaatatatattaaccagtaggcactatattaggccctggggatatagcagtgaatgagaaatgcaaaggtcctacttgcacagagcttacaatatgcgtgggggtgggggagttaggtggtgcagaaaatacagcaaataaatttatgtgtaatataacattccctggtagtagtgataagtgtagcaaagggaaatcaggacaaggaaatagtggtaagaatagcactgctagaaggcatctttgaggagatgatttttaagcaaagaaaaagcaagactgaatcatataaatagctttggggagaattccatgttacagtagcagaaagggcagtgccctgaggtggggacaagttggtatattggaagaatagcaagaaaatatattaggttagttgctttttaaagtagttcagcctaaatatagtggttcttgaggtaggggtgggaagggtagggaatctgccatctttctattctttctgtaggatcttgaaaatatgcttctcttggcagcaacattttcatgagattactcagcagttgagagcaaaatgggtggcatgggcacagagatatctcatcaaaattgccccaacttggctccagcttgggaaagtaacccagaaaaccctgattagagataacagaccagtcttatgaactaatatgatgccccttctggcttgatctgtcttggtcctatcctaagggaatagcacagaaccagatgctggcttggctaaataagtaagtggatataagaaataaataaaaattaattttggctaatggaattgcaaagttcctcctaccctcacctccagatatggcagcatacggggcataagaccgtttagttcaacgtgttctacacattccagctgttttttgtttgtttgttttgttgttttgtttttgtaggggccacgttcatggaagagagaaaaattactagttacccggatatcctattatagttcatgtaacagaagggacactatatttgctcactgatagtagaaaaatgtgtaatcattaaagaatgaccttttttgtaa

SEQ ID NO: 7519 - DNA, 588 bp, Homo sapiens
gacgtcatcgccgtgcgctgccacgtctgctcagctccgcggcgggggctgcctgcgtccaagcagctggtttgcagcgttccaacgctgggagggagttcccttacctggggtccagtctgtaaagttgtcgccgctttctagggaccccgccccaccggctgggactcttccatgcagttgaaactggttgacaaccattaacctgggttgcaactacaggtggcactggaagcagactggttcctggacatgcccggtggaaggaggggccctagtcggcaacagctaagccgttcagctttaccttctttgcagactttggttggtggaggctgtggcaatggaacaggcttgagaaacaggaatggtagtgctattggccttccagtcccacctatcacagccttaatcaccccaggtcctgttcgtcattgccaaattcctgacttgcctgtggatgggagcctactctttgaattcctttttttcatctacctgttggttgctcttttcattcagtacatcaacatttataaaacagtgtggtggtatccttacaatcatcctgcttcttgtacatcactg

SEQ ID NO: 7520 - DNA, 935 bp, Homo sapiens
agaccgcggtcgcgtagctgacgtcatcgccgtgcgctgccacgtctgctcagctccgcggtaatggaggctagggatgggtgctgaagtatcaggctctggctctagctttagctctggcactggaactgcgtcggagtctgggtctgagtctggcagcccgaagcctggacaccttttcttgattctctaggcgggggctgcctgcgtccaagcagctggtttgcagcgttccaacgctgggagggagttcccttacctggggtccagtctgtaaagttgtcgccgctttctagggaccccgccccaccggctgggactcttccatgcgtggcactggaagcagactggttcctggacatgcccggtggaaggaggggccctagtcggcaacagctaagccgttcagctttaccttctttgcagactttggttggtggaggctgtggcaatggaacaggcttgagaaacaggaatggtagtgctattggccttccagtcccacctatcacagccttaatcaccccaggtcctgttcgtcattgccaaattcctgacttgcctgtggatgggagcctactctttgaattcctttttttcatctacctgttggttgctcttttcattcagtacatcaacatttataaaacagtgtggtggtatccttacaatcatcctgcttcttgtacatcactgaattttcatctcattgattatcatctggcagcattcatcacagtgatgcttgcgaggaggcttgtatgggctctcatctcagaggctactaaggcaggtgcagcatcaatgattcactacatggttctgatatcagctcgcttggtactactcactttgtgtggatgggtactttgttggaccctcgtcaatctctttcgaagccattcagtcctcaatctccttttccttggctaccc

SEQ ID NO: 7521 - DNA, 590 bp, Homo sapiens
gtggggaggataaacgaatggaccagttgcctatcctccctccctggcacccctgggaaaataggtctgcagccagaaaactgaaggtcagagaggagttgaaactggttgacaaccattaacctgggttgcaactacaggtggcactggaagcagactggttcctggacatgcccggtggaaggaggggccctagtcggcaacagctaagccgttcagctttaccttctttgcagactttggttggtggaggctgtggcaatggaacaggcttgagaaacaggaatggtagtgctattggccttccagtcccacctatcacagccttaatcaccccaggtcctgttcgtcattgccaaattcctgacttgcctgtggatgggagcctactctttgaattcctttttttcatctacctgttggttgctcttttcattcagtacatcaacatttataaaacagtgtggtggtatccttacaatcatcctgcttcttgtacatcactgaattttcatctcattgattatcatctggcagcattcatcacagtgatgcttgcgaggaggcttgtatgggctctcatctcagag

SEQ ID NO: 7522 - DNA, 1813 bp, Homo sapiens
gtatgcaaatgtagcggcgcggcgggagcgcgcggctgatacccgggactgggctgcggcggttagtcctctcccggccgccgtcgcctccgacatattgcccgcaggagctgcggcggcgaagcggagagcaccggggggaggagatgggaggacgaagaggtcccaacaggacatcttactgtcgaaatccgctctgtgagccgggatcctcggggggctctagtggaagccacacttccagtgcatcggtgaccagtgttcgttcccgcaccaggagcagttctggaacaggcctctccagccctcctctggccacccaaactgttgtgcctctacagcactgcaagatccccgagctgccagtccaggccagcattctgtttgagttgcagctcttcttctgccagctcatagcactcttcgtccactacatcaacatctacaagacagtgtggtggtatccaccttcccacccaccctcccacacctccctgaacttccatctgatcgacttcaacttgctgatggtgaccaccatcgttctgggccgccgcttcattgggtccatcgtgaaggaggcctctcagagggggaaggtctccctctttcgctccatcctgctgttcctcactcgcttcaccgttctcacggcaacaggctggagtctgtgccgatccctcatccacctcttcaggacctactccttcctgaacctcctgttcctctgctatccgtttgggatgtacattccgttcctgcagctgaattgcgacctccgcaagacaagcctcttcaaccacatggcctccatggggccccgggaggcggtcagtggcctggcaaagagccgggactacctcctgacactgcgggagacgtggaagcagcacacaagacagctgtatggcccggacgccatgcccacccatgcctgctgcctgtcacccagcctcatccgcagtgaggtggagttcctcaagatggacttcaactggcgcatgaaggaagtgctcgtcagctccatgctgagcgcctactatgtggcctttgtgcctgtctggttcgtgaagaacacacattactatgacaagcgctggtcctgtgaactcttcctgctggtgtccatcagcacctccgtgatcctcatgcagcacctgctgcctgccagctactgtgacctgctgcacaaggccgccgcccatctgggctgttggcagaaggtggacccagcgctgtgctccaacgtgctgcagcacccgtggactgaagaatgcatgtggccgcagggcgtgctggtgaagcacagcaagaacgtctacaaagccgtaggccactacaacgtggctatcccctctgacgtctcccacttccgcttccatttctttttcagcaaacccctgcggatcctcaacatcctcctgctgctggagggcgctgtcattgtctatcagctgtactccctaatgtcctctgaaaagtggcaccagaccatctcgctggccctcatcctcttcagcaactactatgccttcttcaagctgctccgggaccgcttggtattgggcaaggcctactcatactctgctagcccccagagagacctggaccaccgtttctcctgagccctggggtcacctcagggacagcgtccaggcttcagccaagggctccctggcaaggggctgttgggtagaagtggtggtgggggggacaaaagacaaaaaaatccaccagagctttgtatttttgttacgtactgtttctttgataattgatgtgataaggaaaaaagtcctatttttatactccc

SEQ ID NO: 7523 - DNA, 1710 bp, Homo sapiens
cggcgggagcgcgcggctgatacccgggactgggctgcggcggttagtcctctcccggccgccgtcgcctccgacatattgcccgcaggagctgcggcggcgaagcggagagcaccggggggaggagatgggaggacgaagaggtcccaacaggacatcttactgtcgaaatccgctctgtgagccgggatcctcggggggctctagtggaagccacacttccagtgcatcggtgaccagtgttcgttcccgcaccaggagcagttctggaacaggcctctccagccctcctctggccacccaaactgttgtgcctctacagcactgcaagatccccgagctgccagtccaggccagcattctgtttgagttgcagctcttcttctgccagctcatagcactcttcgtccactacatcaacatctacaagacagtgtggtggtatccaccttcccacccaccctcccacacctccctggcctctcagagggggaaggtctccctctttcgctccatcctgctgttcctcactcgcttcaccgttctcacggcaacaggctggagtctgtgccgatccctcatccacctcttcaggacctactccttcctgaacctcctgttcctctgctatccgtttgggatgtacattccgttcctgcagctgaattgcgacctccgcaagacaagcctcttcaaccacatggcctccatggggccccgggaggcggtcagtggcctggcaaagagccgggactacctcctgacactgcgggagacgtggaagcagcacacaagacagctgtatggcccggacgccatgcccacccatgcctgctgcctgtcacccagcctcatccgcagtgaggtggagttcctcaagatggacttcaactggcgcatgaaggaagtgctcgtcagctccatgctgagcgcctactatgtggcctttgtgcctgtctggttcgtgaagaacacacattactatgacaagcgctggtcctgtgaactcttcctgctggtgtccatcagcacctccgtgatcctcatgcagcacctgctgcctgccagctactgtgacctgctgcacaaggccgccgcccatctgggctgttggcagaaggtggacccagcgctgtgctccaacgtgctgcagcacccgtggactgaagaatgcatgtggccgcagggcgtgctggtgaagcacagcaagaacgtctacaaagccgtaggccactacaacgtggctatcccctctgacgtctcccacttccgcttccatttctttttcagcaaacccctgcggatcctcaacatcctcctgctgctggagggcgctgtcattgtctatcagctgtactccctaatgtcctctgaaaagtggcaccagaccatctcgctggccctcatcctcttcagcaactactatgccttcttcaagctgctccgggaccgcttggtattgggcaaggcctactcatactctgctagcccccagagagacctggaccaccgtttctcctgagccctggggtcacctcagggacagcgtccaggcttcagccaagggctccctggcaaggggctgttgggtagaagtggtggtgggggggacaaaagacaaaaaaatccaccagagctttgtatttttgttacgtactgtttctttgataattgatgtgataaggaaaaaagtcctatttttatactccc

SEQ ID NO: 7524 - DNA, 1490 bp, Homo sapiens
cgacatattgcccgcaggagctgcggcggcgaagcggagagcaccggggggaggagatgggaggacgaagaggtcccaacaggacatcttactgtcgaaatccgctctgtgagccgggatcctcggggggctctagtggaagccacacttccagtgcatcggtgaccagtgttcgttcccgcaccaggagcagttctggaacaggcctctccagccctcctctggccacccaaactgttgtgcctctacagcactgcaagatccccgagctgccagtccaggccagcattctgtttgagttgcagctcttcttctgccagctcatagcactcttcgtccactacatcaacatctacaagacagtgtggtggtatccaccttcccacccaccctcccacacctccctgcaggtttgggatgtacattccgttcctgcagctgaattgcgacctccgcaagacaagcctcttcaaccacatggcctccatggggccccgggaggcggtcagtggcctggcaaagagccgggactacctcctgacactgcgggagacgtggaagcagcacacaagacagctgtatggcccggacgccatgcccacccatgcctgctgcctgtcacccagcctcatccgcagtgaggtggagttcctcaagatggacttcaactggcgcatgaaggaagtgctcgtcagctccatgctgagcgcctactatgtggcctttgtgcctgtctggttcgtgaagaacacacattactatgacaagcgctggtcctgtgaactcttcctgctggtgtccatcagcacctccgtgatcctcatgcagcacctgctgcctgccagctactgtgacctgctgcacaaggccgccgcccatctgggctgttggcagaaggtggacccagcgctgtgctccaacgtgctgcagcacccgtggactgaagaatgcatgtggccgcagggcgtgctggtgaagcacagcaagaacgtctacaaagccgtaggccactacaacgtggctatcccctctgacgtctcccacttccgcttccatttctttttcagcaaacccctgcggatcctcaacatcctcctgctgctggagggcgctgtcattgtctatcagctgtactccctaatgtcctctgaaaagtggcaccagaccatctcgctggccctcatcctcttcagcaactactatgccttcttcaagctgctccgggaccgcttggtattgggcaaggcctactcatactctgctagcccccagagagacctggaccaccgtttctcctgagccctggggtcacctcagggacagcgtccaggcttcagccaagggctccctggcaaggggctgttgggtagaagtggtggtgggggggacaaaagacaaaaaaatccaccagagctttgtatttttgttacgtactgtttctttgataattgatgtgataaggaaaaaagtcctatttttatactcccaac

SEQ ID NO: 7525 - DNA, 2012 bp, Homo sapiens
atattgcccgcaggagctgcggcggcgaagcggagagcaccggggggaggagatgggaggacgaagaggtcccaacaggacatcttactgtcgaaatccgctctgtgagccgggatcctcggggggctctagtggaagccacacttccagtgcatcggtgaccagtgttcgttcccgcaccaggagcagttctggaacaggcctctccagccctcctctggccacccaaactgttgtgcctctacagcactgcaagatccccgagctgccagtccaggccagcattctgtttgagttgcagctcttcttctgccagctcatagcactcttcgtccactacatcaacatctacaagacagtgtggtggtatccaccttcccacccaccctcccacacctccctgggactgtcccacttcccttctcggggtcctgtcctactcctgtaggtaatttcctggcctgactcagctggaggccgatgaagaacttccatctgatcgacttcaacttgctgatggtgaccaccatcgttctgggccgccgcttcattgggtccatcgtgaaggaggcctctcagagggggaaggtctccctctttcgctccatcctgctgttcctcactcgcttcaccgttctcacggcaacaggctggagtctgtgccgatccctcatccacctcttcaggacctactccttcctgaacctcctgttcctctgctatccgtttgggatgtacattccgttcctgcagctgaattgcgacctccgcaagacaagcctcttcaaccacatggcctccatggggccccgggaggcggtcagtggcctggcaaagagccgggactacctcctgacactgcgggagacgtggaagcagcacacaagacagctgtatggcccggacgccatgcccacccatgcctgctgcctgtcacccagcctcatccgcagtgaggtggagttcctcaagatggacttcaactggcgcatgaaggaagtgctcgtcagctccatgctgagcgcctactatgtggcctttgtgcctgtctggttcgtgaagaacacacattactatgacaagcgctggtcctgtgaactcttcctgctggtgtccatcagcacctccgtgatcctcatgcagcacctgctgcctgccagctactgtgacctgctgcacaaggccgccgcccatctgggctgttggcagaaggtggacccagcgctgtgctccaacgtgctgcagcacccgtggactgaagaatgcatgtggccgcagggcgtgctggtgaagcacagcaagaacgtctacaaagccgtaggccactacaacgtggctatcccctctgacgtctcccacttccgcttccatgtgagtctcctccccggggaaggagggttggggcctgagagggtgggaggatctgcagggcaggaatgtgatgtcattgcaagagaaagctattttcagtatttccccaatccaaaggaagacagtgcacacatgtagcacaaggacagccatataaattgtcacttaataactgcagctcggccgggcatggtggctcacgcctgtaatcccagcactttgggagaccaaggcagacagatcacctgaggtcaggagttcaagaccagaccagcctggtcaacatggtgaaacctcgtctccactaaaaatacaaaaattagccaggtatggtggcgggcgcctgtaatcccagctactcgggaggctgaggagggagaaccacttgaactcaggagacggaggttgcagtgagccgagatcatgccactgcactccagcctgggcaacagagcaagactcattctcaaaaataaataaataaataactgcagctcatttggttgtagatctttgagaacattggacagagggagagaagatgatacagtaaaagaaggggctcttggcagtgaaagacaatactgtcttcatttgttactgtgtgccaggcatgtcgttaagcactctccatgtacctt

SEQ ID NO: 7526 - DNA, 690 bp, Homo sapiens
ggctgatacccgggactgggctgcggcggttagtcctctcccggccgccgtcgcctccgacatattgcccgcaggagctgcggcggcgaagcggagagcaccggggggaggagatgggaggacgaagaggtcccaacaggacatcttactgtcgaaatccgctctgtgagccgggatcctcggggggctctagtggaagccacacttccagtgcatcggtgaccagtgttcgttcccgcaccaggagcagttctggaacaggcctctccagccctcctctggccacccaaactgttgtgcctctacagcactgcaagatccccgagctgccagtccaggccagcattctgtttgagttgcagctcttcttctgccagctcatagcactcttcgtccactacatcaacatctacaagacagtgtggtggtatccaccttcccacccaccctcccacacctccctggcctctcagagggggaaggtctccctctttcgctccatcctgctgttcctcactcgcttcaccgttctcacggcaacaggctggagtctgtgccgatccctcatccacctcttcaggacctactccttcctgaacctcctgttcctctgctatccgtttgggatgtacattccgttcctgcagctgaattgcgacctccgcaagacaagcctcttcaaccacatgg

SEQ ID NO: 7527 - DNA, 1156 bp, Homo sapiens
agtcctctcccggccgccgtcgcctccgacatattgcccgcaggagctgcggcggcgaagcggagagcaccggggggaggagatgggaggacgaagaggtcccaacaggacatcttactgtcgaaatccgctctgtgagccgggatcctcggggggctctagtggaagccacacttccagtgcatcggtgaccagtgttcgttcccgcaccaggagcagttctggaacaggcctctccagccctcctctggccacccaaactgttgtgcctctacagcactgcaagatccccgagctgccagtccaggccagcattctgtttgagttgcagctcttcttctgccagctcatagcactcttcgtccactacatcaacatctacaagacagtgtggtggtatccaccttcccacccaccctcccacacctccctgaacttccatctgatcgacttcaacttgctgatggtgaccaccatcgttctgggccgccgcttcattgggtccatcgtgaaggaggtttgggatgtacattccgttcctgcagctgaattgcgacctccgcaagacaagcctcttcaaccacatggcctccatggggccccgggaggcggtcagtggcctggcaaagagccgggactacctcctgacactgcgggagacgtggaagcagcacacaagacagctgtatggcccggacgccatgcccacccatgcctgctgcctgtcacccagcctcatccgcagtgaggtggagttcctcaagatggacttcaactggcgcatgaaggaagtgctcgtcagctccatgctgagcgcctactatgtggcctttgtgcctgtctggttcgtgaagaacacacattactatgacaagcgctggtcctgtgaactcttcctgctggtgtccatcagcacctccgtgatcctcatgcagcacctgctgcctgccagctactgtgacctgctgcacaaggccgccgcccatctgggctgttggcagaaggtggacccagcgctgtgctccaacgtgctgcagcacccgtggactgaagaatgcatgtggccgcagggcgtgctggtgaagcacagcaagaacgtctacaaagccgtaggccactacaacgtggctatcccctctgacgtctcccacttccg

SEQ ID NO: 7528 - DNA, 984 bp, Homo sapiens
tttttaacttgtttaactaagggtggctcctgttgagaggtgacagcgtgttggcagccctcgcagccctcgcttgctcttggtgcctcctcagcctcggcgcccactctggccgcacttgaggagcccttcagcccgctgctgcactgtgggagtcccttcctgggatggccgaggccggagccggctccctcagccttccgggaggaaaagccatggagacttcagcatcctcctcccagcctcaggacaacagtcaagtccacagagaaacagaagatgtagactatggagagacagatttccacaagcaagatgggaaggctggactcttttcccaagaacaatatgagagaaacaagtcttcttcctcctcctcctcttcctcctcatcctcctcatcttcttcatcctcctcctcctcagagagcaatgatgaggaccagcaacccagagcaaccggaaaacatcgacggagcctgggggctggatacccccacgggaacggctcacccggtcctgggcatggggagcctgacgttttgaaggatgagcttcaactctatggagatgctcctggagaggtggtaccctctggggaatcaggactccgaaggagaggctctgacccagcaagtggagaagtggaggcctctcagttaagaagactgaatataaagaaagatgatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccaca

SEQ ID NO: 7529 - DNA, 2308 bp, Homo sapiens
agagcttggtacagccaagggtggcacagctgcccccatttcactgtctcctggagtctgaaggcatggctgtggccctgaggcaggaccaggcatgtagctgccccacctgcccctccgcagtgttgtagggaagagtcaagtcagacaggaaggcctggggctgatagcaccagcaggaaggaatgccatcccagtgagcgagtggggcccagggacaacgtcacggtagtcccgccctccttgctgtcacaggtgcagcctgtcctctccttcccctgaccagcccagcatccacatagtctacacagagctccccttgctgcccagacaagctgaaggaccacaggaaaagccatggagacttcagcatcctcctcccagcctcaggacaacagtcaagtccacagagaaacagaagatgtagactatggagagacagatttccacaagcaagatgggaaggctggactcttttcccaagaacaatatgagagaaacaagtcttcttcctcctcctcctcttcctcctcatcctcctcatcttcttcatcctcctcctcctcagagagcaatgatgaggaccagcaacccagagcaaccggaaaacatcgacggagcctgggggctggatacccccacgggaacggctcacccggtcctgggcatggggagcctgacgttttgaaggatgagcttcaactctatggagatgctcctggagaggtggtaccctctggggaatcaggactccgaaggagaggctctgacccagcaagtggagaagtggaggcctctcagttaagaagactgaatataaagaaagatgatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccacaagggcagagcagcattctgagagacgcacaggagaccaagccagaccaataaacagaacacttttccttccatgtggtctgaatgttggcaccagcccgggcaggggcatctcatttgggcagtactgctgtgcaacccagctgcaaggatggaaggcagagggtgggtgtggggcctgaggcttcacagtacctggaccagcaggaagattctgggaggtcactgctctcagaggacagcaagggaccctgagctctgcaagctgtgatctgtctgggttcatggtttttctcaaatcccaggctatctgcatgcgctctcaggtgctaccgagccatcctgggagagatggatggtccactgctttgaggcagggagccatcgggctggggccccttggtgaacctgatgcaggtaagatgctgaggactaaaaccattttttttgcacccaaaaaaaaaggcaggaaaatgatcatcagaaactaaatggcagccaggcatgggggctcacaactgtaatcctcgcactttgggaggctcaggctaagggtcgcttgaagctgagagttcaagaccaacctgggcaacatagtgagacccccatctctacaatttttttttaatgaccaaatgtggcggtacatacctgtacatacctgcggttccagctactcaagaggctgaggcaggaggactgcttgagcccaggagttcagggctgcagtgaggtacgatcaagccactgcactccagcctgggcgacagagcaagatcgtttctctaaaattaaaaaaaaaaaaaaaagacaaataaaaattgcatgtatttgtagtgtacaacatgttttgaaatatgtggaatggctaaatcaagctaattaacatatgtatccctcacataccctttttttatgatgagaacagtaaaaacctactgtcagcaatttgcaaagtatacaatacattgttattaactatggtcaccatgctatgtgattgatatcctgaacttgaactgagttcttgatggtcacagacatgctgttctcaaaactcagaagggtaacttctgaggttttgatttcaagtacttgtatgtaacctaatttaacgggagcccagagtgcacagatcagatatttattaaacatataaataaaacacagttttcacgatagaa

SEQ ID NO: 7530 - DNA, 979 bp, Homo sapiens
aacttgtttaactaagggtggctcctgttgagaggtgacagcgtgttggcagccctcgcagccctcgcttgctcttggtgcctcctcagcctcggcgcccactctggccgcacttgaggagcccttcagcccgctgctgcactgtgggagtcccttcctgggatggccgaggccggagccggctccctcagccttccgggaggaaaagccatggagacttcagcatcctcctcccagcctcaggacaacagtcaagtccacagagaaacagaagatgtagactatggagagacagatttccacaagcaagatgggaaggctggactcttttcccaagaacaatatgagagaaacaagtcttcttcctcctcctcctcttcctcctcatcctcctcatcttcttcatcctcctcctcctcagagagcaatgatgaggaccagcaacccagagcaaccggaaaacatcgacggagcctgggggctggatacccccacgggaacggctcacccggtcctgggcatggggagcctgacgttttgaaggatgagcttcaactctatggagatgctcctggagaggtggtaccctctggggaatcaggactccgaaggagaggctctgacccagcaagtggagaagtggaggcctctcagttaagaagactgaatataaagaaagatgatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccaca

SEQ ID NO: 7531 - DNA, 1547 bp, Homo sapiens
gaccagcccagcatccacatagtctacacagagctccccttgctgcccagacaagctgaaggaccacaggaaaagccatggagacttcagcatcctcctcccagcctcaggacaacagtcaagtccacagagaaacagaagatgtagactatggagagacagatttccacaagcaagatgggaaggctggactcttttcccaagaacaatatgagagaaacaagtcttcttcctcctcctcctcttcctcctcatcctcctcatcttcttcatcctcctcctcctcaggtcctgggcatggggagcctgacgttttgaaggatgagcttcaactctatggagatgctcctggagaggtggtaccctctggggaatcaggactccgaaggagaggctctgacccagcaagtggagaagtggaggcctctcagttaagaagactgaatataaagaaagatgatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccacaagggcagagcagcattctgagagacgcacaggagaccaagccagaccaataaacagaacacttttccttccatgtggtctgaatgttggcaccagcccgggcaggggcatctcatttgggcagtactgctgtgcaacccagctgcaaggatggaaggcagagggtgggtgtggggcctgaggcttcacagtacctggaccagcaggaagattctgggaggtcactgctctcagaggacagcaagggaccctgagctctgcaagctgtgatctgtctgggttcatggtttttctcaaatcccaggctatctgcatgcgctctcaggtgctaccgagccatcctgggagagatggatggtccactgctttgaggcagggagccatcgggctggggccccttggtgaacctgatgcaggtaagatgctgaggactaaaaccattttttttgcacccaaaaaaaaaggcaggaaaatgatcatcagaaactaaatggcagccaggcatgggggctcacaactgtaatcctcgcactttgggaggctcaggctaagggtcgcttgaagctgagagttcaagaccaacctgggcaacatagtgagacccccatctctacaatttttttttaatgaccaaatgtggcggtacatacctgtacatacctgcggttccagctactcaagaggctgaggcaggaggactgcttgagcccaggagttcagggctgcagtgaggtacgatcaagccactgcactccagcctgggcgacagagcaagatcgtttctctaaaatt

SEQ ID NO: 7532 - DNA, 1785 bp, Homo sapiens
ctgtcctctccttcccctgaccagcccagcatccacatagtctacacagagctccccttgctgcccagacaagctgaaggaccacaggaaaagccatggagacttcagcatcctcctcccagcctcaggacaacagtcaagtccacagagaaacagaagatgtagactgtcctgggcatggggagcctgacgttttgaaggatgagcttcaactctatggagatgctcctggagaggtggtaccctctggggaatcaggactccgaaggagaggctctgacccagcaagtggagaagtggaggcctctcagttaagaagactgaatataaagaaagatgatgagtttttccatttcgtcctcctgtgctttgccatcggggccttgctggtgtgttatcactattacgcagactggttcatgtctcttggggtcggcctgctcaccttcgcctccctggaaaccgttggcatctacttcggactagtgtaccgtatccacagcgtcctccaaggcttcatccccctcttccagaagtttaggctgacagggttcaggaagactgactgaggccacttccaggtgggcagcagaggcaggccccagtgtgaccaccactgcgacccctgagcccacaagggcagagcagcattctgagagacgcacaggagaccaagccagaccaataaacagaacacttttccttccatgtggtctgaatgttggcaccagcccgggcaggggcatctcatttgggcagtactgctgtgcaacccagctgcaaggatggaaggcagagggtgggtgtggggcctgaggcttcacagtacctggaccagcaggaagattctgggaggtcactgctctcagaggacagcaagggaccctgagctctgcaagctgtgatctgtctgggttcatggtttttctcaaatcccaggctatctgcatgcgctctcaggtgctaccgagccatcctgggagagatggatggtccactgctttgaggcagggagccatcgggctggggccccttggtgaacctgatgcaggtaagatgctgaggactaaaaccattttttttgcacccaaaaaaaaaggcaggaaaatgatcatcagaaactaaatggcagccaggcatgggggctcacaactgtaatcctcgcactttgggaggctcaggctaagggtcgcttgaagctgagagttcaagaccaacctgggcaacatagtgagacccccatctctacaatttttttttaatgaccaaatgtggcggtacatacctgtacatacctgcggttccagctactcaagaggctgaggcaggaggactgcttgagcccaggagttcagggctgcagtgaggtacgatcaagccactgcactccagcctgggcgacagagcaagatcgtttctctaaaattaaaaaaaaaaaaaaaagacaaataaaaattgcatgtatttgtagtgtacaacatgttttgaaatatgtggaatggctaaatcaagctaattaacatatgtatccctcacataccctttttttatgatgagaacagtaaaaacctactgtcagcaatttgcaaagtatacaatacattgttattaactatggtcaccatgctatgtgattgatatcctgaacttgaactgagttcttgatggtcacagacatgctgttctcaaaactcagaagggtaacttctgaggttttgatttcaagtacttgtatgtaacctaatttaacgggagcccagagtgcacagatcagatatttattaa

SEQ ID NO: 7533 - DNA, 2827 bp, Homo sapiens
agtgaacgtgctccgcgggctcagtccgcccgccgctgcgtcccggagtgcaagtgagcttctcggctgccccgcgggccggggtgcggagccgacatgcgcccgcttctcggcctccttctggtcttcgccggctgcaccttcgccttgtacttgctgtcgacgcgactgccccgcgggcggagactgggctccaccgaggaggctggaggcaggtcgctgtggttcccctccgacctggcagagctgcgggagctctctgaggtccttcgagagtaccggaaggagcaccaggcctacgtgttcctgctcttctgcggcgcctacctctacaaacagggctttgccatccccggctccagcttcctgaatgttttagctggtgccttgtttgggccatggctggggcttctgctgtgctgtgtgttgacctcggtgggtgccacatgctgctacctgctctccagtatttttggcaaacagttggtggtgtcctactttcctgataaagtggccctgctgcagagaaaggtggaggagaacagaaacagcttgttttttttcttattgtttttgagacttttccccatgacaccaaactggttcttgaacctctcggccccaattctgaacattcccatcgtgcagttcttcttctcagttcttatcggtttgatcccatataatttcatctgtgtgcagacagggtccatcctgtcaaccctaacctctctggatgctcttttctcctgggacactgtctttaagctgttggccattgccatggtggcattaattcctggaaccctcattaaaaaatttagtcagaaacatctgcaattgaatgaaacaagtactgctaatcatatacacagtagaaaagacacatgatctggattttctgtttgccacatccctggactcagttgcttatttgtgtaatggatgtggtcctctaaagcccctcattgtttttgattgccttctataggtgatgtggacactgtgcatcaatgtgcagtgtcttttcagaaaggacactctgctcttgaaggtgtattacatcaggttttcaaaccagccctggtgtagcagacactgcaacagatgcctcctagaaaatgctgtttgtggccgggcgcggtggctcacgcctgtaatcccagcactttgggaggccgaggccggtgattcacaaggtcaggagttcaagaccagcctggccaagatggtgaaatcctgtctctaataaaaatacaaaaattagccaggcgtggtggcaggcacctgtaatcccagctactcgggaggctgaggcaggagaattgcttgaaccaaggtggcagaggttgcagtaagccaagatcacaccactgcactccagcctgggtgatagagtgagacactgtcttgacaaaaaaaaaaaaaaaaagagaaaaaaagaaaatgctgtttgtattttgtggtctaataaggagttcgggatagcctgttgtatttgcctcatgccagcccctgagctgccttgggagaagatgctgattgtccttgtccagagtactgcttttgcagagtgacaggctgctgggacagatgtcctcctgttgcatctttgtggatgtttagtaccaatgatgacacgggaactcacatcactgacaccgctcttcatcttctgttagtctcttgaagagcatttttttgtacttctttgctgatgacctacctcttcataagccaagtgaaacaagttgacgaactgcctaggacttccacgtgttgctcacatacatgatgatttctgtcacgctcttgtgttcagacacactgacattaccatgtatgtcagacctccttatgatcgcatgtcctgacagttaagctgattgcaaacagactattaaatatgaatggagcaaacgctgtatgtcatggatatgttctggagaaattcttacccatctggatggggcagggcccttgactcacctgaatcatgaccaggcaaacattttatctgtcctttctgcaggaatccgttctgtgtcatgctaggagaatgggttcagtatatggggccatcaggcagtataccctctgaatgtttttcattgttgtatttgcttagagtaactaaacaattgtatcttttaatttatcttttaattcaaagaggaaaccttggcttctgataactttgttgtgttgtatcttaatggcctatagctgtcattacttcctgtagctgcagtacagaattgttacagacctggattaatgcttccaaagacagaaggaccttggcacctaaactgaccagccctgtgatcctgcaccccacaggagtaactcatcaggacttaccagactgctgcttttgggcatcatctgctgggttgatgatttggtttggccaagagtcttgccaagactttaatctatgcctcttgttctacatgaattcttgggaattactcacgttccataggaagagtgcatccccaggtgatggtttttggttatggtatgatcctttcacaccgaggatttcattgtttaaaacgtgtttctttaaaagaagccttgataacgagagtgggggaaggaggcagcagactttgaagactgtggcctttggtgttctggagtagggggagggaaggagaaacatgttttccacatcatcgcaagtgtgtgccctttgccccttttcaggatccttagagttgcctccctccctccaccccgacagttttgcaataatgtgccttatcagttgtgagtttacaggtgaagcaatttcccaaataaatggatgtaagtgttc

SEQ ID NO: 7534 - DNA, 1443 bp, Homo sapiens
tcgggtgaggaggtcgcgccggaagtggctctagccgtggcgcttcggcgtagtaaggagcctgcaacagagttttgttgtttagggggcgcggcaccgcaccgctcccttcaccttgcagcagccatggcgaaaggcagagtcgccgaacgatcgcagttgggcgctcaccacacgacccccgtgggggacggggcagcggggacgcggggtctcgcggcgcctggcagcagagaccaccagaaggaaaaatcctgggtagaagctggatcagcaagaatgtcactccttatattggtgtccattttcttatctgcagcttttgttatgtttttggtatataaaaattttcctcagcttagtgaagaagaaagagtgaatatgaaggttcccagagatatggatgatgccaaggctctaggaaaagttttatccaaatacaaggacaccttttatgttcaagtacttgtagcttattttgctacatatattttcttgcaaacatttgctattccaggctctatatttctcagtatactctcagggtttctttatccctttccactagccttatttcttgtttgtttgtgttctggacttggtgcctctttctgttatatgctttcctatttagttgggagaccagttgtatacaaatacctaacagagaaagcagtaaaatggtcacagcaggttgaacgtcatagagaacatctcattaactacattatatttttgagaataacaccatttctgcctaattggtttattaatatcacatctcctgtgataaacgtgccattgaaagttttttttattggtacttttctaggtgtcgcacctccttcttttgtagccattaaggcaggaacaacactgtatcaacttacaacagcaggagaagctgtttcctggaactcaatatttattctgatgatcttggctgttctttctattctgccagccatcttccaaaaaaaactaaagcagaaatttgagtaaaaataatcatctgatttttagttttgctgtcatcaccatctcaggattaacagctgcgactttaggtggggtatattttcttctcctaagagaatagacagtttttccagattcatcatcattgactgtcaagaaaggacccttcagcaaggctgtaccctcaatgcagttgatggcctgtcttcacggatttacagacttggcctgatgcccatgtaaattcaagctttggcttgtggtaacaaccacaagaagacaagcatctgtggtgcggaggcaagcaggctaactaggagttgacaagctaagaaagtgaaactgttctttcttagttaactgtctttctctggagctctgttattttgagtataatatttccatgacacttagtaaatgcaagctaaaatgtaataataataaattgtattggagaaacctaaa

SEQ ID NO: 7535 - DNA, 3968 bp, Homo sapiens
tgctctcgccccagcgcccggcggccacctctttcccgcgggcgggccggggcggggcactgaagggggcggtccaggaccctgacttgtctcgcggttactgggccggcgcgagcacgcgaggctcgggggcggcacggggcggggtttagcctgtggtgggcgctgcgggtgtttgcaggaggttgcagtactcgctgggctgaggtcgtctcgggtgaggaggtcgcgccggaagtggctctagccgtggcgcttcggcgtagtaaggagcctgcaacagagttttgttgtttagggggcgcggcaccgcaccgctcccttcaccttgcagcagccatggcgaaaggcagagtcgccgaacgatcgcagttgggcgctcaccacacgacccccgtgggggacggggcagcggggacgcggggtctcgcggcgcctggcagcagagaccaccagaaggaaaaatcctgggtagaagctggatcagcaagaatgtcactccttatattggtgtccattttcttatctgcagcttttgttatgtttttggtatataaaaattttcctcagcttagtgaagaagaaagagtgaatatgaaggttcccagagatatggatgatgccaaggctctaggaaaagttttatccaaatacaaggacaccttttatgttcaagtacttgtagcttattttgctacatatattttcttgcaaacatttgctattccaggctctatatttctcagtatactctcagggtttctttatccctttccactagccttatttcttgtttgtttgtgttctggacttggtgcctctttctgttatatgctttcctatttagttgggagaccagttgtatacaaatacctaacagagaaagcagtaaaatggtcacagcaggttgaacgtcatagagaacatctcattaactacattatatttttgagaataacaccatttctgcctaattggtttattaatatcacatctcctgtgataaacgtgccattgaaagttttttttattggtacttttctaggtgtcgcacctccttcttttgtagccattaaggcaggaacaacactgtatcaacttacaacagcaggagaagctgtttcctggaactcaatatttattctgatgatcttggctgttctttctattctgccagccatcttccaaaaaaaactaaagcagaaatttgagtaaaaataatcatctgatttttagttttgctgtcatcaccatctcaggattaacaggtgcatccatttatgttttaaaatcacctcttcagtaattaaacaaggaatttgtaaaataaaatttcctatcagatagttaaagtaatacatttaagtgacaaggggagaagaaagtaaaaatggaaattggtatactgtgaaaagtgctatcaatagttaaggtagacatcttagacatcttataaattattataccaagggtagctgtagataatagtagtgtggtaggaaattgttgatccagctaattcattcaatttaattgaatattttttatctttaataactaaaatagatatttttaaattctagattttttaaagtagtgttgcaggttttgttaatgttaggcttttttcagagcataaactggaaaacttaaaaagagatttacattttcttcctctttttttttttttttttttttctgttttgagacggagtctagctctgccgcccaggctggagtgcagtggcgcgatctccactcactgcaagctccacctcctgggttcacgccattctcctgtctcagcctcctgagtagctgggactacaggcgcccgccaccatgcccagctaatttttttgtatttttagtagagacggggtttcaccgtgttagccaggatggtctcgatctcctgacctcgtgatctgcccgccttggcctcccaaagtgctgggattacaggcgtgagccaccgcgcctggcccattttcttcctcttttgaggtaatggatttgtttggagatggcatgttagtagacgactgaatatggaaaggatatcaagttatctattttgttaattttatttttgttttttatcatctagatttttatcatggattagtctgaaatttaaagttctggccagtcggttttctttcatcttgtagtttttacagtatttccactgtgcatatgcaaaatgggtattacataactgtatcatatttggtattgataattttttttttttttgagacggagtcttgctgttgcccaggctggagtggagtgcgtggtgtgatctcggctcactgcaaactccgcctcctgggttcaagcgattctcctggcccagcctcctgagtagctgggattacaggtgtgtgccaccgtgcccagctaatttttgtgtttttagtagagacggggtttcaccatgttggccgggctggtcttgaactcctgacctcaggctatatgcccacttccacctcccaaagtgctgggattacaggcatgagccactgtgcccagcctggtattgataatttatattcagataatttgttatggctctttaatatcccacaaggggctctaaaaagcaaacattcaagagtatgtagtttttagacattaagttaattattttaaacagtgacagcaaaacacaagtgattaaatatagtttatttgttccaatgactaaattttacctcatttattaatctggtcattaaggaatatatttaataatattatgtaattattctttttatgcatgatacacctagaaaaatgccttttgtttctattgatggctttgttgtttggagctacttttgattacttattgcagtttcccaatttagtctttactttatctaactcacaaagtaaaattaactgatcacatggcaactactgtatttaaatagttctggaaaaatgaaagtgctttttgctgcttggtaaatgggtaatgcccttgattccttgactgtaggacatagctgatctaaagtactctgtcagttttaccttcacccatgactgttattagttgtcaaagttgaaaagtactttagctgtgagaaatccttgtatgtttttattataagaggtataatcatcctcaaagcctgtttttattacatgatgtggactgattattttttctatcacagtgttaacagatggattttattgtaaatacaaagaaaacatattgattattgtagtattcttatgtcacctggccttttgcgtgagattatttattatttctagcaaggctttcttcctttcttattgcccagagactgactgatacatcttttgttatttttacacataaattaaacatagcctttttggacaaattcactaaatattaatgtataaaatgtaattgagtaaatttttatcagaattttaaaaataaaagagcttagactcagtagaactcagtagaagcttcactatttactccagcgtgtgtaaattgtacttactctattctcagagtatatttactgtccttaccattgattctttccctttgctaatttttttttttgttaatggtagctgcgactttaggtggggtatattttcttctcctaagagaatagacagtttttccagattcatcatcattgactgtcaagaaaggacccttcagcaaggctgtaccctcaatgcagttgatggcctgtcttcacggatttacagacttggcctgatgcccatgtaaattcaagctttggcttgtggtaacaaccacaagaagacaagcatctgtggtgcggaggcaagcaggctaactaggagttgacaagctaagaaagtgaaactgttctttcttagttaactgtctttctctggagctctgttattttgagtataatatttccatgacacttagtaaatgcaagctaaaatgtaataataataaattg

SEQ ID NO: 7536 - DNA, 723 bp, Homo sapiens
tttagcctgtggtgggcgctgcgggtgtttgcaggaggttgcagtactcgctgggctgaggtcgtctcgggtgaggaggtcgcgccggaagtggctctagccgtggcgcttcggcgtagtaaggagcctgcaacagagttttgttgtttagggggcgcggcaccgcaccgctcccttcaccttgcagcagccatggcgaaaggcagagtcgccgaacgatcgcagttgggcgctcaccacacgacccccgtgggggacggggcagcggggacgcggggtctcgcggcgcctggcagcagagaccaccagaaggaaaaatcctgggtagaagctggatcagcaagaatgtcactccttatattggtgtccattttcttatctgcagcttttgttatgtttttggtatataaaaattttcctcagcttagtgaagaagaaagagtgaatatgaaggttcccagagatatggatgatgccaaggctctaggaaaagttttatccaaatacaaggacaccttttatgttcaagtacttgtagcttattttgctacatatattttgtatccttttaactgaaaaaatgttttctaattttgttcaagaaaaagtgtaaaaggtctgctcttcatttatacataactattttccttttaaaatttgttattgcagtgtgacaatattaaataattgaaaaattaaaatggaaaaaaattatcactttaa

SEQ ID NO: 7537 - DNA, 1026 bp, Homo sapiens
cggcgcgcgctctgccctgcgggcagcgggtgccaggcacggtgtcagcaggcaacatggccgagaggccggggcctccgggcggcgccgtgtccgcgaccgcgtaccctgacacccccgcggaattccctccgcacctccaggcgggtgcgatgcggcgccgcttttggggcgtattcaactgtctgtgcgccggcgcgttcggggccctggccgccgcctccgccaagctggccttcggcagcgaggtgagcatgggtttatgcgtcttaggcattattgtgatggcgagcaccaattctctgatgtggaccttctttagccggggcctcagtttctccatgtcttcagccattgcatctgtcacagtgactttttcaaatatcctcagctcggccttcctgggctatgtgctgtatggagagtgccaggaggtcttgtggtggggaggagtgttccttattctctgcggactcaccctaatccacaggaagctcccacccacctggaagccccttccacacaagcagcagtagcaccacttggctagacggaccagctggaaagatcatgatggtggcccagccttgggatgtcatgtgggactgtatcctagggcgatccagttgtgcagccttctgaccatcagccaagggaagcaggcctctgatggagcaggctctggctctgtaaggagaggtgcagctgcagcagtgttctaccggaagtgttttgatcatctgtacagtgctttggattcttcctcccaggcctaccccagtgagccttcgcagatgctggagatcctggggttggtctgctttgtgtatggtacttgaaaccacgctgtaattattgtcctgttgccaaacaaaagccagtcatgtaactctagaagcagtgactggtggggctttctgacagttccatgctgatgtatcaggccatctgtgtcatgcttatgtattatggcaagaagaggaaaactggattaataaatacgttttttgtaagttaaaactacca

SEQ ID NO: 7538 - DNA, 1567 bp, Homo sapiens
gaagcacatctggacagctgtgcggcctcctcgcgggccgacgtcagccgagcacgtcccccacgtcctctccttctcgccacttattatttattcgttttcccaaagaagcgactagggacccaagtttaaaaattcctccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgtattttggtgcaga

SEQ ID NO: 7539 - DNA, 1910 bp, Homo sapiens
gcgggccgacgtcagccgagcacgtcccccacgtcctctccttctcgccacttattatttattcgttttcccaaagaagcgactagggacccaagtttaaaaattcctccccccacccaatgcgagacgtggccagatcccatccaacacacggtttaattttcatggggctctgggatcaaaagaacagaaacagcaacaacaaaagcccagccgctgtctgattttaagctggcaaagtgggaaaaataaagtgttgagtaaacagaccaagttggggtgctatgggccaggtttctgaagttgggtggaggtggaggccaccggcagtgagtacaacgcccaggggaagcatgtgagtgggaggaagaaaagagagttttctggagctgttgcaatgtgtatgctggtgaaatctacttgagcattaagcagtatctcccagcattgttagctactgagtggcacatcttcagtacgcatgattcgtgggggactcaggcagaggtaaaagtgtgaaacttttcagcattacctaagaagcaaaggctcaattttggctgcttcattcttatctcttctgccacagttctaacgtgcctgatctactgagaccaaggatgaccaatgactcagaagggaaaatgggatttaaacacccaaagatcatggggaatttcagaggtcatgccctccctggaaccttcttttttattattggtctttggtggtgtacaaagagtattctgaagtatatctgcaaaaagcaaaagcgaacctgctatcttggttccaaaacattattctatcgattggaaattttggagggaattacaatagttggcatggctttaactggcatggctggggagcagtttattcctggagggccccatctgatgttatatgactataaacaaggtcactggaatcaactcctgggctggcatcatttcaccatgtatttcttctttgggctgttgggtgtggcagatatcttatgtttcaccatcagttcacttcctgtgtccttaaccaagttaatgttgtcaaatgccttatttgtggaggcctttatcttctacaaccacactcatggccgggaaatgctggacatctttgtgcaccagctgctggttttggtcgtctttctgacaggcctcgttgccttcctagagttccttgttcggaacaatgtacttctggagctattgcggtcaagtctcattctgcttcaggggagctggttctttcagattggatttgtcctgtatccccccagtggaggtcctgcatgggatctgatggatcatgaaaatattttgtttctcaccatatgcttttgttggcattatgcagtaaccattgtcatcgttggaatgaattatgctttcattacctggttggttaaatctagacttaagaggctctgctcctcagaagttggacttctgaaaaatgctgaacgagaacaagaatcagaagaagaaatgtgactttgatgagcttccagtttttctagataaaccttttcttttttacattgttcttggttttgtttctcgatcttttgtttggagaacagctggctaaggatgactctaagtgtactgtttgcatttccaatttggttaaagtatttgaatttaaatattttctttttagctttgaaaatattttgggtgatactttcattttgcacatcatgcacatcatggtattcaggggctagagtgatttttttccagattatctaaagttggatgcccacactatgaaagaaatatttgttttatttgccttatagatatgctcaaggttactgggcttgctactatttgtaactccttgaccatggaattatacttgtttatcttgttgctgcaatgagaaataaatgaatgtatgta

SEQ ID NO: 7540 - DNA, 2234 bp, Homo sapiens
cctggagctgcacctgcttctgggcggacgcacttggcgcgcggcgcgggctgcagacggctgcgaggcgctgggcacaggtgtcctgatggcaaatttcaagggccacgcgcttccagggagtttcttcctgatcattgggctgtgttggtcagtgaagtacccgctgaagtactttagccacacgcggaagaacagcccactacattactatcagcgtctcgagatcgtcgaagccgcaattaggactttgttttccgtcactgggatcctggcagagcagtttgttccggatgggccccacctgcacctctaccatgagaaccactggataaagttaatgaattggcagcacagcaccatgtacctattctttgcagtctcaggaattgttgacatgctcacctatctggtcagccacgttcccttgggggtggacagactggttatggctgtggcagtattcatggaaggtttcctcttctactaccacgtccacaaccggcctccgctggaccagcacatccactcactcctgctgtatgctctgttcggagggtgtgttagtatctccctagaggtgatcttccgggaccacattgtgctggaacttttccgaaccagtctcatcattcttcagggaacctggttctggcagattgggtttgtgctgttcccaccttttggaacacccgaatgggaccagaaggatgatgccaacctcatgttcatcaccatgtgcttctgctggcactacctggctgccctcagcattgtggccgtcaactattctcttgtttactgccttttgactcggatgaagagacacggaaggggagaaatcattggaattcagaagctgaattcagatgacacttaccagaccgccctcttgagtggctcagatgaggaatgagccgagatgcggagggcgcagatgtcccactgcacagctggaatgaatggagttcatcccctccacctgaatgcctgctgtggtctgatcttaagggtctatatatttgcacctcctcattcaacacagggctggaggttctacaacaggaaatcaggcctacagcatcctgtgtatcttgcagttgggatttttaaacatactataaagtctgtgttggtatagtacccttcataaggaaaaatgaagtaatgcctataagtagcaggcctttgtgcctcagtgtcaagagaaatcaagagatgctaaaagctttacaatggaagtggcctcatggatgaatccggggtatgagcccaggagaacgtgctgcttttggtaacttatccctttttctcttaagaaagcaggtactttcttattagaaatatgttagaatgtgtaagcaaacgacagtgcctttagaattacaattctaacttacatattttttgaaagtaaaataattcacaagctttggtattttaaaattattgttaaacatatcataactaatcataccagggtactgcaataccactgtttataagtgacaaaattaggccaaaggtgatttttttttaaatcaggaagctggttactggctctactgagagttggagccctgatgttctgattcttcaaagtcaccctaaaagaagatctgacaggaaagctgtataatgagatagaaaaacgtcaggtatggaaggctttcagttttaatatggctgaaagcaaaggataacgaattcagaattagtaatgtaaaatcttgataccctaatcttgcttctggatctgttctttttttaaaaaaacttccttcaccgcgcctataatcctagcactttgggaggccgaggcaggcagatcacggggtcaggagatcaagaccatcctggctaacatggtgaaaccccgtctctactgaaaatacaaaaaattagccgggtgtggtggcgggcgcctgtagttccagctactcgggaggctgaggcaagagaatggcatgaacccggtaggggagcttgcagtgagcccagatcatgccactgtactccagcctaggtgacagagcaagactctgtctcaaaaacaagcaaacagacttccttcaacaaatatttattaaatatccactttgcaacagcactgaaatggctgtaaggactcctgagatatgtgtccagcaaggagtttacagtcaaacaggagagacatgcctgtagttacatccagtgtgatgggtgctgagaggcaagtacaaaccacgatg

SEQ ID NO: 7541 - DNA, 1639 bp, Homo sapiens
tttttttatgtttagtagagacagggtttcaccatgtttgtcaggcttatctcgaactcctgacctcaggtgatctgcctgcctcgccctcccaaagtgctgggattacaggcgtgagccaccgcacctggcctctcatgtttttctataagcagttaagagaagccacacagcatcctgaacactttgctttctatctcttctgccaaatatcctaggtcatcattcttaagttctgccctccatgaagtcctaggaaacgacataattcaggtgtcctgatggcaaatttcaagggccacgcgcttccagggagtttcttcctgatcattgggctgtgttggtcagtgaagtacccgctgaagtactttagccacacgcggaagaacagcccactacattactatcagcgtctcgagatcgtcgaagccgcaattaggactttgttttccgtcactgggatcctggcagagcagtttgttccggatgggccccacctgcacctctaccatgagaaccactggataaagttaatgaattggcagcacagcaccatgtacctattctttgcagtctcaggaattgttgacatgctcacctatctggtcagccacgttcccttgggggtggacagactggttatggctgtggcagtattcatggaaggtttcctcttctactaccacgtccacaaccggcctccgctggaccagcacatccactcactcctgctgtatgctctgttcggagggtgtgttagtatctccctagaggtgatcttccgggaccacattgtgctggaacttttccgaaccagtctcatcattcttcagggaacctggttctggcagattgggtttgtgctgttcccaccttttggaacacccgaatgggaccagaaggatgatgccaacctcatgttcatcaccatgtgcttctgctggcactacctggctgccctcagcattgtggccgtcaactattctcttgtttactgccttttgactcggatgaagagacacggaaggggagaaatcattggaattcagaagctgaattcagatgacacttaccagaccgccctcttgagtggctcagatgaggaatgagccgagatgcggagggcgcagatgtcccactgcacagctggaatgaatggagttcatcccctccacctgaatgcctgctgtggtctgatcttaagggtctatatatttgcacctcctcattcaacacagggctggaggttctacaacaggaaatcaggcctacagcatcctgtgtatcttgcagttgggatttttaaacatactataaagtctgtgttggtatagtacccttcataaggaaaaatgaagtaatgcctataagtagcaggcctttgtgcctcagtgtcaagagaaatcaagagatgctaaaagctttacaatggaagtggcctcatggatgaatccggggtatgagcccaggagaacgtgctgcttttggtaacttatccctttttctcttaagaaagcaggtactttcttattagaaatatgttagaatgtgtaagcaaacgacagtgcctttagaattacaattctaacttacatattttttgaaagtaaaataattcacaagctttggtattttaaaa

SEQ ID NO: 7542 - DNA, 2683 bp, Homo sapiens
agaaaataaacaagactaaaaagtcctgagtagcgctgtgtggccgcaaacctgaacccaccttttgcaccacgcgggacccggcactcttcctgccacccacccctgagagggctgcgcggccgaccccagtactagaaaacactcgtcacctcactcaagacgggtacgaaggccaacggacgccttcctttagaacgctcagcacacagagcaacttctcacgcctactctcaaatggcgtactccaaactagcactcccgacgtccagctgtgaacccagagcggcggaaagcccctgaacccagcgcccgggcatgcgcagacgcgttgttgtggtgggcgtggctccctccggacccggcgccccgccctccgccccgtgtccgcatgcgcgactgagccgggtggatggtactgctgcatccgggtgtctggaggctgtggccgttttgttttcttggctaaaatcgggggagtgaggcgggccggcgcggcgcgacaccgggctccggaaccactgcacgacggggctggactgacctgaaaaaaatgtctggatttctagagggcttgagatgctcagaatgcattgactggggggaaaagcgcaatactattgcttccattgctgctggtgtactattttttacaggctggtggattatcatagatgcagctgttatttatcccaccatgaaagatttcaaccactcataccatgcctgtggtgttatagcaaccatagccttcctaatgattaatgcagtatcgaatggacaagtccgaggtgatagttacagtgaaggttgtctgggtcaaacaggtgctcgcatttggcttttcgttggtttcatgttggcctttggatctctgattgcatctatgtggattctttttggaggttatgttgctaaagaaaaagacatagtataccctggaattgctgtatttttccagaatgccttcatcttttttggagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccattgaaggaaaggaaaaaagggcagagacttgacactccagtcttagacaggggacaatttctttgtagttgttctgataataaactgggttccatgttgcatttcatctgtgtactgaaccactagcctaatagaccagcacggtcaactagaatgacaaacattagctactgggaactcttgttgtctcttcctcttcagaactcttgtccccccaggctccccacctctgcaagatgggatacactcttcaggaccacagtttgaaatgtctttcataaaatgtgctacaattagccttcggaatatttgctgggtgatttaaatgtgtgggtctcatttccatgctagccatggtcatctgacagtctctacactgtgaatattgcctggtgatcaagactctcctcaaagaaatgacttgctgtcatcccacatgaactcctgatgttttttctacaaaagtccataaaatgtgaaaactggagaagatcttagaggttgaagcccaccttctcttttcacataggagggaacagaccatggaaatttaaacgacttcctcacggtcacagaactagttttttaatcctcaggcagtgcatccccccaccctacaactgagcacaacctctttccccacagtgcaattcagaatatgctcagggaatgccagccaccttgtaaaactgctgggagaaaagcatgattcccacaaggactaagtatcagtgatttgtaattttcctgttttgtattatctgctttgctgatgtagacaagagttaactgagtagcatgctttattaagcatgagaaagaatcttaagaattgtcaataaaattaacccaaaactttaataatgtgtctgtaaccaagaaaatattgatagcatcatcctaatgaaactaaacatttattttaaacttattaaattgactcttaaactaa

SEQ ID NO: 7543 - DNA, 3062 bp, Homo sapiens
gctcccggggctgaggtggagccgcgggacgccggcagggttgtggcgcagcagtctccttcctgcgcgcgcgcctgaagtcggcgtgggcgtttgaggaagctgggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagaggtgatagctatgaaagcggctgtttaggaagaacaggtgctcgagtttggcttttcattggtttcatgttgatgtttgggtcacttattgcttccatgtggattctttttggtgcatatgttacccaaaatactgatgtttatccgggactagctgtgttttttcaaaatgcacttatattttttagcactctgatctacaaatttggaagaaccgaagagctatggacctgagatcacttcttaagtcacattttccttttgttatattctgtttgtagataggttttttatctctcagtacacattgccaaatggagtagattgtacattaaatgttttgtttctttacatttttatgttctgagttttgaaatagttttatgaaatttctttatttttcattgcatagactgttaatatgtatataatacaagactatatgaattggataatgagtatcagttttttattcctgagatttagaacttgatctactccctgagccagggttacatcatcttgtcattttagaagtaaccactcttgtctctctggctgggcacggtggctcatgcctgtaatcccagcactttgggaggccgaggcgggccgattgcttgaggtcaagtgtttgagaccagcctggccaacatggcgaaaccccatctactaaaaatacaaaaattagccaggcatggtggtgggtgcctgtaatcccaactacctaggaggctgaggcaggagaatcgcttgaacccggggggcagaggttgtagtgagctgagtttgcgccactgcactctagcctgggggagaaagtgaaactccctctcaaaaaaaagaaggaccactctcagtatctgatttctgaagatgtacaaaaaaatatagcttcatatatctagaatgagcactgagccataaaaggttttcagcaagttgtaacttattttggcctaaaaatgaggtttttttggtaaagaaaaaatatttgttcttatgtattgaagaagtgtacttttatataatgattttttaaatgcccaaaggactagtttgaaagcttcttttaaaaagaattcctctaatatgactttatgtgagaagggataatacatgatcaaataaactcagttttttatggttactgtaaaaagactgtgtaaggcagctcagcaccatgcttctcgtaaaagcagcttcaaatatccactggggttatcttttgacaacttgccattatctgatgttacacaattcaatagcaagcaagtttgagacaatcgcagtttaaaagcatgaaccatttaacaaaaagtggaataattaaagataaagcacttcttcccaaagggaattatcacctagtgaaaaattatgcatttcatctactcagttaccgactgcaagtctctcctcgctctagctctcaagctttgggtgaatattcctgtgaaatatatcttcaacttgaaagttcatactccaatcaaaaactccttttactgagtttgcagtactgtatttgcactgtttgtattcctctgggcccttattgctacttttgctttcctttgttacacagattttgtgttgcactttttctccagaggggtgttgtagagccttggttgtatgaataataccagtggtagtgtccacggctctaatgtaagcccatttggcatcactcctctcctctctcttgagaggatttcttgtgcacagagtatgaagcagttgtggagcgctgtgcctttgtcaagataccatcttgtttgatgacttctttctttgctgttttttcttcaaaatgttagtaagctctgtcatgcttctagcaaattgtaagactaattatttgtttccacctcataacctgttgcaataaatattacttctcatacagtttaatattgttgtttgttggagaaaatgaaccataaaaattgatttgctgttcagttttcaattattcaagtatacccaattaaagatgcagttatgtttataaaataagaagaaatagacttgtaaaatgcttatgtgagggttattgaaggtttccctgaagactgactggaaatggtggctgtttttttctatttctgactctgccatgaatttttttttttttttttaaagacaatatctcactctgttgcctaggctggagtgcagtggtgcaaccacagctcactgcaccttcaaatgctggagctcaggcaatcctcttacctccgctttccaagcagctgggaccacagatgtatcctccactcctcgctggccaccatcctgctgcccaacagaagaagctcttctgtctccgatttcctgaacggtctaaggaccaggaagaaacaggctcctgccagcaccgacagcaacgaaaatgttcccacggagatcaggatgacttgctgaagctcagtggaggctaaaaagaggacacgaaagtgaacagaatgatcttcctacgcacaacacaaacatcagttaatgttccatccatgctgcttaaagagcattcctgtcctagtaaaatgggcaagtccctctaccccccaccctcacctggtatgcttacattaatagctaaagtcaatcctgtaatgaaataaagcaagtggtagctgtctggtagcctccactactgcaaatctcag

SEQ ID NO: 7544 - DNA, 619 bp, Homo sapiens
ggaaagggaaggggaacaacattctttcgagaattataaaccttgagctccgttaaataagtagcagcagagcattgtcactggagcagtggtagtcgcgggtaggaccgtttcggtttttagccaataggctggttaaaggtacttaaaacagtaagttggaaggtgctgaaattctaagcatggtagcccaagcattagtgttccagagaaccaggcagatgctccattgccttctgtgacctgatcttggaagtggcatggagaagttacatagcatcacttcctctactctactggtctactagtctttattgttgacccaaattcaaaggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagag

SEQ ID NO: 7545 - DNA, 287 bp, Homo sapiens
ggatggcatttttggtgataattccatgatacaaaaccttttacttcattatgcctcaagatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtg

SEQ ID NO: 7546 - DNA, 508 bp, Homo sapiens
ggagccgcgggacgccggcagggttgtggcgcagcagtctccttcctgcgcgcgcgcctgaagtcggcgtgggcgtttgaggaagctgggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagaggtgatagctatgaaagcggctgtttaggaagaacaggtgctcgagtttggcttttcattggtttcatgttgatgtttgggtcacttattgcttccatgtggattctttttggtgcatatgttacccaaaatttg

SEQ ID NO: 7547 - DNA, 2375 bp, Homo sapiens
ctgcggtgcacacggcgcctcgccccgcctcaccggcgctctatcctcgcgtctgctcccagctccgggctcccggggctgaggtggagccgcgggacgccggcagggttgtggcgcagcagtctccttcctgcgcgcgcgcctgaagtcggcgtgggcgtttgaggaagctgggatacagcatttaatgaaaaatttatgcttaagaagtaaaaatggcaggcttcctagataattttcgttggccagaatgtgaatgtattgactggagtgagagaagaaatgctgtggcatctgttgtcgcaggtatattgttttttacaggctggtggataatgattgatgcagctgtggtgtatcctaagccagaacagttgaaccatgcctttcacacatgtggtgtattttccacattggctttcttcatgataaatgctgtatccaatgctcaggtgagaggtgatagctatgaaagcggctgtttaggaagaacaggtgctcgagtttggcttttcattggtttcatgttgatgtttgggtcacttattgcttccatgtggattctttttggtgcatatgttacccaaaatactgatgtttatccgggactagctgtgttttttcaaaatgcacttatattttttagcactctgatctacaaatttggaagaaccgaagagctatggacctgagatcacttcttaagtcacattttccttttgttatattctgtttgtagataggttttttatctctcagtacacattgccaaatggagtagattgtacattaaatgttttgtttctttacatttttatgttctgagttttgaaatagttttatgaaatttctttatttttcattgcatagactgttaatatgtatataatacaagactatatgaattggataatgagtatcagttttttattcctgagatttagaacttgatctactccctgagccagggttacatcatcttgtcattttagaagtaaccactcttgtctctctggctgggcacggtggctcatgcctgtaatcccagcactttgggaggccgaggcgggccgattgcttgaggtcaagtgtttgagaccagcctggccaacatggcgaaaccccatctactaaaaatacaaaaattagccaggcatggtggtgggtgcctgtaatcccaactacctaggaggctgaggcaggagaatcgcttgaacccggggggcagaggttgtagtgagctgagtttgcgccactgcactctagcctgggggagaaagtgaaactccctctcaaaaaaaagaaggaccactctcagtatctgatttctgaagatgtacaaaaaaatatagcttcatatatctagaatgagcactgagccataaaaggttttcagcaagttgtaacttattttggcctaaaaatgaggtttttttggtaaagaaaaaatatttgttcttatgtattgaagaagtgtacttttatataatgattttttaaatgcccaaaggactagtttgaaagcttcttttaaaaagaattcctctaatatgactttatgtgagaagggataatacatgatcaaataaactcagttttttatggttactgtaaaaagactgtgtaaggcagctcagcaccatgcttctcgtaaaagcagcttcaaatatccactggggttatcttttgacaacttgccattatctgatgttacacaattcaatagcaagcaagtttgagacaatcgcagtttaaaagcatgaaccatttaacaaaaagtggaataattaaagataaagcacttcttcccaaagggaattatcacctagtgaaaaattatgcatttcatctactcagttaccgactgcaagtctctcctcgctctagctctcaagctttgggtgaatattcctgtgaaatatatcttcaacttgaaagttcatactccaatcaaaaactccttttactgagtttgcagtactgtatttgcactgtttgtattcctctgggcccttattgctacttttgctttcctttgttacacagattttgtgttgcactttttctccagaggggtgttgtagagccttggttgtatgaataataccagtggtagtgtccacggctctaatgtaagcccatttggcatcactcctctcctctctcttgagaggatttcttgtgcacagagtatgaagcagttgtggagcgctgtgcctttgtcaagataccatcttgtttgatgacttctttctttgctgttttttcttcaaaatgttagtaagctctgtcatgcttctagcaaattgtaagactaattatttgtttccacctcataacctgttgcaataaatattacttctcatacagtttaa

SEQ ID NO: 7548 - DNA, 1755 bp, Homo sapiens
agtgcgccctctccaccactgcgttccctcggctaagaatcccccgaaccccagccccgcgatcgcggcgcccaccgaggaggccgcccgggtggggcgcgggggtcgcgaagcccgcagtcccggaccgcccagccgagacggagccggacccgccgcctcccggggcccttccaccgcagccatccgcacgggaggcctcgcgattgctcggaaccatcccgcaggagttcagctgatattttctagtgtggggcgagagattttgtggagcgcatttaaggggtttttgttgtgactgctgccttgtatacatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcataatagtcttcaatggtacacttaactagtctcttctgtgtaacagc

SEQ ID NO: 7549 - DNA, 1930 bp, Homo sapiens
agtgcgccctctccaccactgcgttccctcggctaagaatcccccgaaccccagccccgcgatcgcggcgcccaccgaggaggccgcccgggtggggcgcgggggtcgcgaagcccgcagtcccggaccgcccagccgagacggagccggacccgccgcctcccggggtggatctttaactcaagactagcatgaagagttgccttctggcctgccctgagtctcctcaaataacaacaggcccttccaccgcagccatccgcacgggaggcctcgcgattgctcggaaccatcccgcaggagttcagctgatattttctagtgtggggcgagagattttgtggagcgcatttaaggggtttttgttgtgactgctgccttgtatacatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcataatagtcttcaatggtacacttaactagtctcttctgtgtaacagcaaaaaaaaaaaaaaaaagaagaagaaagaaaactgtaggaaatgttctttttgaaatgccatgcaatggagctttttgtaataaaatattttatatgtagta

SEQ ID NO: 7550 - DNA, 1843 bp, Homo sapiens
aaagggctggacgctcacccaagaaggggaccccggcctgacctctctcggaattcaaaaaaatctaaggctcagagagggaatgggagctggctcttccctctgtgtttagcatccacgttttttggcggtctggctgaaaccagcccaccctagttcgggcgccagagcaacgcagttccgagggcagatctccaaggggcggaggcagagccgcgggtggatctttaactcaagactagcatgaagagttgccttctggcctgccctgagtctcctcaaataacaacaggcccttccaccgcagccatccgcacgggaggcctcgcgattgctcggaaccatcccgcaggagttcagctgatattttctagtgtggggcgagagattttgtggagcgcatttaaggggtttttgttgtgactgctgccttgtatacatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcataatagtctt

SEQ ID NO: 7551 - DNA, 1911 bp, Homo sapiens
acgccggcgctcccaggccgcgcttcctgcgtccccaacccggtccctgagagggcagtgcgccctctccaccactgcgttccctcggctaagaatcccccgaaccccagccccgcgatcgcggcgcccaccgaggaggccgcccgggtggggcgcgggggtcgcgaagcccgcagtcccggaccgcccagccgagacggagccggacccgccgcctcccgggcccttccaccgcagccatccgcacgggaggcctcgcgattgctcggaaccatcccgcaggagttcagctgatattttctagtgtggggcgagagattttgtggagcgcatttaaggggtttttgttgtgactgctgccttgtatacatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcataatagtcttcaatggtacacttaactagtctcttctgtgtaacagcaaaaaaaaaaaaaaaaagaagaagaaagaaaactgtaggaaatgttctttttgaaatgccatgcaatggagctttttgtaataaaatattttatatgtagt

SEQ ID NO: 7552 - DNA, 1942 bp, Homo sapiens
cagctgcctatcggcttctcagtgtttgaacttcaaagggctggacgctcacccaagaaggggaccccggcctgacctctctcggaattcaaaaaaatctaaggctcagagagggaatgggagctggctcttccctctgtgtttagcatccacgttttttggcggtctggctgaaaccagcccaccctagttcgggcgccagagcaacgcagttccgagggcagatctccaaggggcggaggcagagccgcgggcccttccaccgcagccatccgcacgggaggcctcgcgattgctcggaaccatcccgcaggagttcagctgatattttctagtgtggggcgagagattttgtggagcgcatttaaggggtttttgttgtgactgctgccttgtatacatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcataatagtcttcaatggtacacttaactagtctcttctgtgtaacagcaaaaaaaaaaaaaaaaagaagaagaaagaaaactgtaggaaatgttctttttgaaatgccatgcaatggagctttttgtaataaaatattttatatgtagt

SEQ ID NO: 7553 - DNA, 1984 bp, Homo sapiens
acgccggcgctcccaggccgcgcttcctgcgtccccaacccggtccctgagagggcagtgcgccctctccaccactgcgttccctcggctaagaatcccccgaaccccagccccgcgatcgcggcgcccaccgaggaggccgcccgggtggggcgcgggggtcgcgaagcccgcagtcccggaccgcccagccgagacggagccggacccgccgcctcccgggtggatctttaactcaagactagcatgaagagttgccttctggcctgccctgagtctcctcaaataacaacaggcccttccaccgcagccatccgcacgggaggcctcgcgattgctcggaaccatcccgcaggagttcagctgatattttctagtgtggggcgagagattttgtggagcgcatttaaggggtttttgttgtgactgctgccttgtatacatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccaccagggctgacgtggaggccagccctgggaacccccctgacaggcagaactctaagttggccaaacgactgaaaccgctgaaagttcgaaggattaaatctgaaaagcttcacctcaaagactttaggatcaacctcccagacaaaaacgtccctcctccctcgatagagcctttgactcctccaccgcagtatgatgaagtccaggagaaggcccccgacacccggccgcccgactgaatggccccacttgagccacgctccctcctgtctctcacacctttcacccccaagactctaacaaagccacatgagccacagttgagaagcggaggggccagctgtgcatggagccatttggatggcggcgggcggggggggattctctgtatcaggagtgactttgttgccccacacagcctcctgctgcaggtgctttggaaagagatgctgccttggagctggtgaatctgtggaccacattcaagggtgtggcacaggcatcttcccatccttttcactccgaatcgctggcgacacattctcctttccagctaggaaagggttcctcgcggctggtttagattgtggttgtttgttttgcttctactaagactgttttgtttcaaaaaggaaacaagttttgtgtttgctgtctacgctggagtcctgaactgtgggtagaaaacacgacctggctttgtagaaaggacacagggctgttttatgaactaagcggtgaggctcaggtggcggctctcgcagagcccctgatgctgttgttctttgagggcttaaggcctgatgaacgtaggcacgtgatgcataatagtcttcaatggtacacttaactagtctcttctgtgtaacagcaaaaaaaaaaaaaaaaagaagaagaaagaaaactgtaggaaatgttctttttgaaatgccatgcaatggagctttttgtaataaaatattttatatgtagt

SEQ ID NO: 7554 - DNA, 927 bp, Homo sapiens
cgctcacccaagaaggggaccccggcctgacctctctcggaattcaaaaaaatctaaggctcagagagggaatgggagctggctcttccctctgtgtttagcatccacgttttttggcggtctggctgaaaccagcccaccctagttcgggcgccagagcaacgcagttccgagggcagatctccaaggggcggaggcagagccgcgggcccttccaccgcagccatccgcacgggaggcctcgcgattgctcggaaccatcccgcaggagttcagctgatattttctagtgtggggcgagagattttgtggagcgcatttaaggggtttttgttgtgactgctgccttgtatacatttattttctttcttggaactgggcctcgccctcctcccactgacatgatggcccagtccaaggccaatggctcgcactatgcgctgaccgccatcggcctggggatgctggtccttggggtgatcatggccatgtggaacctggtacccggcttcagcgcggccgagaagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacagccaggaggaagaagaggaggatgaggaggctgcctcaaggtactatgttcccagctacgaggaagtgatgaacacaaactactcagaagcaaggggagaggagcagaacccgaggttgagcatctctctcccgtcctatgagtcactgacggggctcgacgagaccacccccacatccacca

SEQ ID NO: 7555 - DNA, 929 bp, Homo sapiens
ctcagagcatggcccgggggccgctggccgcccgcggactgcggctgctgctgccgctcctgccgctcctgccgctcctgccgctgccgcaggtggcgctgggcttcgcggacggcagctgcgacccctcggaccagtgcccgccccaggcccgctggagcagcctgtggcacgtggggctcatcctgctggcggtcctcctgcttctgctgtgtggtgtcacagctggttgtgtccggttctgctgcctccggaagcaggcacaggcccagccacatctgccaccagcacggcagccctgcgacgtggcagtcatccctatggacagtgacagccctgtacacagcactgtgacctcctacagctccgtgcagtacccactgggcatgcggttgcccctgccctttggggagctggacctggactccatggctcctcctgcctacagcctgtacaccccggagcctccaccctcctacgatgaagctgtcaagatggccaagcccagagaggaaggaccagcactctcccagaaacccagccctctccttggggcctcgggcctagagaccactccagtgccccaggagtcgggccccaatactcaactaccaccttgtagccctggtgccccttgaaggaggtaggagaacggaccagagcttggagaactaatgcttggagccaagggccccagcccaccccaccgtcccacacattgctgtggccccaacctcggtgccatgttacaccggcccctggcgtcacccactaggcaggctgctgctttcagcctcagcccctggcccagccccagcaggccctcagcctggaagaggccccttgggcctaagcctcgggtgggagctcagggccacctgtgacgtctgcatcttcttggagagagaataaagtttgtatttaagtgg

SEQ ID NO: 7556 - DNA, 514 bp, Homo sapiens
gggggccgctggccgcccgcggactgcggctgctgctgccgctcctgccgctcctgccgctcctgccgctgccgcaggtgggtcgggcggcgttctctctcggttcggccaccgcggggcgggtccctgctcggaccacgcccctcccgggctcacccttgtccccacaggtggcgctgggcttcgcggacggcagctgcgacccctcggaccagtgcccgccccaggcccgctggagcagcctgtggcacgtgggcctgtacaccccggagcctccaccctcctacgatgaagctgtcaagatggccaagcccagagaggaaggaccagcactctcccagaaacccagccctctccttggggcctcgggcctagagaccactccagtgccccaggagtcgggccccaatactcaactaccaccttgtagccctggtgccccttgaaggaggtaggagaacggaccagagcttggagaactaatgcttggagccaagggccccagcccacccca

SEQ ID NO: 7557 - DNA, 1118 bp, Homo sapiens
tccgctgtcgcccagtcccggccgctggcgggaactgacctggagcaagcaggaccttccctcccacctctcccgcctggcctccgcgggagtcccctacgatcccgctcagcagtggggcactcgctgaggacagcgagtcctgggagtgagcccaaggccacccctggccagcccaggagagatagccagggcaggcccagcagcccgaggccaggctctggccacggcggtctccgacatggagagacattgtctgctttttatcctgttaacctgtcttcggtggttgtgccacgacattccccagggtgcaggtgcccggtggccgagggtcagtccagtggtagagccttgctctcctaggctcatcctgctggcggtcctcctgcttctgctgtgtggtgtcacagctggttgtgtccggttctgctgcctccggaagcaggcacaggcccagccacatctgccaccagcacggcagccctgcgacgtggcagtcatccctatggacagtgacagccctgtacacagcactgtgacctcctacagctccgtgcagtacccactgggcatgcggttgcccctgccctttggggagctggacctggactccatggctcctcctgcctacagcctgtacaccccggagcctccaccctcctacgatgaagctgtcaagatggccaagcccagagaggaaggaccagcactctcccagaaacccagccctctccttggggcctcgggcctagagaccactccagtgccccaggagtcgggccccaatactcaactaccaccttgtagccctggtgccccttgaaggaggtaggagaacggaccagagcttggagaactaatgcttggagccaagggccccagcccaccccaccgtcccacacattgctgtggccccaacctcggtgccatgttacaccggcccctggcgtcacccactaggcaggctgctgctttcagcctcagcccctggcccagccccagcaggccctcagcctggaagaggccccttgggcctaagcctcgggtgggagctcagggccacctgtgacgtctgcatcttcttggagagagaataaagtttgtatttaagtggt

SEQ ID NO: 7558 - DNA, 313 bp, Homo sapiens
gagcatggcccgggggccgctggccgcccgcggactgcggctgctgctgccgctcctgccgctcctgccgctcctgccgctgccgcaggtgggtcgggcggcgttctctctcggttcggccaccgcggggcgggtccctgctcggaccacgcccctcccgggctcacccttgtccccacaggtggcgctgggcttcgcggacggcagctgcgacccctcggaccagtgcccgccccaggcccgctggagcagcctgtggcacgtggggctcatcctgctggcggtcctcctgcttctgctgtgtggtgtcaca

SEQ ID NO: 7559 - DNA, 890 bp, Homo sapiens
cgcaagcgggagttccggctggagacccgtgctctgggccggcgccttcaccatggcctcggcagagctggactacaccatcgagatcccggatcagccctgctggagccagaagaacagccccagcccaggtgggaaggaggcagaaactcggcagcctgtggtgattctcttgggctggggtggctgcaaggacaagaaccttgccaagtacagtgccatctaccacaaaaggaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtaggggctctgcgggccctggcagccatcctggagcgccgggccgccatgctgcgcctgttgctgctggtggcctttgccctggtggtcgtcctgttccacgtcctgcttgctcccatcacagccctcttccacacccacttctatgacaggctacaggacgcgggctctcgctggcccgagctctacctctactcgagggctgacgaagtagtcctggccagagacatagaacgcatggtggaggcacgcctggcacgccgggtcctggcgcgttctgtggatttcgtgtcatctgcacacgtcagccacctccgtgactaccctacttactacacaagcctctgtgtcgacttcatgcgcaactgcgtccgctgctgaggccattgctccatctcacctctgctccagaaataaatgcctgacacctccccacaacctgcaatctgtcgggcactcttctcgttcaactccc

SEQ ID NO: 7560 - DNA, 2310 bp, Homo sapiens
ggtggttgctaaggcgggaggtcacagagcgcggcgcagggattgggccgtgttgggggaggtgtgtggtgattgggcggcgcccaggaggcgcccgggtgaggcacgggtgcgcaagcgggagttccggctggagacccgtgctctgggccggcgccttcaccatggcctcggcagagctggactacaccatcgagatcccggatcagccctgctggagccagaagaacagccccagcccaggtgggaaggaggcagaaactcggcagcctgtggtgattctcttgggctggggtggctgcaaggacaagaaccttgccaagtacagtgccatctaccacaaaaggggctgcatcgtaatccgatacacagccccgtggcacatggtcttcttctccgagtcactgggtatcccttcacttcgtgttttggcccagaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtaggggctctgcgggccctggcagccatcctggagcgccgggccgccatgctgcgcctgttgctgctggtggcctttgccctggtggtcgtcctgttccacgtcctgcttgctcccatcacagccctcttccacacccacttctatgacaggctacaggacgcgggctctcgctggcccgagctctacctctactcgagggctgacgaagtagtcctggccagagacatagaacgcatggtggaggcacgcctggcacgccgggtcctggcgcgttctgtggatttcgtgtcatctgcacacgtcagccacctccgtgactaccctacttactacacaagcctctgtgtcgacttcatgcgcaactgcgtccgctgctgaggccattgctccatctcacctctgctccagaaataaatgcctgacacctccccacaacctgcaatctgtcgggcactcttctcgttcaactccctgtagccctttgggactttgcggtcccctaagtagaaaattcctatgggcctgtctcctgggggcctctgtctgctggtggtctgcttaccacagaatcctaaggggcaggagtgcctgggcatgtgtctgtgggagccttgcagtcagttgtgtttggacaagtgcaacagtcaggctgctgattcctgtggcatgcaggctgtagaggttgacaaatggaggggggtgttgagggtgagccctagttgattttttaaaatttaaactctggtaagaacatttaatatgagacctactctctttttttctttacttatttatttatctatttatttcaagacagggtctcactctgtcacctaggctggggtgcaatggtgcaatcatggctcactgcagcctcaacctcccaggctcaagtgatcctcccacctcagcctcccaaagtgctaggattacaggcatgagtcaccgcgcctggccaagatcacctaacaaaattgtaagtgtgtacgatacttaaaatttaagagattatgtgcacggcagacctctagaactgaatagtcttgcatcttgcataattcagaacttcatcatcttgcataactgaaactttgtgcctgttaccagagttgagttttgattccttgaatggaaggtgacctttgtggggagatgccagagggaaggtatatcggtcaggggtagcgtcaggctgcggataggggctatgatctttgctccagcagggcgaagccctacagtgtaaagtaccattcacatggctcccacttggcagttcactcagagaggctcctctgaccccattgcctgggagtctgaggtagaagccagatgaggagctgaggttaggggcctgcctggctctaccacactttgctaggaagccgctgggtctgggaaagttgcaagctgaaagttgccagagacagtggggggcaggaaggcagcagcattgtaacaggagctgggatgagctaactcccaagccctaaagaccagaaccagggtaaggggatttgggctgaaatagcaaactccttcatcttctggaagggagacccacttagatactctctaggcagaagaggtgaattcagcctgatagttcagtatcattgatcattctagaagtcactactgcacaatgttggcatatagtaggtattcaataaatatttgattgaatgag

SEQ ID NO: 7561 - DNA, 1846 bp, Homo sapiens
gggtgaggcacgggtgcgcaagcgggagttccggctggagacccgtgctctgggccggcgccttcaccatggcctcggcagagctggactacaccatcgagatcccggatcagccctgctggagccagaagaacagccccagcccaggtgggaaggaggcagaaactcggcagcctgtggtgattctcttgggctggggtggctgcaaggacaagaaccttgccaagtacagtgccatctaccacaaaaggggctgcatcgtaatccgatacacagccccgtggcacatggtcttcttctccgagtcactgggtatcccttcacttcgtgttttggcccagaagctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtcttctgcatggcctcctgcttgctgctttcaccattgctggtggatggcatctctgctgggacagaggggcaactcacactccggccagactgggcagcacaggtgctaacgcggcttggctgtcaccttcaatgcatcacccgaagctgagagccccccttcgtcactcctagcttgcagcctcacaattccatttccccacccaaatacatccattttaatatgcacatcacaggcaggcagcacggtcacaaaggagccccaccagcagcagtccccacgtggtggaacggatggatgaccagccaccagcctcggcctcttggcttccagcagatggatacccagcagaggcctggcaccagagtgccaatgtctacgtgtcagctgcttgtacctcggaagccaccttccaggagagtggtggcccgtatccgcttctgtccacaccactcatactcctcaaagcggttgttgttctcatgctcgatgtccacagcatcatcctcagccatgcaggagccttccctctgtgaagagcagagcaggatcatgctgggcccaggccatccccacctgctccccacagtctgcaacgaaggcacagctctagccccagctgtggtgtgccaagtgggccctcagctctagggctcctttgaagcaaaccaatttagaggtcaaagacctgggcctcttcccaatagttttccgctggagcccaaggagggaatgagtgagagtgaaagcaaaaggagagagcagtggtcagaagggaagaagctgctgagaccacatggagaccccaagagcccacagattcaggggcagtcagcagctagtgtcgggggaagggagcggggaaggaaggtgggtggtgatggcccctctaccttagaaaggcaatgctccacatgcctactcatctcctgctccgatcctgccagggggcggttgcacaggggacatacctgcccttcatcttgcttcctccgtttcattttcccaatccgagctgcacggggaaaccgaaaacaaagcacagaacaagcagacggtcactgcagcccccagggtcccagtggagctgacacatcctgacctcttgccagccattggcctttttattcagtgcctgatctggccctcatcttgaaatacctcctgctcctttggggactgggctttgccaagagcacctggggaggagactggtgctaactaagccagtgagtaagtccactctttggctgcagctggtgcaaggtctacccatacctttctatttgcagtgtttaataaaaatccagtgagcaaagaca

SEQ ID NO: 7562 - DNA, 1579 bp, Homo sapiens
cccgggtgaggcacgggtgcgcaagcgggagttccggctggagacccgtgctctgggccggcgccttcaccatggcctcggcagagctggactacaccatcgagatcccggatcagccctgctggagccagaagaacagccccagcccaggtgggaaggaggcagaaactcggcagcctgtggtgattctcttgggctggggtggctgcaaggacaagaaccttgccaagtacagtgccatctaccacaaaagggtcttctgcatggcctcctgcttgctgctttcaccattgctggtggatggcatctctgctgggacagaggggcaactcacactccggccagactgggcagcacaggtgctaacgcggcttggctgtcaccttcaatgcatcacccgaagctgagagccccccttcgtcactcctagcttgcagcctcacaattccatttccccacccaaatacatccattttaatatgcacatcacaggcaggcagcacggtcacaaaggagccccaccagcagcagtccccacgtggtggaacggatggatgaccagccaccagcctcggcctcttggcttccagcagatggatacccagcagaggcctggcaccagagtgccaatgtctacgtgtcagctgcttgtacctcggaagccaccttccaggagagtggtggcccgtatccgcttctgtccacaccactcatactcctcaaagcggttgttgttctcatgctcgatgtccacagcatcatcctcagccatgcaggagccttccctctgtgaagagcagagcaggatcatgctgggcccaggccatccccacctgctccccacagtctgcaacgaaggcacagctctagccccagctgtggtgtgccaagtgggccctcagctctagggctcctttgaagcaaaccaatttagaggtcaaagacctgggcctcttcccaatagttttccgctggagcccaaggagggaatgagtgagagtgaaagcaaaaggagagagcagtggtcagaagggaagaagctgctgagaccacatggagaccccaagagcccacagattcaggggcagtcagcagctagtgtcgggggaagggagcggggaaggaaggtgggtggtgatggcccctctaccttagaaaggcaatgctccacatgcctactcatctcctgctccgatcctgccagggggcggttgcacaggggacatacctgcccttcatcttgcttcctccgtttcattttcccaatccgagctgcacggggaaaccgaaaacaaagcacagaacaagcagacggtcactgcagcccccagggtcccagtggagctgacacatcctgacctcttgccagccattggcctttttattcagtgcctgatctggccctcatcttgaaatacctcctgctcctttggggactgggctttgccaagagcacctggggaggagactggtgctaactaagccagtgagtaagtccactctttggctgcagctggtgcaaggtctacccatacctttctatttgcagtgtttaataaaaatccagtgagcaaagaca

SEQ ID NO: 7563 - DNA, 1472 bp, Homo sapiens
ggcgcccaggaggcgcccgggtgaggcacgggtgcgcaagcgggagttccggctggagacccgtgctctgggccggcgccttcaccatggcctcggcagagctggactacaccatcgagatcccggatcagccctgctggagccagagtcttctgcatggcctcctgcttgctgctttcaccattgctggtggatggcatctctgctgggacagaggggcaactcacactccggccagactgggcagcacaggtgctaacgcggcttggctgtcaccttcaatgcatcacccgaagctgagagccccccttcgtcactcctagcttgcagcctcacaattccatttccccacccaaatacatccattttaatatgcacatcacaggcaggcagcacggtcacaaaggagccccaccagcagcagtccccacgtggtggaacggatggatgaccagccaccagcctcggcctcttggcttccagcagatggatacccagcagaggcctggcaccagagtgccaatgtctacgtgtcagctgcttgtacctcggaagccaccttccaggagagtggtggcccgtatccgcttctgtccacaccactcatactcctcaaagcggttgttgttctcatgctcgatgtccacagcatcatcctcagccatgcaggagccttccctctgtgaagagcagagcaggatcatgctgggcccaggccatccccacctgctccccacagtctgcaacgaaggcacagctctagccccagctgtggtgtgccaagtgggccctcagctctagggctcctttgaagcaaaccaatttagaggtcaaagacctgggcctcttcccaatagttttccgctggagcccaaggagggaatgagtgagagtgaaagcaaaaggagagagcagtggtcagaagggaagaagctgctgagaccacatggagaccccaagagcccacagattcaggggcagtcagcagctagtgtcgggggaagggagcggggaaggaaggtgggtggtgatggcccctctaccttagaaaggcaatgctccacatgcctactcatctcctgctccgatcctgccagggggcggttgcacaggggacatacctgcccttcatcttgcttcctccgtttcattttcccaatccgagctgcacggggaaaccgaaaacaaagcacagaacaagcagacggtcactgcagcccccagggtcccagtggagctgacacatcctgacctcttgccagccattggcctttttattcagtgcctgatctggccctcatcttgaaatacctcctgctcctttggggactgggctttgccaagagcacctggggaggagactggtgctaactaagccagtgagtaagtccactctttggctgcagctggtgcaaggtctacccatacctttctatttgcagtgtttaataaaaatccagtgagcaaagaca

SEQ ID NO: 7564 - DNA, 415 bp, Homo sapiens
gcgccttcaccatggcctcggcagagctggactacaccatcgagatcccggatcagccctgctggagccagaagaacagccccagcccaggtgggaaggaggcagaaactcggcagcctgtggtgattctcttgggctggggtggctgcaaggacaagaaccttgccaagtacagtgccatctaccacaaaaggctgctcgagctgctctttgattatgagattgagaaggagcccctgctcttccatgtcttcagcaacggtggcgtcatgctgtaccgctacgtgctggagctcctgcagacccgtcgcttctgccgcctgcgtgtggtgggcaccatctttgacagcgctcctggtgacagcaacctggtaggggctctgcgggccctggcagccatcctggagcgccgggc

SEQ ID NO: 7565 - DNA, 871 bp, Homo sapiens
gcccagccccgggctccgggcgggaagtgggcgagcgcgacggtgcggggcgcgcgggcgacgggccagcgggatgggagcagggtcccccggcggcccgcagcctcgggagccgcgctgaagccgggggcgggaccagcgcggagccgacatgtgtctgcgcctcggaggcctgagtgtgggcgacttccggaaggtgctgatgaagacaggcctggtgctggtggtgctgggccatgtgagcttcatcacagctgccctgttccatggcacagtgctgcgctacgtgggcacccctcaagatgcggtggctctgcagtactgcgtggtcaacatcctctctgtcacttccgccatcgtgggcaaggcactgctggctgcctgcacttttgggagctctgaactactggccctcgcacctgactgtcccttcgaccccacacgcatttatagctccagcctgtgcctctggggcatcgccctagtgctctgcgtggcggagaacgtgtttgctgtacgctgtgctcagctcacccaccagctgctggagctgaggccctggtgggggaaaagcagccaccacatgatgcgggagaacccagagctggtggagggccgtgacctgctgagctgcaccagctctgagcctctgaccctctgagagatgatgtcctgcccaggcccgatggccactaggaccctgcaagcaactctgctctgtgaccaggccaggattcctggagctggcctgagagggctcaatggaccctcggggacccaagtggggctttcaaccctctcccccaccacccagcccactgcactgaaatgagactttattctgaaattattaaaaagaacagagatgctc

SEQ ID NO: 7566 - DNA, 999 bp, Homo sapiens
cgagcgcgacggtgcggggcgcgcgggcgacgggccagcgggatgggagcagggtcccccggcggcccgcagcctcgggagccgcgctgaagccgggggcgggaccagcgcggagccgacatgtgtctgcgcctcggaggcctgagtgtgggcgacttccggaaggtgctgatgaagacaggcctggtgctggtggtgctgggccatgtgagcttcatcacagctgccctgttccatggcacagtgctgcgctacgtgggcacccctcaagatgcggtggctctgcagtactgcgtggtcaacatcctctctgtcacttccgccatcgtggtcatcacttcaggcatcgcagccatcgtgttgtcacgctacctccctagcacccccctgcgctggacagtgtttagctcgagcgtggcctgtgctctcctttctctgacctgtgccctcggcctcttggcctccatcgccatgacctttgccacccagggcaaggcactgctggctgcctgcacttttgggagctctgaactactggccctcgcacctgactgtcccttcgaccccacacgcatttatagctccagcctgtgcctctggggcatcgccctagtgctctgcgtggcggagaacgtgtttgctgtacgctgtgctcagctcacccaccagctgctggagctgaggccctggtgggggaaaagcagccaccacatgatgcgggagaacccagagctggtggagggccgtgacctgctgagctgcaccagctctgagcctctgaccctctgagagatgatgtcctgcccaggcccgatggccactaggaccctgcaagcaactctgctctgtgaccaggccaggattcctggagctggcctgagagggctcaatggaccctcggggacccaagtggggctttcaaccctctcccccaccacccagcccactgcactgaaatgagactttattctgaaattattaaaaagaacagagatgctc

SEQ ID NO: 7567 - DNA, 1961 bp, Homo sapiens
tgtgcgtcgctccccaatggaaaaggagagctgccttcacaggaccaggaattggtttatctacgcgaataatagcatgacccgggcggggatagcctatcacgtgctgctagacggaacggggcggggcaggccactggttgcggagtgagctgggcgcgcggcgcgcaggcgccctggggacccggtagcggcggtggcggtggcggcggtggcggtggctgcggcgacggcagaggcgaagggagccggatcgccgacctgagcgggaggcggcggtggcggccatggcggcagatggagagcgttccccgctgctgtctgagcccatcgacggtggcgcgggcggcaacggtttagtggggcccggcgggagtggggctgggcccgggggaggcctgaccccctccgcaccaccgtacggagccgcatttcccccgtttcccgaggggcatccagccgtgttgcctggggaggacccacccccctattcacccttaactagcccggacagtgggagtgcccctatgatcacctgccgagtctgccaatctctcatcaacgtggaaggcaagatgcatcagcatgtagtcaaatgtggtgtctgcaatgaagccaccccaatcaagaatgcacccccagggaaaaaatatgttcgatgcccctgtaactgtctccttatctgcaaagtgacatcccaacggattgcatgccctcggccctactgcaaaagaatcatcaacctggggcctgtgcatcccggacctctgagtccagaaccccaacccatgggtgtcagggttatctgtggacattgcaagaatacttttctgtggacagagttcacagaccgcactttggcacgttgtcctcactgcaggaaagtgtcatctattgggcgcagatacccacgtaagagatgtatctgctgcttcttgcttggcttgcttttggcagtcactgccactggccttgcctttggcacatggaagcatgcacggcgatatggaggcatctatgcagcctgggcatttgtcatcctgttggctgtgctgtgtttgggccgggctctttattgggcctgtatgaaggtcagccaccctgtccagaacttctcctgagcctgatgacccacagactgtgcctggcccctccctggtggggacagtgacactacgaagggagctggggtagttaaaggctcccggggcttctagaaggaagccaagcagctgccttccttttccctggggagaggtaggaaggaaccaggccctcacttaggtttggaggggcagataagagcactgctgaccatctgctttcctccaagggttgctgtgtctagggtgaagtaggcaaaacgttgcccttaaaactgggccctgaagacggttccagccttgtccttcctgtgtgctccctgagagccattcctgtcccttacacattccagggcagggtgggggtgggtagccctgggggttcccctccctcttgtgcaccattaggactttgctgctgctattgcacttcaccagaggttggctctggcctcagtaccctcagtctcctctccccacattgtgtcctgtgggggtggggtcagccgctgctctgtacagaaccacaggaactgatgtgtatataactatttaatgtgggatatgttcccctattcctgtatttcccttaattcctcctcccgaccttttttacccccccagttgcagtatttaactgggctgggtagggttgctcagtctttgggggaggttagggacttatcctgtgcttgtaaataaataaggtcatgactctacgctttttcagttgttaacttgtgtgcatgaaaatatgaggaagagaatgtgtagccccacgaaggggtaagacacgaagacagcaaggctgaaactatggctctttattttcatgtggataattcaaacaaagtcatt

SEQ ID NO: 7568 - DNA, 1696 bp, Homo sapiens
gtgagctgggcgcgcggcgcgcaggcgccctggggacccggtagcggcggtggcggtggcggcggtggcggtggctgcggcgacggcagaggcgaagggagccggatcgccgacctgagcgggaggcggcggtggcggccatggcggcagatggagagcgttccccgctgctgtctgagcccatcgacggtggcgcgggcggcaacggtttagtggggcccggcgggagtggggctgggcccgggggaggcctgaccccctccgcaccaccgtacggagccggtaaacatgccccgccccaggcatttcccccgtttcccgaggggcatccagccgtgttgcctggggaggacccacccccctattcacccttaactagcccggacagtgggagtgcccctatgatcacctgccgagtctgccaatctctcatcaacgtggaaggcaagatgcatcagcatgtagtcaaatgtggtgtctgcaatgaagccaccccaatcaagaatgcacccccagggaaaaaatatgttcgatgcccctgtaactgtctccttatctgcaaagtgacatcccaacggattgcatgccctcggccctactgcaaaagaatcatcaacctggggcctgtgcatcccggacctctgagtccagaaccccaacccatgggtgtcagggttatctgtggacattgcaagaatacttttctgtggacagagttcacagaccgcactttggcacgttgtcctcactgcaggaaagtgtcatctattgggcgcagatacccacgtaagagatgtatctgctgcttcttgcttggcttgcttttggcagtcactgccactggccttgcctttggcacatggaagcatgcacggcgatatggaggcatctatgcagcctgggcatttgtcatcctgttggctgtgctgtgtttgggccgggctctttattgggcctgtatgaaggtcagccaccctgtccagaacttctcctgagcctgatgacccacagactgtgcctggcccctccctggtggggacagtgacactacgaagggagctggggtagttaaaggctcccggggcttctagaaggaagccaagcagctgccttccttttccctggggagaggtaggaaggaaccaggccctcacttaggtttggaggggcagataagagcactgctgaccatctgctttcctccaagggttgctgtgtctagggtgaagtaggcaaaacgttgcccttaaaactgggccctgaagacggttccagccttgtccttcctgtgtgctccctgagagccattcctgtcccttacacattccagggcagggtgggggtgggtagccctgggggttcccctccctcttgtgcaccattaggactttgctgctgctattgcacttcaccagaggttggctctggcctcagtaccctcagtctcctctccccacattgtgtcctgtgggggtggggtcagccgctgctctgtacagaaccacaggaactgatgtgtatataactatttaatgtgggatatgttcccctattcctgtatttcccttaattcctcctcccgaccttttttacccccccagttgcagtatttaactgggctgggtagggttgctcagtctttgggggaggttagggacttatcctgtgcttgtaaataaataaggtcatgactcta

SEQ ID NO: 7569 - DNA, 6822 bp, Homo sapiens
gcggccgcggcccctttaaggagcagctctgcggtaacccgagcccgcagtccgggcgggcgcgacggccgccgcggtagctggagcctccgcgactgcacctccaagcggcccggaacccgcggcttccctggctcccgtgagcatctcaccgggcggcactggccagcgccagccctcgggccggcccggatgagcagactcctgtagacacccgccgccctctcccggctcggcgcagccgccgcccgcgcgcgactcgccccgggacccggcacaggttgaagaaatatggagatcaacacaaaactgctcatcagtgttacctgtatcagctttttcacctttcagcttcttttctactttgtaagttactggttttcagcaaaagtttctccaggtttcaatagtctcagcttcaaaaagaagattgaatggaactcaagggtagtatccacatgccattctttggtggttggtatttttggcctgtacattttcttattcgatgaggctactaaagctgatccactttggggtggtccatcacttgcaaacgtgaatattgctattgcctcaggctacctcatttctgatttgtccattataattttgtattggaaagtgattggtgacaaattttttataatgcatcattgtgcgtccctgtatgcatactaccttgtactgaaaaatggagtgctggcatacattgggaattttcgcctgcttgcagagctttccagcccgtttgtgaatcagcggtggttctttgaagctctgaagtatcccaagttttctaaagctatcgttatcaatggaatactcatgacagtagtattcttcatcgtgcggattgcctcaatgcttcctcattatggcttcatgtattccgtgtatggaacagaaccctacataaggcttggagttttaatccagttatcctgggtcattagttgtgttgttttggatgtgatgaatgtcatgtggatgatcaaaatttcaaaaggttgcatcaaagtcatctctcacatcagacaagagaaagccaaaaatagtcttcagaatggaaaacttgattaaaagagtgctaccgataagcaaacttcattactacccagcatatctgctgataggatgaattcttggcatgttcttgtgtacctttcttaattataattgttattcaggatttcagtgtcattttttttaaaccttagaaaagagaaggccgggcacggtggctcatgcctgtaatcccagcactttgggaggccaaggtgggtcgatcactgaggtcaggagttcgagactagcttggccaacatggtgaaacctcatctctactaaaaatacaaaaaaaagtagctgggcgtggtggttggcgcctgtaatcccagctactcgggaggctgaggcaggagaatcgcttgaacccgagagacggaggttgcagtgagctgatattgtgccactgcactccagcctgggcgacagagcaagactctgtctcaaaaaaaaaaaaaagagagaaactaaaattaaaatttagttttcatcccaagatgtcttttctgcctttcttttgccttatttacaagcatggataaaaatcttaaaggtttaaataaaaatgatcaatataatggtgaatcttttgagaaatctcttaactgcattggtattttttctctgtgaaagatgactatgataatctggtacaaatggttttatgtcaccaattttgctgcaagaatgggaactgcttttaaatctgtaaatagctcttaacatttgttgtatgcactcttttcttactatggctgtcaacacttgtgtagggtttaatttctaaattgttggcatgttctttttctcaggctattcagaagtaacaacatttttcatttcagacatgcaatcacctattaatgatgaaatattttaccactttgggaatatttaattagtttagtcatggagaatacttcccacattttaagattttttcaaatatcactgtcatttctattttagcattttatcaaattattgcttttttattttataataaggcttaagacagattatagacctccttaagagatgagtttcttcttctaaaaatgcatgttgatagaggactatttaggctaatcggaggaatcattaagaaagaaagttttaacactgtttatccctatctgctttccttgcactttttctgtgaaaaatattttctgtttgcaaaatcttccctgagttctgaacccagcaccatcagtaccaaagtcttatgcaatatgtatttattatgctcctgaaataggcctcttcttgatgagacccaaactattacaaaaatatcagtattcatattttactcacaattcatacccgtgcttacttagttggcattttagtgctttgaatttctatcttaaagcacagaaaaaaaaaggtaatttaatccaagtattctatcatcaaaattattgtctgattatatgaagataaatgactggcgactctggttgtgtgtgtatgtgttttgcttttactttaattcttgcaatccaaatatagaattatatatttatctattattgcctttattctttaagcacttgagtttaatgattattcttacctgagaaaggaagaaatttaattctaccagtgatgaatacttgaaattaattgaactcataccaaaagatgtaatccagtttctcagtttgaaggagaacgtttgactcactttcattgttcatgctagctgaatataatcaagacttttgatttgatttgcttttattattcaatgcagatagagcctgataagttttagaacatttaaagaagattgaaatctcagtcagtaactaaatgataaaatgagattgattggcttatactaggtacatttatttttgaaagaattaatgtaaaataatagttatttttaaagcagctaatattacactgataatttgttgctaaatttagtgctgtccacatcataggtgcttaaatatgtactggttaactagaggggggtaggaaagcaagcggttttatcttgttcttacctttttgcaggaaaagtggctttaaaaaaatttatataataaaactattttggaaattcattcttttagaaagagaccttgagataaatattttttgactctggatatttctatagttctgaacacagattttaaacccactatcaaaatgaaaacaatataaagctatattagtgagtctccatgtagcagtttgtttttatagttactgtttcatgcttaaaacttcattcttactttcattaatgttacccttcactggtatagccactcactaaataagtatatttaaaacatcaaaattttgaactaaagtttgtgattctcttattcagcaatccttatcttatgctggctgcatgagttaattcaacatccagattaaatatcctgaagtaggttctatatatttcctcatacaacagacatggaatggaaatgccactagaaactgccctgctacttttaagtctgacctttgcaggaggtacactttgctgttctatgattgtattcacctacctaaaatacaaatgaagacagaacatatcatttactgcacgatgaatttttcatttattaaatgaaaaacgtttgctagacattttaaatattaagtattttgactacacggattaatttaaatgattctatcaggcattctgatatttaacaactctattaaaatatttatagaaaaataaaagcaaattgatataaatttttgagcaattctatttttgtagaaaaaagataacctgtaattataaagatgttttttgaatgtgtagtatcctagaaaataaaagttcttgtgaaacttaaaaaatgaatgaaaaccaactaatagcatgcaagatcatagatcctgcattaaatttttatttgtgaaaatttgaaaattatgagctataacttataaagtttgccttcttatgtctaaaatcttttaaaggattatttgcatttatgtaaaactggaaatgaagttatatatgagtgcaaagaaattgacttctgctcaaatatgtgttgataccctacagtaaattgaattaaatttttatcccaactgtttgattttattatttcatggactagccttacgttaagtgaaatactatttatgttgttaccacccctaagagtgactctgatatattatggatgacccaggacggtcttaaaggtctagttttaaaaactgcctagtttgtaagtatttgaatccagttcttttctaaattttaataatttgactcaaaatttttgctacagggtcaacttttaaattgtatatttcctctgaggcacactgggcatttggagaatggttcttcactggtgtagagagccaggtttactgttggttgcaccatctgttatcaggcatgcagaaacatttttcttctggagaaacagaggggaaggtgttgttacagtgtacatgtttcctctgtgtcgtttttaagggaaataaacatgttccaaaagatgctgttaaaataaatatttgaacacgttttctgtttctaggttgctcttaattccaaacatttaaataaatgtgcatttgaatagctttaggtggtttagtctattagctgaaatggaaaagttcatgtattgacatcatcaataatacttcataaaggtttatgtatttttatgtgtttggattccataagaagttgaacttagataattttatcaagagtagcacagtgtttctcaggtgcgagccagcatacagcgagacccttcatgtgtctctggatgcacatatatcttcccaaccttaaacacagctcattgaaatacattaaagctactgaaagtgagttctgatgcaaaacacatgtgaggtgtgtaggaacaatgaaaagctagaggatctggagttagaggaggcattgagagtgcttttcccttaaacgccgtgatagtcctcccttgatctagaagtattctctttgaatccttccatctcttcctcctggtacaccagatgacttcatcagcatctccctcttttatgctaacacctttcgctgtcaacttttgagacctccccatgtatctataagcttcccagtctcttatggcaaatttaaaagtttacaaataggttctctcattgaaaaaaagcattgtagtaaagtttaaagtggagctcagacaaatcatgacttattaagagactacaggaagccattcagcatttaataataactgtttacaacatgaggcaaagctaataatgttatggttttattaagagatctgtcatctctgtttttcttaaactggtttaacagtcagagctttgtaatgtgtttcagctgaagatttattataggcttgtaaattatctaaatgttctttttagaccccatgacaggagcacagaggaactgagataactctgtgttatgagagggtggatgctggcttgtgccaaaattattttagagtcctgctctttagggaaaactttgctatggtaatgtttctttgaaaacaaatttaccagcaactgcgttacttggtgttttccaaagtacaacatccaaggcttgaaccttacccgtttctaggccagactaggccagcctctagttttgataataattcatacctttattggaatatattttggatagcagtgaagaattgaaagcagctcctaaagattggtttgtttgctttgaaaatgtttacacttattcactctaagcagtggaccattttgatatcaggccctatacataagaccaaaaccagaaatatttctaaatctcaaagatttataagtacagtacctctggctgaaaactcgttaaacatctttggatattttttctttatatctttatgtaattatttctgtaattaagtgtacattagggttatttgctacttaacaagcctaaaggtatagctgtatatagaatgtgctctgtgtttttctgtttcctgcttggtttgtttctggtatgactatgtctactttttatttaaggaattttgtgtagataatactctcactaacttgtaaataggataagttatgagattttttggtattagaatttgtaataataatgacttttagattttatttgaaaaagctacttggaaagcagtaaatagaactatagtgatatatatagatacatagatatatacttttttctgagaatgtataatatataattgtcaaagatttttggaagtctttcaaaatatacttaataccattttgagaacataccttctaatttatttccataaggctgaagaacttttatttacaaaatgtaagactagataatgtatgaatcagtgttactaggacttatcagtacttaaaatagcaacttggcattctttattttgtttcctggttgttttatttggagggataataaatgtctaagttatttccattaaaattttgaaatgtttgtatactttatgtgtgccattttaaagtatatgcaagttctaagcaataatctgcatgttatacaaggttgacatattttgtcctgaaatttttagttaacatttcaagaatgataaaatgaacaccctgtaaattacccttctccccctcccctccatgaaaaccttgggattttcttgtgctagaacactaccacaatgtggtgcaaagctttgtattttgtggaaaaaaacaataaaatcacaattatttagtgcaaaa

SEQ ID NO: 7570 - DNA, 609 bp, Homo sapiens
ccgggcgccccgcattcctctcgcgtttctcgggctgcacgattccggctgccctgtctgcctggcggtgcctctcgggtctgagcttaaagcgggtgggtgcaaacctttgggcatccagggagagctttcttgttagagcccacacacaatcgggcgcatcaagtgggttgaagaaatatggagatcaacacaaaactgctcatcagtgttacctgtatcagctttttcacctttcagcttcttttctactttgtaagttactggttttcagcaaaagtttctccaggtttcaatagtctcagcttcaaaaagaagattgaatggaactcaagggtagtatccacatgccattctttggtggttggtatttttggcctgtacattttcttattcgatgaggctactaaagctgatccactttggggtggtccatcacttgcaaacgtgaatattgctattgcctcaggctacctcatttctgatttgtccattataattttgtattggaaagtgattggtgacaaattttttataatgcatcattgtgcgtccctgtatgcatactaccttgtactgaaaaatggagtgctggcatacattgggaat

SEQ ID NO: 7571 - DNA, 992 bp, Homo sapiens
ctccaagcggcccggaacccgcggcttccctggctcccgtgagcatctcaccgggcggcactggccagcgccagccctcgggccggcccggatgagcagactcctgtagacacccgccgccctctcccggctcggcgcagccgccgcccgcgcgcgactcgccccgggacccggcacaggtgacgccgtttggagggggggttggggaggaaggcgggcttgcctcgccccgcggctcccccgcgccagccgccaagcgcagcccgcggagaggggtgccgcggcttcccgcccctggcctagcgcggccgagagctcctgcgcctggaggctgggtgggcgtccggcgcgcgggaggcggcccggggctcccgggcgggctccggcaggtgcagaactcacatagatgaaatgatgggacagatgcagaagaggggactttccaccagttctacttacttcaaagcaaaatgattggctttaaggaaaaggaaacgtgcaaggagtgaacttggatatgttgaagaaatatggagatcaacacaaaactgctcatcagtgttacctgtatcagctttttcacctttcagcttcttttctactttgtaagttactggttttcagcaaaagtttctccaggtttcaatagtctcagcttcaaaaagaagattgaatggaactcaagggtagtatccacatgccattctttggtggttggtatttttggcctgtacattttcttattcgatgaggctactaaagctgatccactttggggtggtccatcacttgcaaacgtgaatattgctattgcctcaggctacctcatttctgatttgtccattataattttgtattggaaagtgattggtgacaaattttttataatgcatcattgtgcgtccctgtatgcatactaccttgtactgaaaaatggagtgctggcatacattgggaattttcgcctgcttgcagagctttccagcccgttt

SEQ ID NO: 7572 - DNA, 3917 bp, Homo sapiens
ggaggaggctccgagccccccctccccgtgctaccccctccccccgggtgctggctccatgtctgtgtgaccggcctcaggggtagagtccaggcccgacgcggggcgggccagcggcggcggcagctgaggtgagagacggcggcggcggcgcgggcacccggccccccagcgggaggatgaagcggcggaacgccgactgcagtaagctccgccgccccctaaagcggaaccggatcaccgagggcatttacggcagtacatttttatacctgaaattcctggtggtgtgggcacttgtcctcctagcagattttgtcctggagttcagatttgaatacctgtggccattctggcttttcatcagaagcgtctatgattccttcagataccagggactggccttctcagtattttttgtttgtgtagcattcacgtcaaatataatatgcctgctgttcatccccatacagtggcttttttttgctgctagcacatatgtatgggttcagtacgtatggcacacagaaaggggagtgtgtttgcctacagtgtctctctggatcctctttgtttatattgaagcagccattagatttaaagatctcaaaaactttcatgtagacctttgtcgtccatttgctgctcactgtattgggtaccctgtggtaactttggggtttggcttcaaaagttacgtaagctacaaaatgcggttaaggaagcaaaaagaagtacaaaaagagaacgagttttacatgcaacttcttcaacaagctctccctccagagcaacagatgctacagaagcaagaaaaagaggccgaggaagcagccaaaggattacctgatatggattcttcgatccttatacaccacaatggaggtatcccagccaacaaaaaactctccacaactttgccagagatagaataccgagaaaaagggaaagaaaaggacaaggatgccaaaaaacacaaccttggaataaataacaacaatattctacaacctgtagactctaaaatacaagagattgagtatatggaaaaccatatcaatagtaaaagattaaataatgatcttgtgggaagtacagaaaatctcttgaaagaggactcatgcactgcttcctcaaaaaattacaaaaatgccagtggagttgtgaactcttcacctcgaagtcatagcgccacaaatgggagcattccttcctcatctagtaaaaatgagaagaagcagaaatgcactagcaagagcccaagtacacacaaggacttaatggaaaactgtattcctaataaccagctaagcaaaccagacgcactggtcaggctggaacaagacattaaaaagttaaaggctgacctgcaagccagcagacaagtggaacaagagctccgcagtcagatcagctccctttcgagcaccgagcgagggatccgctcagaaatgggccagcttcggcaggagaacgagctgctgcagaacaagttacataatgctgtgcaaatgaagcaaaaagacaagcagaatatcagccagttggagaaaaagctaaaagctgagcaggaagcccgaagttttgtagagaaacagttaatggaagagaaaaagaggaagaagttagaagaagccactgctgcccgggctgttgcgtttgctgctgcatctaggggagaatgcaccgaaaccttacggaatcggatcagagaactagaagcagagggcaagaagctcacgatggacatgaaggtgaaagaagaccaaatcagagaactagaactaaaagtccaggagcttcggaaatataaggaaaatgagaaggacactgaggtgttaatgtcagccctctcagccatgcaagacaaaacacagcacctggagaacagcttaagtgcagagacgagaatcaagctggacctgttctccgcactgggcgatgcaaagcggcagctcgagattgcccaaggacaaatccttcagaaagatcaggaaatcaaggacctaaaacagaagatagccgaagtcatggccgtcatgcccagcataacatacagtgccgccaccagccccctgagccctgtttccccccactactcttccaaatttgtggagaccagcccctctggacttgaccccaatgcctctgtttaccagcccctgaagaaatgaaggccagctgtgtgttgtgcccaaaaatttggttaccggaaggcattgcaaaggagcgtctctggcagtcaagataaaaaaacagtttctattgtattttgtggaactgtatctgttgtcatttttaaaaaggggggaaaagataacatccaagtctgattagaactgcccatcagtttttcttgtaaatttttagaagacctcacagaactttacagtttatttttctcggccaacacattaaaaccattcttggatttcaagtagccaactttgccttttatgtattcttacatagtttcctcttgaagaaaaaaaaagcagagtttttgtttttcaaccctttatgtttgttttgttttattcttaaataagcaagcaaaacctgcacattggattcacgtgagatgataatgaaaacttttagtttaagagtgaagggttaagtaacctaacagagctttgatgttatagctgcattaaagaaggtgattgtcaatattacagaaaacaaaaatggattgcccctccaaggaccaaacagattcaaggagcatcatttaagctaagaagagacctaagtgatgaaactagctgtaagaatgtaacaggggttgtgtttgaaatatttatattcccatcggtgtgtttagtcctagaaaattgctagcagcagtcttcttcacagtgccttgggaaaagacatttcaagaggaaacttgataattttaaactcttttccccctttaccgtcatctatcctctatctgtatcaagctcactgcggatcctgctgtaaaactggtgggtagctgggctgtccgttaccaccacagctacatcttctgtttctttgaatagaaagcaccacagtgttttgcacttgcctccagtaaagtgccctgggaagggagctgggcagtgtttgtggacgagagactgtaacgatggctaataaaagctgcgggtctaggtttttttttttttgttttgttttttcatttcatttaactgtgctttctccacttttcatcattttgtgtttgatgatttaaaagaagcttgactattcctcagctcttgtgccaaggagggttttttttttttaagactcttaaactcaaaactctgcacaaagatttcagtttcaaatgtgtattatacatgggtagaaaagtgtttgcacaggcaacttttggaagtgtttaagaatcagggtgggggtggcgggagggaccgggtgggggcaatgcaaaattgtatttggaaactaggaaaaattaagaaaccaaataaattggttttgcttccttgccatggattctggaaggacatagttcttctaaaatttcctgttaattggcatgtacgtctcatttaaagcaaattaagtaggacaagcaagtcagtaaaatagaagtattaaaaagaatcatcctttaaatcacagatcttattttgagattaaaaaaaatacttctagctttagccaggtgtgcatgttgctgccattttgcatttttgaatcatcttgtgtaattgtcaccatgaaagtgttactcagaattgtcatagattttctcttctttgtgcaaaaacatggaaaattgtcactgactttgttttgaggtttcccccattttgctgccttttgggacacttcgttaaatactggtcttggctgcattcttttttttttttcctgtggggttcaaaagaataaacattttcttacagataaaa

SEQ ID NO: 7573 - DNA, 2866 bp, Homo sapiens
gtcatttctttgtttccgaaggcggaggaggctccgagccccccctccccgtgctaccccctccccccgggtgctggctccatgtctgtgtgaccggcctcaggggtagagtccaggcccgacgcggggcgggccagcggcggcggcagctgaggtgagagacggcggcggcggcgcgggcacccggccccccagcgggaggatgaagcggcggaacgccgactgcagtaagctccgccgccccctaaagcggaaccggatcaccgagggcatttacggcaggctggaacaagacattaaaaagttaaaggctgacctgcaagccagcagacaagtggaacaagagctccgcagtcagatcagctccctttcgagcaccgagcgagggatccgctcagaaatgggccagcttcggcaggagaacgagctgctgcagaacaagttacataatgctgtgcaaatgaagcaaaaagacaagcagaatatcagccagttggagaaaaagctaaaagctgagcaggaagcccgaagttttgtagagaaacagttaatggaagagaaaaagaggaagaagttagaagaagccactgctgcccgggctgttgcgtttgctgctgcatctaggggagaatgcaccgaaaccttacggaatcggatcagagaactagaagcagagggcaagaagctcacgatggacatgaaggtgaaagaagaccaaatcagagaactagaactaaaagtccaggagcttcggaaatataaggaaaatgagaaggacactgaggtgttaatgtcagccctctcagccatgcaagacaaaacacagcacctggagaacagcttaagtgcagagacgagaatcaagctggacctgttctccgcactgggcgatgcaaagcggcagctcgagattgcccaaggacaaatccttcagaaagatcaggaaatcaaggacctaaaacagaagatagccgaagtcatggccgtcatgcccagcataacatacagtgccgccaccagccccctgagccctgtttccccccactactcttccaaatttgtggagaccagcccctctggacttgaccccaatgcctctgtttaccagcccctgaagaaatgaaggccagctgtgtgttgtgcccaaaaatttggttaccggaaggcattgcaaaggagcgtctctggcagtcaagataaaaaaacagtttctattgtattttgtggaactgtatctgttgtcatttttaaaaaggggggaaaagataacatccaagtctgattagaactgcccatcagtttttcttgtaaatttttagaagacctcacagaactttacagtttatttttctcggccaacacattaaaaccattcttggatttcaagtagccaactttgccttttatgtattcttacatagtttcctcttgaagaaaaaaaaagcagagtttttgtttttcaaccctttatgtttgttttgttttattcttaaataagcaagcaaaacctgcacattggattcacgtgagatgataatgaaaacttttagtttaagagtgaagggttaagtaacctaacagagctttgatgttatagctgcattaaagaaggtgattgtcaatattacagaaaacaaaaatggattgcccctccaaggaccaaacagattcaaggagcatcatttaagctaagaagagacctaagtgatgaaactagctgtaagaatgtaacaggggttgtgtttgaaatatttatattcccatcggtgtgtttagtcctagaaaattgctagcagcagtcttcttcacagtgccttgggaaaagacatttcaagaggaaacttgataattttaaactcttttccccctttaccgtcatctatcctctatctgtatcaagctcactgcggatcctgctgtaaaactggtgggtagctgggctgtccgttaccaccacagctacatcttctgtttctttgaatagaaagcaccacagtgttttgcacttgcctccagtaaagtgccctgggaagggagctgggcagtgtttgtggacgagagactgtaacgatggctaataaaagctgcgggtctaggtttttttttttttgttttgttttttcatttcatttaactgtgctttctccacttttcatcattttgtgtttgatgatttaaaagaagcttgactattcctcagctcttgtgccaaggagggttttttttttttaagactcttaaactcaaaactctgcacaaagatttcagtttcaaatgtgtattatacatgggtagaaaagtgtttgcacaggcaacttttggaagtgtttaagaatcagggtgggggtggcgggagggaccgggtgggggcaatgcaaaattgtatttggaaactaggaaaaattaagaaaccaaataaattggttttgcttccttgccatggattctggaaggacatagttcttctaaaatttcctgttaattggcatgtacgtctcatttaaagcaaattaagtaggacaagcaagtcagtaaaatagaagtattaaaaagaatcatcctttaaatcacagatcttattttgagattaaaaaaaatacttctagctttagccaggtgtgcatgttgctgccattttgcatttttgaatcatcttgtgtaattgtcaccatgaaagtgttactcagaattgtcatagattttctcttctttgtgcaaaaacatggaaaattgtcactgactttgttttgaggtttcccccattttgctgccttttgggacacttcgttaaatactggtcttggctgcattcttttttttttttcctgtggggttcaaaagaataaacattttcttacagataaaa

SEQ ID NO: 7574 - DNA, 3259 bp, Homo sapiens
gtcatttctttgtttccgaaggcggaggaggctccgagccccccctccccgtgctaccccctccccccgggtgctggctccatgtctgtgtgaccggcctcaggggtagagtccaggcccgacgcggggcgggccagcggcggcggcagctgaggtgagagacggcggcggcggcgcgggcacccggccccccagcgggaggatgaagcggcggaacgccgactgcagtaagctccgccgccccctaaagcggaaccggatcaccgagggcatttacggcagtacatttttatacctgaaattcctggtggtgtgggcacttgtcctcctagcagattttgtcctggagttcagatttgaatacctgtggccattctggcttttcatcagaagcgtctatgattccttcagataccagggactggccttctcagtattttttgtttgtgtagcattcacgtcaaatataatatgcctgctgttcatccccatacagtggcttttttttgctgctagcacatatgtatgggttcagtacgtatggcacacagaaaggggagtgtgtttgcctacagtgtctctctggatcctctttgtttatattgaagcagccattagatttaaagatctcaaaaactttcatgtagacctttgtcgtccatttgctgctcactggctggaacaagacattaaaaagttaaaggctgacctgcaagccagcagacaagtggaacaagagctccgcagtcagatcagctccctttcgagcaccgagcgagggatccgctcagaaatgggccagcttcggcaggagaacgagctgctgcagaacaagttacataatgctgtgcaaatgaagcaaaaagacaagcagaatatcagccagttggagaaaaagctaaaagctgagcaggaagcccgaagttttgtagagaaacagttaatggaagagaaaaagaggaagaagttagaagaagccactgctgcccgggctgttgcgtttgctgctgcatctaggggagaatgcaccgaaaccttacggaatcggatcagagaactagaagcagagggcaagaagctcacgatggacatgaaggtgaaagaagaccaaatcagagaactagaactaaaagtccaggagcttcggaaatataaggaaaatgagaaggacactgaggtgttaatgtcagccctctcagccatgcaagacaaaacacagcacctggagaacagcttaagtgcagagacgagaatcaagctggacctgttctccgcactgggcgatgcaaagcggcagctcgagattgcccaaggacaaatccttcagaaagatcaggaaatcaaggacctaaaacagaagatagccgaagtcatggccgtcatgcccagcataacatacagtgccgccaccagccccctgagccctgtttccccccactactcttccaaatttgtggagaccagcccctctggacttgaccccaatgcctctgtttaccagcccctgaagaaatgaaggccagctgtgtgttgtgcccaaaaatttggttaccggaaggcattgcaaaggagcgtctctggcagtcaagataaaaaaacagtttctattgtattttgtggaactgtatctgttgtcatttttaaaaaggggggaaaagataacatccaagtctgattagaactgcccatcagtttttcttgtaaatttttagaagacctcacagaactttacagtttatttttctcggccaacacattaaaaccattcttggatttcaagtagccaactttgccttttatgtattcttacatagtttcctcttgaagaaaaaaaaagcagagtttttgtttttcaaccctttatgtttgttttgttttattcttaaataagcaagcaaaacctgcacattggattcacgtgagatgataatgaaaacttttagtttaagagtgaagggttaagtaacctaacagagctttgatgttatagctgcattaaagaaggtgattgtcaatattacagaaaacaaaaatggattgcccctccaaggaccaaacagattcaaggagcatcatttaagctaagaagagacctaagtgatgaaactagctgtaagaatgtaacaggggttgtgtttgaaatatttatattcccatcggtgtgtttagtcctagaaaattgctagcagcagtcttcttcacagtgccttgggaaaagacatttcaagaggaaacttgataattttaaactcttttccccctttaccgtcatctatcctctatctgtatcaagctcactgcggatcctgctgtaaaactggtgggtagctgggctgtccgttaccaccacagctacatcttctgtttctttgaatagaaagcaccacagtgttttgcacttgcctccagtaaagtgccctgggaagggagctgggcagtgtttgtggacgagagactgtaacgatggctaataaaagctgcgggtctaggtttttttttttttgttttgttttttcatttcatttaactgtgctttctccacttttcatcattttgtgtttgatgatttaaaagaagcttgactattcctcagctcttgtgccaaggagggttttttttttttaagactcttaaactcaaaactctgcacaaagatttcagtttcaaatgtgtattatacatgggtagaaaagtgtttgcacaggcaacttttggaagtgtttaagaatcagggtgggggtggcgggagggaccgggtgggggcaatgcaaaattgtatttggaaactaggaaaaattaagaaaccaaataaattggttttgcttccttgccatggattctggaaggacatagttcttctaaaatttcctgttaattggcatgtacgtctcatttaaagcaaattaagtaggacaagcaagtcagtaaaatagaagtattaaaaagaatcatcctttaaatcacagatcttattttgagattaaaaaaaatacttctagctttagccaggtgtgcatgttgctgccattttgcatttttgaatcatcttgtgtaattgtcaccatgaaagtgttactcagaattgtcatagattttctcttctttgtgcaaaaacatggaaaattgtcactgactttgttttgaggtttcccccattttgctgccttttgggacacttcgttaaatactggtcttggctgcattcttttttttttttcctgtggggttcaaaagaataaacattttcttacagataaaa

SEQ ID NO: 7575 - DNA, 1696 bp, Homo sapiens
aggccccgcttcgcgctaacgcttgcgatggttgaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataa

SEQ ID NO: 7576 - DNA, 600 bp, Homo sapiens
caagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaagtacgaaacaatactgcctttcaaactagcctgcttagatggcactgacttgtattgcttgaagtgtttatcacccacttgatcctattttagtgttatattttatatttggctttcagcaaacaaaattagtttgcaaatagaaaagtcagttgaataattgcttttgtataatgctttactattaaaagttatgcttacgttca

SEQ ID NO: 7577 - DNA, 1151 bp, Homo sapiens
agaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggtgtctgccagtttgtacacagtggatcacatagaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtg

SEQ ID NO: 7578 - DNA, 1116 bp, Homo sapiens
accgtgcgcctcccgcctacggagaactacatgccccagcctgccccgcgaagggaagaagtcaggaggccccgcttcgcgctaacgcttgcgatggttgaattcccctcctcacgccagcctaggagaagaagttcgtagtcccagaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaag

SEQ ID NO: 7579 - DNA, 2473 bp, Homo sapiens
aatgtagccaaggttactaatgcatagatatgttatgcgtatacaaggatgtacacatatattttgtaaatataagtatacataaagagcttctactaatttttttctactacataatattctgtgtagatatattataattttttaggcagtcccttatttgtgaacatgtaggttgttcctaatctttttcttttgtaaatgatacctattttgcacatttgtgagtatacctgtagaataaaatcatagggctagaattgctgagttaagaggtatatgcattttttatttttatgttttttagagatgaggatctcactatattacccaggctggcctcaagcttctgggcccaagtgctaccatagataccactgcactccagcctgggtgacagagcgagacactgtctcaaaaaaaaaaaaaaaaaacagatgaaaaaagaaacaaagcagaaccaaagctatccctagagtttagtaaatggcatcccacacttgtgctttagagaggcccagtgctgctaaagaagtcaagaaatcagaattggaggaaagatgatatcatttgtcaaaatcctttttttttttttttttttgtgatggagtctcgctctgtcgccaggctggagtgcagtggcatgatcttggctcacggcaacctctgcctccctggcttaagggattctcctgcctcagcctcctgagtagctgggactacaggcgtgcgccaccacgcctagctaatttttgtgtatttttagtagagatcgggtttcaccatgttgcccaggatggtctccatctcttgacctcgtgatccacccgcctcagcctcccaaagtgctgggattaccggtgtgagccaccacgctgggccattaaaatcttatcagtagcttactacatatattcagcccataaatactcccttcaccctgtcgtgttgtcagatgtctaccattttatatatatattcttctgattgattttttccgttctcttttccattgatgttcattatagcatgatttattcttgatgaaagcattaaagatgagaatgatacgatttgtcccttcccgttctacccttaaggccttgctggtccttatttaattacatcttaagagtcttcttatttttggacttaattcaaaagcctgttattctgatagaggtgacaggtagctagtaagtgtgtttggtggcaaattaaagtatccttggtttttaagctttaccataatgtgcatagataactaagagtttactctaatgctattgattatggtagatgtatttaattgtttgtatcctgtcccaataaggattggagtaatcttgattatattgttcttttgaatatacatatataaaaataatatatttctcattatttattttatttttagcttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataa

SEQ ID NO: 7580 - DNA, 1900 bp, Homo sapiens
ttctagttatatcaccgttgtgttttttgttgttgttgttttttaagcaacagggtctcactttgtaccccaagctggagtacagtggtgtgattatagctcactgtaccctcaaactcctgggctcaaacaatcctcacacctcagcctactgagtactaggacaacaagtgtgcactaccatacccagttatttttgtgtgtgtgtttgttttggtacagatggggtctcgctatatagtccaggctggcctcaaactgttggcctcaagcagtcctcccacctcagcttcccaaagccctgggattacaggtgtgagccactgcacctggcctgtcactattagttttatttttaatttttcccccccacagattgtaaccaaagaaaatggaaaaagggtggtggttttacctactaggcttttttcttcgtatcacttttaaaataaggaactaaaacctctatatggcaaaggtcttgagtatcaactggctcctatcatttttttctttcagttatgaaacttactggacgatttgtaataaactttactaactgctttcttcctaacctgttttcccctgaggaaaaaaaaatactattttttggtaacccttcctgttcttgaactccctaggaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgagaagctgagtatctatggtgacttggagtttatgaatgaacaaaagctaaacagatatccagcttcttctcttgtggttgttagatctaaaactgaagatcatgaagaagcagggcctctacctacaaaagtgaatcttgctcattctgaaatttaagcatttttcttttaaaagacaagtgtaatagacatctaaaattccactcctcatagagcttttaaaatggtttcattggatataggccttaagaaatcactataaaatgcaaataaagttactcaaatctgtgaagactgtatttgctataactttattggtattgtttttgtagtaatttaagaggtggatgtttgggattgtattattattttactaatatctgtagctattttgttttttgctttggttattgtttttttcccttttcttagctatgagctgatcattgctccttctcacctcctgccatgatactgtcagttaccttagttaacaagctgaatatttagtagaaatgatgcttctgctcaggaatggcccacaaatctgtaatttgaaatttagcaggaaatgacctttaatgacactacattttcaggaactgaaatcattaaaattttatttgaataatt

SEQ ID NO: 7581 - DNA, 728 bp, Homo sapiens
gatggttgaattcccctcctcacgccagcctaggagaagaagttcgtagtcccagaggtgtctgccagtttgtacacagtggatcacatagaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgaggtaaatttaat

SEQ ID NO: 7582 - DNA, 618 bp, Homo sapiens
aggaggccccgcttcgcgctaacgcttgcgatggttgaattcccctcctcacgccagcctaggagaagaagttcgtagtcccagagcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgaggtaaatttaat

SEQ ID NO: 7583 - DNA, 1074 bp, Homo sapiens
gaattcccctcctcacgccagcctaggagaagaagttcgtagtcccagaggtgaggcaggaggcggcagtttctggcgggtgagggcggagctgaagtgacagcggaggcggaagcaacggtcggtggggcggagaagggggctggccccaggaggaggaggaaacccttccgagaaaacagcaacaagctgagctgctgtgacagaggggaacaagatggcggcgccgaaggggagcctctgggtgaggacccaactggggctcccgccgctgctgctgctgaccatggccttggccggaggttcggggaccgcttcggctgaagcatttgactcggtcttgggtgatacggcgtcttgccaccgggcctgtcagttgacctaccccttgcacacctaccctaaggtgtctgccagtttgtacacagtggatcacatagaagaggagttgtacgcatgtcagagaggttgcaggctgttttcaatttgtcagtttgtggatgatggaattgacttaaatcgaactaaattggaatgtgaatctgcatgtacagaagcatattcccaatctgatgagcaatatgcttgccatcttggttgccagaatcagctgccattcgctgaactgagacaagaacaacttatgtccctgatgccaaaaatgcacctactctttcctctaactctggtgaggtcattctggagtgacatgatggactccgcacagagcttcataacctcttcatggactttttatcttcaagccgatgacggaaaaatagttatattccagtctaagccagaaatccagtacgcaccacatttggagcaggagcctacaaatttgagagaatcatctctaagcaaaatgtcctatctgcaaatgagaaattcacaagcgcacaggaattttcttgaagatggagaaagtgatggctttttaagatgcctctctcttaactctgggtggattttaactacaactcttgtcctctcggtgatggtattgctttggatttgttgtgcaactgttgctacagctgtggagcagtatgttccctctgaggtaaattt

SEQ ID NO: 7584 - DNA, 1611 bp, Homo sapiens
cagcgccccggtccccgccgcagccgctgcatcctccgtgcccggcctgagctggagtcccccgcgccccccgcgttccgcccggccatggctgcggtggcgctgatgccaccgccgctgctgctgctgctgctgttggcgtcgccgcccgccgcctccgcgccgtccgcccgcgatcccttcgccccccagctcggggacacgcagaactgccagctgcggtgccgcgaccgcgacctcggcccgcagccctcgcaggcggggctggagggcgcctccgagtctccctatgacagagccgttctgatcagcgcttgcgagcgtggctgccgcctcttctccatctgccgatttgtggccagaagctccaagcccaatgccacccaaactgagtgtgaagcagcctgcgtggaagcctatgtgaaggaggcagagcagcaggcctgtagccacggctgctggagccagcccgcggagcctgagccggagcagaagagaaaggtcctggaggctccaagtggggccctctccctcttggacttgttttccaccctctgcaatgaccttgtcaactcagcccagggatttgtctcctccacctggacatactacttgcagactgacaatgggaaagtggtggtgtttcagactcagcccatagtggagagcctcggcttccaggggggccgtctgcagcgcgtggaggtgacctggcgaggctcccaccctgaagccctggaggtgcacgtggaccctgtaggccccctggacaaggtgaggaaggccaagatccgagtcaagaccagcagcaaggccaaggtggagtctgaagagccacaggacaatgacttcctcagttgcatgtcccggcgctcgggtctgcctcgctggatcctggcctgctgcctcttcctctccgtgctggtgatgctgtggctgagctgctccaccctggtgaccgcgcctggccagcacctcaagttccagcctctgaccctggagcagcacaagggcttcatgatggagcccgattggcccctgtacccgccgccgtcccacgcctgtgaggacagcctaccaccctacaagctgaagctggacctgaccaagctgtaggcctccactggccccatcactgccaactgcagggggcccctcgggcctcacttgccctgagcccaggagtccaagggcagggtgggtccagccttgagcccctccacccccaaatccttcctctcctcccagtcccaccccttgccccacggagtcctggggacgcagtgccccagctgggaagagggcgggatcgggcactggttcctccttgtccccgctttcttgggggcttgctactttttgtcttctattgtgtggctttctgagtatttgaaccccagtcctgtgtcaccttcctttttccttctatgtcccctctctgcggggggggcgctgaggctgagggggagctgcgtcttgctagggcttcccccttctccccatcccggtctccagagacccagcttctgagagacagggtgtgggcatctccatgcccctataaagcgtgcctggggcttgtctggggctggggaggaataaaccatgtat

SEQ ID NO: 7585 - DNA, 1717 bp, Homo sapiens
gaaaaagcaggaaggcacggagtccctcgccttcgccctggctgcgctgtccccttcgcgcgcgggatgggtttgaggctgcctcgctcgggtgacgtcagcgccccggtccccgccgcagccgctgcatcctccgtgcccggcctgagctggagtcccccgcgccccccgcgttccgcccggccatggctgcggtggcgctgatgccaccgccgctgctgctgctgctgctgttggcgtcgccgcccgccgcctccgcgccgtccgcccgcgatcccttcgccccccagctcggggacacgcagaactgccagctgcggtgccgcgaccgcgacctcggcccgcagccctcgcaggcggggctggagggcgcctccgagtctccctatgacagagccgttctgatcagcgcttgcgagcgtggctgccgcctcttctccatctgccgatttgtggccagaagctccaagcccaatgccacccaaactgagtgtgaagcagcctgcgtggaagcctatgtgaaggaggcagagcagcaggcctgtagccacggctgctggagccagcccgcggagcctgagccggagcagaagagaaaggtcctggaggctccaagtggggccctctccctcttggacttgttttccaccctctgcaatgaccttgtcaactcagcccagggatttgtctcctccacctggacatactacttgcagactgacaatgggaaagtggtggtgtttcagactcagcccatagtggagagcctcggcttccaggggggccgtctgcagcgcgtggaggtgacctggcgaggctcccaccctgaagccctggaggtgcacgtggaccctgtaggccccctggacaaggtgaggaaggccaagatccgagtcaagaccagcagcaaggccaaggtggagtctgaagagccacaggacaatgacttcctcagttgcatgtcccggcgctcgggtctgcctcgctggatcctggcctgctgcctcttcctctccgtgctggtgatgctgtggctgagctgctccaccctggtgaccgcgcctggccagcacctcaagttccagcctctgaccctggagcagcacaagggcttcatgatggagcccgattggcccctgtacccgccgccgtcccacgcctgtgaggacagcctaccaccctacaagctgaagctggacctgaccaagctgtaggcctccactggccccatcactgccaactgcagggggcccctcgggcctcacttgccctgagcccaggagtccaagggcagggtgggtccagccttgagcccctccacccccaaatccttcctctcctcccagtcccaccccttgccccacggagtcctggggacgcagtgccccagctgggaagagggcgggatcgggcactggttcctccttgtccccgctttcttgggggcttgctactttttgtcttctattgtgtggctttctgagtatttgaaccccagtcctgtgtcaccttcctttttccttctatgtcccctctctgcggggggggcgctgaggctgagggggagctgcgtcttgctagggcttcccccttctccccatcccggtctccagagacccagcttctgagagacagggtgtgggcatctccatgcccctataaagcgtgcctggggcttgtctggggctggggaggaataaaccatgtatataaaaga

SEQ ID NO: 7586 - DNA, 1023 bp, Homo sapiens
aaaggtcggttggtttgcactggcggacaaatggtccaattaccgcggaaaagggacctctgaatccagattggcgtcctctctacctatagggtaggctcaggggcggtgagaaccagccccggatgtgggcgcggcactgaggtagaactgagagatcctctaccgcagtcgtttgaggaggcggaactgaagttttttcttaattatcatgtgacgggttctggatttaatggggggaaaagggcggaaaaggacaaggatccaaactggcgaatttgctgatcttcgcgtccctctccgctttccggccggcagcgctgccagggtatatttccttttttccgatcctgcaacagcctctttaaactgtttaaatgagaatgtccttggctcagagagtactactcacctggcttttcacactactcttcttgatcatgttggtgttgaaactggatgagaaagcaccttggaactggttcctcatattcattccagtctggatatttgatactatccttcttgtcctgctgattgtgaaaatggctgggcggtgtaagtctggctttgaccctcgacatggatcacacaatattaaaaaaaaagcctggtacctcattgcaatgttacttaaattagccttctgcctcgcactctgtgctaaactggaacagtttactaccatgaatctatcctatgtcttcattcctttatgggccttgctggctggggctttaacagaactcggatataatgtcttttttgtgagagactgacttctaagtacatcatctcctttctattgctgttcaacaagttaccattaaagtgttctgaatctgtcaagcttcaagaataccagagaactgagggaaaataccaaatgtagttttatactacttccataaaacaggattggtgaatcacggacttctagtcaacctacagcttaattattcagcatttgagttattgagatccttattatctctatgtaaataaagtttgttttggacctca

SEQ ID NO: 7587 - DNA, 1097 bp, Homo sapiens
ggcctggctcggtccctgcgcaccgggtgcgggcggcggagagggcgcggctggtgagccctgggagggcccaggagccagacctcggttttgcgggctggggagcagggctcgggggcagcggccaggcccctccgcccctaacacccgcgcctcctgcagacccgagggtcgccgctggtagggtcgctcagccctggcgtcctccaccaccacaccttcacctgcgcccggctccctgcgcgcctggacagcgcctgctgcccgcctcccgatggccctgccccagatgtgtgacgggagccacttggcctccaccctccgctattgcatgacagtcagcggcacagtggttctggtggccgggacgctctgcttcgcttggtggagcgaaggggatgcaaccgcccagcctggccagctggccccacccacggagtatccggtgcctgagggccccagccccctgctcaggtccgtcagcttcgtctgctgcggtgcaggtggcctgctgctgctcattggcctgctgtggtccgtcaaggccagcatcccagggccacctcgatgggacccctatcacctctccagagacctgtactacctcactgtggagtcctcagagaaggagagctgcaggacccccaaagtggttgacatccccacttacgaggaagccgtgagcttcccagtggccgaggggcccccaacaccacctgcataccctacggaggaagccctggagccaagtggatcgagggatgccctgctcagcacccagcccgcctggcctccacccagctatgagagcatcagccttgctcttgatgccgtttctgcggagacgacaccgagtgccacacgctcctgctcaggcctggttcagactgcacggggaggaagttaaaggctcctagcaggtcctgaatccagagacaaaaatgccgtgccttctccagagtcttatgcagtgcctgggacacagtaggcactcagcaaacgttcgttgttgaaggctgttctatttatctattgctgtataacaaaccaccccagaatttagtggcttaaaataaatcccattttattatgtctca

SEQ ID NO: 7588 - DNA, 2760 bp, Homo sapiens
ggtgttcagagtttcggttctcttttctgtgatcgtattacttatgcaaaacgagcccagtcacttgcgcggccagagaggggcaggtgctgggcggcggctgacgggcgcagcaccctaggcccagtgtctggctccagccccgcatccggcgccggccccgcatccagctctggccctgcgacaatagagtccggaagtgcaggcaaagcggctcccgggagcgccgcgcggtcctgcgcgggatcagcgagggccgcgccccggcgggcgggcggcatggctgcagtgctggctctcagggtggtcgcggggttggcggccgcagcgctggtggccatgctcttggagcactacggcctggcgggccagccctcgccgctgccgcgccccgcgccccccaggaggccgcaccctgcgccagggcccggagacagcaacatcttctggggcctgcagatatccgacattcacctgagcaggtttcgagatccaggcagagcggtagacttagagaaattctgttctgaaactattgacatcattcaaccagctctcgtcctagcaacaggagacctgacagatgccaaaacaaaggaacagttgggatccaggcagcatgaggtagaatggcaaacctaccagggtattctgaagaagacaagagtcatggaaaaaaccaagtggctggatatcaaaggaaatcatgatgcattcaatattccaagtctggacagcatcaagaattattacaggaaatattctgctgtacgtagagatggctctttccattatgtccacagtactccctttggcaactattcgttcatctgtgtagatgccactgtaaatccagggcctaagagaccctataatttctttggaattttagataagaaaaagatggaggagctcttattactggccaaggaaagcagtcggagcaaccatacaatttggtttggacactttacaacatccactattctttctccatcaccaggaatccggtcaataatgagttcggctatagcttatttgtgtggacatctccatacacttggtggactgatgcctgttttgcacactcgtcacttccagggcactttggaacttgaggtgggagactggaaggataataggaggtaccggatttttgcttttgatcacgacctctttagctttgcagatttgatctttgggaagtggcctgtggttcttatcaccaatcctaaatcactcctttatagttgtggtgaacatgaaccactagaaagacttcttcactcaacacacatcagagtcttggccttttccttatcctccattacttctgtcacagttaagattgatggagttcatttaggccaggctgttcatgtgtctggtcccattttcgtactgaagtggaatcctagaaactacagtagtgggacacataacatagaagtaatcgtccaggattctgctggaagaagtaagagtgttcaccacatattttctgttcaagagaataatcatctcagttttgatcccctggcatcatttattctccgtactgatcactacatcatggcccgggtcctttttgtgctgattgtgctgagccagctcaccattctcattatttttagatatcgaggatacccagagcttaaagaaccttcagggtttataaatctgacctcattttctcttcatgtcttgagcaaaataaacatcttctactattctgtgttgttgttgaccctgtatacagtgctgggtccatggttttttggtgaaatcattgatggcaaatttggttgctgcttttcctttgggatatttgttaatggacatttcctacaaggcagcataacatttataattggaattctccagctggcgttttttaacatccccttgatggcttacatgtgttggagcttgctgcagcggtgctttggtcacaacttcaggtctcatctccatcaaagaaaatacttgaaaattatgcctgttcacctacttatgctactgctgtacatctggcaggtttattcctgctactttctttatgcaacatacggcaccctagcttttttattctcccctttgcggacctggttgacactgctgacacctgttctcattcgttatgtgtggacactgaactccaccaagtttggaatcttcatggtgcagttaaaaagccacctgagctcctgaaggccatgtctcaccactggcagctgggcagaagcccagcctctgtgtctgtagcccaggcctctaccccagtagcaggtggagggccaggattggtgggtgagctttagggagcagctgctcgtttggagtcctggacgttggagggattacccactactgatacctgcagaatggactgcagaaaagtctcaaaaataatgcctttattccttccctccctaaggaggcaaagagttgatttacctttgtgaagagaaaacccttatctaggacatccacagggtagaggttgggtgtgtgtacgggagtgtctgaggcccagtgtgttttttagggttaccccatgtaaagcacttaccgctgtgcttggaattcagcagctgtcaaaggtgcaatttcaggggcagggaacctttgaggatctgggcccgaccctcactacccctgagatattagttcccaggcctgttttcccacaggattgtgggctctctgcttccttagtcggaagtgttttcaactaatcaaataaatgaatgaatgatg

SEQ ID NO: 7589 - DNA, 4098 bp, Homo sapiens
gtaacttttaagtggtcggaacacgccccgcgctgctgggtcccgccagacacgccgccgccgcaggaaagtctacagtttggtaccccaggactcgctggtcaggaaagccctgcaggacatgagtgttaggcccgacgcctggcccttggcagcttgggaggtggctggggctgcttttgcctttgccagagacagctccaactgaggacctctccaacgggcccatccacagtccttccttcccctagtgtctgggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactgccatcttccgtctgcatgatgaccagatcctggaatggtgtggggaggacgccatccactacctgtccttccagaggcacatcatcttcctgttggtggtggtcagctttttgtccctgtgtgtcatcctgcctgtcaacctctcaggggacttgctggacaaagacccgtatagttttgggaggacaacaatagcaaacctacagactgacaatgacctcctttggctgcacaccatctttgctgtcatttacctcttcctcactgtgggtttcatgcggcaccacactcagtccattaagtacaaagaggagaacctggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgccatccacaacatcagcgggactatccctggacagtgcttggcgcagagcgccacgggcagtgtggctgctgccccccaggaggcctgaggctgggtctcactgctctgaaaagacacaaccagaatggcctggggctcaggcccttggctgagtgggaatgcgttgggactgcccagctgagctatcaggtgcccatcttttctggtcccagcagtggtgaggagagcacaggcaggcctcgcccctcccttgctcacccagtttcccctccggcacaagcttccagctctgcagctggggtgacatccccagtggtttgtcgccaagaccatgtggtggacttttcgccccccaaactgatgagtccgggagaatatatggagagagagatgtaacaaggggaaggcctcctcccttctgagcacacacacaaccgataaccaaagagatgctgcagtccaggtctgaggtcccgctggcatccagctccctgctccatggccagtccctccccagcccagcagtccctccaggctacatccaggagtaagctatggggaacaggttgggaggtggccagtgctcctgccagctgtgcacacatctctgtatcccgctagagttctgtgtttttgtatcatgttgtcagggacgctagctgggtcagggttaccccatagcaggcagggacaaggaccactcataatatgcccattggaccacagttaagatccagcctctctcacctcttcagggctgagtgcatgagtctgcacctccaggcaggctctgtgcagtactcaccccctccgtctgctccctccaaggtgtgggggtgggcagtgctcagggcctcctcggagccaaaggacagcatggtcggcacagaggaaggggtacctgggctgggtgcagggccatcccactgcccttgagctgtggctctggcaggaaggaggggcagcccatccctcttctccctcctggggattctggggaatgggatgcaacttaagacttctgcctgagaagcctcctccctgctgcctccagggggcaccaaggcacaagcctgtgcagtaggggcgggatgggggtgtggaagagcaggtccaggctcctagcacaactggcctggggccttggcacctctgtaggccctgcctgtgcctgtccgctggcctggggggcctgggcttatctgggccttctcactcagggactctcttgacgctgacttgcccccgcagtggtggccagtgctgcctctgctccaagctgcccctgcgctgggaggggtgggggcggtgccattggtctggtgcagcatagccctggccagtggcctcatccccagcaggcctcccgtgcctctgccagcaaggaggggccggccagctctgcttgcacagggggccccatgtggggtcagcgcacgctcatgtcactgagttccagccgcttttagagtaaagtcgtttatcatcaaa

SEQ ID NO: 7590 - DNA, 454 bp, Homo sapiens
gcctttggctctgccagcactggtgggaacctgcaagaaatttgagccctgaacgtctgccttgtcctgttgtcctgtgctccagggaagacaggcgcgatgatggactccccgttcctggagctgtggcagtccaaggcagtgtccatcagggagcagctgggactcggggaccggcccaacgactcctattgctacaactcggccaaaaacagcaccgtgctccagggggtcacctttggtggcatccccactgtcctgctcatagacgtcagctgcttcctgttcttaatcttggtgttttctattataagaagaagattctgggactatggccgcattgccctggtgtcagaagcagacagcgagtccagatttcagagattgtcatcgacttcctcctcaggtcaacaagactttgaaaatgagctgggatgctgtccctggctgactg

SEQ ID NO: 7591 - DNA, 1018 bp, Homo sapiens
ccagctctgcacccccagctccctgcctgggatcccagccctgatggcaggtggtttccctctcagcaatgacctcctttggctgcacaccatctttgctgtcatttacctcttcctcactgtgggtttcatgcggcaccacactcagtccattaagtacaaagaggagaacctgtctcctgccatgcaaagaaggctcatagagttgctttggaagtggattctttgtacagcctggaagaagacgctgtaggctggagttgggtaggaaacctgagcataccggcacactggcttgtgggtgacttctctccctgctgtatttcccggacaggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggtaagctcctagaccaaggagaggtgggagagaggcctgggttcctggtgggagctgcccatcacctggagcacaggtgtgacctggcagtcaatggagatctccacacatctgcaattctgtgggctgtgatgct

SEQ ID NO: 7592 - DNA, 3318 bp, Homo sapiens
accacagaggcgtctggctaactcatctccagacctaagttgggaaaggggaggggagcgcggaaagcggagaagccggaggagacgctccggagtgaccagcgacggctgaacgcagcccgccctccccaagtcgacgccgcaacccggggaaagcaggaggaccatgcggcagtagcagccatgctgccctttctgctggccacactgggcaccacagccctcaacaacagcaaccccaaggactactgctacagcgcccgcatccgcagcactgtcctgcagggcctgccctttgggggcgtccccaccgtgctggctctcgacttcatgtgcttccttgcactgctgttcttattctctatcctccggaaggtggcctgggactatgggcggctggccttggtgacagatgcagacaggcttcggcggcaggagagggaccgagtggaacaggaatatgtggcttcagctatgcacggggacagccatgaccggtatgagcgtctcacctctgtctccagctccgttgactttgaccaaagggacaatggtttctgttcctggctgacagccatcttcaggataaaggatgatgagatccgggacaaatgtgggggcgatgccgtgcactacctgtcctttcagcggcacatcatcgggctgctggtggttgtgggcgtcctctccgtaggcatcgtgctgcctgtcaacttctcaggggacctgctggagaacaatgcctacagctttgggagaaccaccattgccaacttgaaatcagggaacaacctgctatggctgcacacctccttcgccttcctgtatctgctgctcaccgtctacagcatgcgtagacacacctccaagatgcgctacaaggaggatgatctggtgaagcggaccctcttcatcaatggaatctccaaatatgcagagtcagaaaagatcaagaagcattttgaggaagcctaccccaactgcacagttctcgaagcccgcccgtgttacaacgtggctcgcctaatgttcctcgatgcagagaggaagaaggccgagcggggaaagctgtacttcacaaacctccagagcaaggagaacgtgcctaccatgatcaaccccaagccctgtggccacctctgctgctgtgtggtgcgaggctgtgagcaggtggaggccattgagtactacacaaagctggagcagaagctgaaggaagactacaagcgggagaaggagaaggtgaatgagaagcctcttggcatggcctttgtcaccttccacaatgagactatcaccgccatcatcctgaaggacttcaacgtgtgtaaatgccagggctgcacctgccgtggggagccacgcccctcatcctgcagcgagtccctgcacatctccaactggaccgtgtcctatgcccctgaccctcagaacatctactgggagcacctctccatccgaggcttcatctggtggctgcgctgcctggtcatcaatgtcgtcctcttcatcctcctcttcttcctcaccactccagccatcatcatcaccaccatggacaagttcaacgtcaccaagcctgtggagtacctcaacaaccccatcatcacccagttcttccccaccctgctgctgtggtgcttctcggccctccttcccaccatcgtctactactcagccttctttgaagcccactggacacgctctggggagaacaggacaaccatgcacaagtgctacactttcctcatcttcatggtgctgctcctaccctcgctgggactgagcagcctggacctcttcttccgctggctctttgataagaaattcttggctgaggcagctattcggtttgagtgtgtgttcctgcccgacaacggcgccttcttcgtgaactacgtcattgcctcagcctttatcggcaacgccatggacctgctgcgcatcccaggcctgctcatgtacatgatccggctctgcctggcgcgctcggccgccgagaggcgcaacgtgaagcggcatcaggcctacgagttccagtttggcgcagcctacgcctggatgatgtgcgtcttcacggtggtcatgacctacagtatcacctgccccatcatcgtgcccttcgggctcatgtacatgctgctgaagcacctggtagacaggtacaatctctactacgcctacctgccggccaagctggacaagaagatccactcgggggctgtgaaccaggtggtggccgcgcccatcctctgcctcttctggctgctcttcttttccaccatgcgcacggggttcctagctcccacgtctatgttcacatttgtggtcctggtcatcaccatcgtcatctgtctctgccacgtctgctttggacacttcaaatacctcagtgcccacaactacaagattgagcacacggagacagatactgtggaccccagaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccctcacggacacagacttccagtcttgcgaggacagcctcatagagaatgagattcaccagtaaggggagggaggggccctggaggccacatcctgccccaccccacccccactcccacggacactaaaacgctaataatttattagatctaaagccccttcctccccagcccctgctttcattaaggtatttaaacttgggggtttcactgctctcccccatgatggagggagggagccccccaacctcagtgaggagagccccgagccggccccggggcaaagaggggtgcagagggagttcccccagatcagtaccccccacccctccccagctagtagcatgaccaggagagggttaatgagagccaagaggagtacctggtgcacctggtgccggtggctggagacctggggggcaggtggatctggggctgttcccccccctccgttttttccaccccacagttcctcctgggatctggccctccagggaagtggagcctccagcccctaggggatgcatgaggggggagggggtgctgagtgggaggaagagtcaggctcacagctggggtggcctgggggtgggggtgggcaaggctgacactggaaaatgggtttttgcactgttttttttttggtttttttgttcttttttgtttttttcctttaaaataaaaacaaagaaaagctctga

SEQ ID NO: 7593 - DNA, 3198 bp, Homo sapiens
aacccggggctccgagccggagccgagtctgcgcctgggggaggaccatgcggcagtagcagccatgctgccctttctgctggccacactgggcaccacagccctcaacaacagcaaccccaaggactactgctacagcgcccgcatccgcagcactgtcctgcagggcctgccctttgggggcgtccccaccgtgctggctctcgacttcatgtgcttccttgcactgctgttcttattctctatcctccggaaggtggcctgggactatgggcggctggccttggtgacagatgcagacaggcttcggcggcaggagagggaccgagtggaacaggaatatgtggcttcagctatgcacggggacagccatgaccggtatgagcgtctcacctctgtctccagctccgttgactttgaccaaagggacaatggtttctgttcctggctgacagccatcttcaggataaaggatgatgagatccgggacaaatgtgggggcgatgccgtgcactacctgtcctttcagcggcacatcatcgggctgctggtggttgtgggcgtcctctccgtaggcatcgtgctgcctgtcaacttctcaggggacctgctggagaacaatgcctacagctttgggagaaccaccattgccaacttgaaatcagggaacaacctgctatggctgcacacctccttcgccttcctgtatctgctgctcaccgtctacagcatgcgtagacacacctccaagatgcgctacaaggaggatgatctggtgaagcggaccctcttcatcaatggaatctccaaatatgcagagtcagaaaagatcaagaagcattttgaggaagcctaccccaactgcacagttctcgaagcccgcccgtgttacaacgtggctcgcctaatgttcctcgatgcagagaggaagaaggccgagcggggaaagctgtacttcacaaacctccagagcaaggagaacgtgcctaccatgatcaaccccaagccctgtggccacctctgctgctgtgtggtgcgaggctgtgagcaggtggaggccattgagtactacacaaagctggagcagaagctgaaggaagactacaagcgggagaaggagaaggtgaatgagaagcctcttggcatggcctttgtcaccttccacaatgagactatcaccgccatcatcctgaaggacttcaacgtgtgtaaatgccagggctgcacctgccgtggggagccacgcccctcatcctgcagcgagtccctgcacatctccaactggaccgtgtcctatgcccctgaccctcagaacatctactgggagcacctctccatccgaggcttcatctggtggctgcgctgcctggtcatcaatgtcgtcctcttcatcctcctcttcttcctcaccactccagccatcatcatcaccaccatggacaagttcaacgtcaccaagcctgtggagtacctcaacaaccccatcatcacccagttcttccccaccctgctgctgtggtgcttctcggccctccttcccaccatcgtctactactcagccttctttgaagcccactggacacgctctggggagaacaggacaaccatgcacaagtgctacactttcctcatcttcatggtgctgctcctaccctcgctgggactgagcagcctggacctcttcttccgctggctctttgataagaaattcttggctgaggcagctattcggtttgagtgtgtgttcctgcccgacaacggcgccttcttcgtgaactacgtcattgcctcagcctttatcggcaacgccatggacctgctgcgcatcccaggcctgctcatgtacatgatccggctctgcctggcgcgctcggccgccgagaggcgcaacgtgaagcggcatcaggcctacgagttccagtttggcgcagcctacgcctggatgatgtgcgtcttcacggtggtcatgacctacagtatcacctgccccatcatcgtgcccttcgggctcatgtacatgctgctgaagcacctggtagacaggtacaatctctactacgcctacctgccggccaagctggacaagaagatccactcgggggctgtgaaccaggtggtggccgcgcccatcctctgcctcttctggctgctcttcttttccaccatgcgcacggggttcctagctcccacgtctatgttcacatttgtggtcctggtcatcaccatcgtcatctgtctctgccacgtctgctttggacacttcaaatacctcagtgcccacaactacaagattgagcacacggagacagatactgtggaccccagaagcaatggacggccccccactgctgctgctgtccccaaatctgcgaaatacatcgctcaggtgctgcaggactcagaggtggacggggatggggatggggctcctgggagctcaggggatgagcccccatcatcctcatcccaagatgaggagttgctgatgccacccgacgccctcacggacacagacttccagtcttgcgaggacagcctcatagagaatgagattcaccagtaaggggagggaggggccctggaggccacatcctgccccaccccacccccactcccacggacactaaaacgctaataatttattagatctaaagccccttcctccccagcccctgctttcattaaggtatttaaacttgggggtttcactgctctcccccatgatggagggagggagccccccaacctcagtgaggagagccccgagccggccccggggcaaagaggggtgcagagggagttcccccagatcagtaccccccacccctccccagctagtagcatgaccaggagagggttaatgagagccaagaggagtacctggtgcacctggtgccggtggctggagacctggggggcaggtggatctggggctgttcccccccctccgttttttccaccccacagttcctcctgggatctggccctccagggaagtggagcctccagcccctaggggatgcatgaggggggagggggtgctgagtgggaggaagagtcaggctcacagctggggtggcctgggggtgggggtgggcaaggctgacactggaaaatgggtttttgcactgttttttttttggtttttttgttcttttttgtttttttcctttaaaataaaaacaaagaaaagctctg

SEQ ID NO: 7594 - DNA, 828 bp, Homo sapiens
atacactgccgcggccgccgcaggagcccggagctcgagccgcccagcgactccccctccccctcccccagccccgccccgccccaacccggggctccgagccggagccgagtctgcgcctgggggaggaccatgcggcagtagcagccatgctgccctttctgctggccacactgggcaccacagccctcaacaacagcaaccccaaggactactgctacagcgcccgcatccgcagcactgtcctgcagggcctgccctttgggggcgtccccaccgtgctggctctcgacttcatgtgcttccttgcactgctgttcttattctctatcctccggaaggtggcctgggactatgggcggctggccttggtgacagatgcagacaggcttcggcggcaggagagggaccgagtggaacaggaatatgtggcttcagctatgcacggggacagccatgaccggtatgagcgtctcacctctgtctccagctccgttgactttgaccaaagggacaatggtttctgttcctggctgacagccatcttcaggataaaggatgatgagatccgggacaaatgtgggggcgatgccgtgcactacctgtcctttcagcggcacatcatcgggctgctggtggttgtgggcgtcctctccgtaggcatcgtgctgcctgtcaacttctcaggggacctgctggagaacaatgcctacagctttgggagaaccaccattgccaacttgaaatcagggaacaacctgctatggctgcacacctccttcgccttcctgtatctgctgctcaccgtctacagcatgcgtagacaca

SEQ ID NO: 7595 - DNA, 5334 bp, Homo sapiens
ctgtcactgcagcctggcggcctgagcgccgagcctggggctggggccgcggtgctgaggacgcaaatcagccccgtagctgggtggagcctccgggcctgacgtggaccttcactggagaagtgactcagggatcctcccaggatgtctgcctcaccagacgacctgagtacagggggaaggttacagaacatgacagtggatgaatgcttccagtctcggaacaccgtcctccaggggcagccctttgggggtgtccccaccgtgctgtgcctcaacatcgccctgtgggtgctcgtccttgtggtttactccttcctccggaaagctgcgtgggactatgggcgcctggctctgctgatacacaatgacagcctgacctcgctgatctatggggagcagagcgagaagacatctccctcggagacttccttggagatggaacgcagagacaagggattctgttcctggttcttcaacagcataacaatgaaggacgaggatctgattaacaagtgtggggacgacgcacgcatctacatcgtgttccagtaccacctcatcatctttgtgctcatcatctgtatcccctccctgggcatcattttgcccatcaactatactggatctgttctggactggagcagtcactttgctcggaccaccattgtcaatgtctccacagagagcaagctcctgtggctgcatagcctgctgtccttcttctacttcatcaccaacttcatgttcatggctcatcactgcctggggtttgcacccaggaatagccaaaaggtcacaaggacactaatgatcacctatgtgcccaaggacattgaagacccagaactcatcattaagcattttcacgaggcctatccaggcagtgtcgtgacaagagtccacttctgctacgacgtcaggaacctgatcgacttggacgatcagaggcgccatgccatgcggggccggcttttctatacagccaaggccaagaagactgggaaggtgatgatcaggatccacccctgtgcccgcctgtgcttctgcaagtgctggacctgcttcaaggaggtggatgcagagcagtattacagcgagctagaggagcagctaacggacgagttcaacgccgagctcaaccgcgtgccgctcaagcggctggacctgatctttgtcaccttccaggactccaggatggccaagcgtgtccgtaaggattacaagtatgtccagtgtggtgtgcaaccccagcagtcctcagtgaccaccatcgtcaaatcatattactggagggtcactatggccccacaccccaaagacattatttggaaacacctgtctgtccgccgcttcttttggtgggcccgctttatcgcaatcaacaccttcctcttcttcctcttcttctttctcaccacgcctgccatcatcatgaacactatcgacatgtacaacgtcacccgccccatcgagaagctgcagaacccaattgtgacccagttcttcccctctgtgatgctctggggcttcacagtgatactgcctctgattgtctacttctccgccttcctcgaggcccactggaccagatcaagtcagaatctggtcatggtgcacaagtgctacatctttctggtgttcatggtagtcattctgccctctatgggactgaccagtttggatgtctttctccgctggctctttgacatctactatctagagcaagcatccatcaggttccagtgtgtgttcctgccagacaacggcgccttctttgtcaactacgtgatcacggcagctttacttggcacaggcatggagctgctgcgtctggggtcactcttctgctacagcacccgcctcttcttctctagatcagagccagagagagtcaacatcagaaagaaccaggccatagacttccagtttgggcgtgagtatgcgtggatgatgaacgtgttcagcgtggtgatggcgtacagcatcacttgccccatcattgtgccttttgggttgctctacctgtgcatgaagcacttgacggatcgctataacatgtactactcctttgcacccaccaaactgaacgagcagatccacatggctgccgtctcccaggccatctttgcgccactcttgggtctgttctggatgctgttcttctccatcctgcggttgggttctctccacgccatcaccatcttttccctgtccaccctcctcattgccatggtgattgcctttgttggcatttttctggggaagcttcggatggttgccgactacgagcccgaggaggaggagatccagacagtgtttgacatggagccaagcagcacctcctccacgcccacctccctcctgtatgtggccaccgtgctgcaagaaccggagttgaatctgacccccgcctcctccccagccaggcacacctatggcaccatgaacaaccagccggaagagggagaagaagagagtggtctgaggggctttgcgagggagctagactcggcccagttccaggaagggctggaactggagggccagaaccagtaccactgaccgggacctgaggcctccactggcgacttgttgaggggtcaggggagggcctggcaaggggaggcaggagggtggcctggacctccccactacctcctgcagactttgagaagcccacagtggagacatccaccaccccagccatgggccatacgggggtcctgacctgctgcccggctggaactgggggtgctcggcagtgctgaaggagcctgggaagggatgggaggatacaggcaagcacatgtcttgagagaggtggctggagccccggcacagagactgaacgctggggtcccttcctgggaccaagatggagaaggtgttcctaagggaggagacagaaggaggctgccgaaggctctgtggggtcatcaccactctgcatcagctgcccttccaaggagcttctgctgctgctcctcctcccagccccggcccattcctcccctgcagtctgaggaggcaaaggtatgtgcacggggcacattgacaggacacggaggaccacctcatcacagggttccctgcatggggatctgtaaagagaaagtttctgcacccaccagagcaagagccaactgaaagcgtagacctgagaagaggtaactcagccccttcctgctcctctgccctcatcagatgtccccaggagcagcagggcagaggcccttctttctattcttacaagggtagctagagcgtgatcactcagggctcatcaaatgagactcgtgtgcatttttcagaaggaaaccttggttagtccttgctgggtaacacaaagtggggtgagacgacagaagccgaattcatggaaggggggtcttctccccaaaactctgtgtggtgggaaaccagctatacctccccaagccccagggcctaaagagaagacccccgaagccaaagatgtggccacttaaaagcgtctcctgcctcctacccaactgagtgcctgggcccccagcttggccaagatgggcagtacgttagggtaagaaccccatgcttcaaacttaaggactgaccatcacctgcgtcccaagtaggacccttcctcccttctcggggctgcccctgcaccctgccttgaagaccacccaagcggcctccagtgtgggcctggtccagacattgcagatgcttcaaccgtgatgtcgccccaggcctgccaggggtgtggtggaggggaaggccacgtgctccagggagaagccctttctggagaagcaaggctgtcctcccagggctgccactaccagagacctgggggagctgaattccgaacagtgatggtgacactcagcacctttgccacagccggggggaaccggcttctgcctctgggatgggctctcatcaggaccaccgtgcagcccagccagggaggacatgagaagggccagtgggggcctcaatgaaccagaacaagccaagctgaatggggtctgtgtgctccagggccctcttcagccccctcccccaaaggtctgggtccctgccaccaacctactgaaggccggcccccggctcacctcacctgagcacctgcaccaggccccaggcacatggctgccctgaactcagatcacctagaccttgtccctgccccacctttgccccatcctagccccagaagctccaagcttcaccgcaggtgagaaattgtgctcaatgggcagaaactgctatacccccagggcatggcccacattttggcatgagggtgtctttccagagagcttgggttggctggagagaggctgtctttcccattccttgtccagctaggaataaaggggaaatggtcctagcctggcccctacacacccaggtcccacaggccccctccccactggaatttcaccaaccaacaaggggaaagtacgctgttacagcatagcggtcaggcccagcaggagcttggcacatgatggggaggtggccagctccaggccctgcccgaccccatcatgtgtatttggtgtatggggtgtggggggtcacaccagaagctggcctggggtctcttctttgctggacacagctccctggcccctgcccccagcccctgcagcccctgccggactgtggaagccacatatgggaaaagtcctggcagacaatgtggcgggatgactgggggcttctccctctgaacctgggtccagtgtagcctggctctgagagaaggtggtgagcatgtggagaaggttccatagtccactcttaggggaaccagcaaagcctcatggcagttggctccatctggacctcccatggtcactacaggatggtggagcagggggcatcttttagcctccccccgccaccacatccaggccctctcaggcacctcctgcctcagcccacacctgcctcacccattgcccccctccccccacctactgccatcccactcctctgccagccacttcccagccgccccaccccactccatccaccaaatcacctcctgacttaatcctttctggaaggagctgccgcccaggaaccggtattgcctagagcctccaggaggggccctcctcaggcctccagtggccccatgcccacctgcctgaccctccactgcccctggaagcaaagtgcctatcagcagcgttgcgtcctctggggcccccggtcgggggggagggggtgtgggctaaccttggccaccaccacaaaaggaatgtgccagaatgctgaaccttcttgttaatgctatgaccgtgccttgaataaacaagtcctcccaacctc

SEQ ID NO: 7596 - DNA, 3783 bp, Homo sapiens
tgccatcatcatgaacactatcgacatgtacaacgtcacccgccccatcgagaagctgcagaacccaattgtgacccagttcttcccctctgtgatgctctggggcttcacagtgatactgcctctgattgtctacttctccgccttcctcgaggcccactggaccagatcaagtcagaatctggtcatggtgcacaagtgctacatctttctggtgttcatggtagtcattctgccctctatgggactgaccagtttggatgtctttctccgctggctctttgacatctactatctagagcaagcatccatcaggttccagtgtgtgttcctgccagacaacggcgccttctttgtcaactacgtgatcacggcagctttacttggcacaggcatggagctgctgcgtctggggtcactcttctgctacagcacccgcctcttcttctctagatcagagccagagagagtcaacatcagaaagaaccaggccatagacttccagtttgggcgtgagtatgcgtggatgatgaacgtgttcagcgtggtgatggcgtacagcatcacttgccccatcattgtgccttttgggttgctctacctgtgcatgaagcacttgacggatcgctataacatgtactactcctttgcacccaccaaactgaacgagcagatccacatggctgccgtctcccaggccatctttgcgccactcttgggtctgttctggatgctgttcttctccatcctgcggttgggttctctccacgccatcaccatcttttccctgtccaccctcctcattgccatggtgattgcctttgttggcatttttctggggaagcttcggatggttgccgactacgagcccgaggaggaggagatccagacagtgtttgacatggagccaagcagcacctcctccacgcccacctccctcctgtatgtggccaccgtgctgcaagaaccggagttgaatctgacccccgcctcctccccagccaggcacacctatggcaccatgaacaaccagccggaagagggagaagaagagagtggtctgaggggctttgcgagggagctagactcggcccagttccaggaagggctggaactggagggccagaaccagtaccactgaccgggacctgaggcctccactggcgacttgttgaggggtcaggggagggcctggcaaggggaggcaggagggtggcctggacctccccactacctcctgcagactttgagaagcccacagtggagacatccaccaccccagccatgggccatacgggggtcctgacctgctgcccggctggaactgggggtgctcggcagtgctgaaggagcctgggaagggatgggaggatacaggcaagcacatgtcttgagagaggtggctggagccccggcacagagactgaacgctggggtcccttcctgggaccaagatggagaaggtgttcctaagggaggagacagaaggaggctgccgaaggctctgtggggtcatcaccactctgcatcagctgcccttccaaggagcttctgctgctgctcctcctcccagccccggcccattcctcccctgcagtctgaggaggcaaaggtatgtgcacggggcacattgacaggacacggaggaccacctcatcacagggttccctgcatggggatctgtaaagagaaagtttctgcacccaccagagcaagagccaactgaaagcgtagacctgagaagaggtaactcagccccttcctgctcctctgccctcatcagatgtccccaggagcagcagggcagaggcccttctttctattcttacaagggtagctagagcgtgatcactcagggctcatcaaatgagactcgtgtgcatttttcagaaggaaaccttggttagtccttgctgggtaacacaaagtggggtgagacgacagaagccgaattcatggaaggggggtcttctccccaaaactctgtgtggtgggaaaccagctatacctccccaagccccagggcctaaagagaagacccccgaagccaaagatgtggccacttaaaagcgtctcctgcctcctacccaactgagtgcctgggcccccagcttggccaagatgggcagtacgttagggtaagaaccccatgcttcaaacttaaggactgaccatcacctgcgtcccaagtaggacccttcctcccttctcggggctgcccctgcaccctgccttgaagaccacccaagcggcctccagtgtgggcctggtccagacattgcagatgcttcaaccgtgatgtcgccccaggcctgccaggggtgtggtggaggggaaggccacgtgctccagggagaagccctttctggagaagcaaggctgtcctcccagggctgccactaccagagacctgggggagctgaattccgaacagtgatggtgacactcagcacctttgccacagccggggggaaccggcttctgcctctgggatgggctctcatcaggaccaccgtgcagcccagccagggaggacatgagaagggccagtgggggcctcaatgaaccagaacaagccaagctgaatggggtctgtgtgctccagggccctcttcagccccctcccccaaaggtctgggtccctgccaccaacctactgaaggccggcccccggctcacctcacctgagcacctgcaccaggccccaggcacatggctgccctgaactcagatcacctagaccttgtccctgccccacctttgccccatcctagccccagaagctccaagcttcaccgcaggtgagaaattgtgctcaatgggcagaaactgctatacccccagggcatggcccacattttggcatgagggtgtctttccagagagcttgggttggctggagagaggctgtctttcccattccttgtccagctaggaataaaggggaaatggtcctagcctggcccctacacacccaggtcccacaggccccctccccactggaatttcaccaaccaacaaggggaaagtacgctgttacagcatagcggtcaggcccagcaggagcttggcacatgatggggaggtggccagctccaggccctgcccgaccccatcatgtgtatttggtgtatggggtgtggggggtcacaccagaagctggcctggggtctcttctttgctggacacagctccctggcccctgcccccagcccctgcagcccctgccggactgtggaagccacatatgggaaaagtcctggcagacaatgtggcgggatgactgggggcttctccctctgaacctgggtccagtgtagcctggctctgagagaaggtggtgagcatgtggagaaggttccatagtccactcttaggggaaccagcaaagcctcatggcagttggctccatctggacctccccccacctactgccatcccactcctctgccagccacttcccagccgccccaccccactccatccaccaaatcacctcctgacttaatcctttctggaaggagctgccgcccaggaaccggtattgcctagagcctccaggaggggccctcctcaggcctccagtggccccatgcccacctgcctgaccctccactgcccctggaagcaaagtgcctatcagcagcgttgcgtcctctggggcccccggtcgggggggagggggtgtgggctaaccttggccaccaccacaaaaggaatgtgccagaatgctgaaccttcttgttaatgctatgaccgtgccttgaataaacaagtcctccc

SEQ ID NO: 7597 - DNA, 457 bp, Homo sapiens
ctgtcactgcagcctggcggcctgagcgccgagcctggggctggggccgcggtgctgaggacgcaaatgtgagccttggaggagcctccctcggggtcaggaatcgagcggggacaccgctgggccactcagaaggaccgtttcctggggactgatcaagaggagggaaggtcctattacagcccagaggccacgtggggcctgagccccaaacctcagctgctgttccagcagccccgtagctgggtggagcctccgggcctgacgtggaccttcactggagaagtgactcagggatcctcccaggatgtctgcctcaccagacgacctgagtacagggggaaggttacagaacatgacagtggatgaatgcttccagtctcggaacaccgtcctccaggggcagccctttgggggtgtccccaccgtgctgtgcctcaacatcgccctgtgggtg

SEQ ID NO: 7598 - DNA, 1004 bp, Homo sapiens
tgccagcctgggttccccggcaggtcagagaagctttggggcggggccaaggttggcccctgcttgggaggagccgggatgcctctctcacagtgatgcagagaggaatttgctgacagtcccttgccaggtggggctggcttcgcccagccggcgaggaggaggacccgctggcagtctcctcccaggtggggagcgtggagcctgtcactgcagcctggcggcctgagcgccgagcctggggctggggccgcggtgctgaggacgcaaatgtgagccttggaggagcctccctcggggtcaggaatcgagcggggacaccgctgggccactcagaaggaccgtttcctggggactgatcaagaggagggaaggtcctattacagcccagaggccacgtggggcctgagccccaaacctcagctgctgttccagcagccccgtagctgggtggagcctccgggcctgacgtggaccttcactggagaagtgactcagggatcctcccaggatgtctgcctcaccagacgacctgagtacagggggaaggttacagaacatgacagtggatgaatgcttccagtctcggaacaccgtcctccaggggcagccctttgggggtgtccccaccgtgctgtgcctcaacatcgccctgtgggtgctcgtccttgtggtttactccttcctccggaaagctgcgtgggactatgggcgcctggctctgctgatacacaatgacagcctgacctcgctgatctatggggagcagagcgagaagacatctccctcggagacttccttggagatggaacgcagagacaagggattctgttcctggttcttcaacagcataacaatgaaggacgaggatctgattaacaagtgtggggacgacgcacgcatctacatcgtgttccagtaccacctcatcatctttgtgctcatcatctgtatcccctccctgggcatcattttgcccatcaactatactggatctgttctgg

SEQ ID NO: 7599 - DNA, 515 bp, Homo sapiens
aatatcattcagtgatagtggcggtggataacaatgacctcctaccagctgtgaatttctcgtcttccactagtactagtaaaagagattgctgctggctaagaatacccaccggtggggtcttgagccttggaggagcctccctcggggtcaggaatcgagcggggacaccgctgggccactcagaaggaccgtttcctggggactgatcaagaggagggaaggtcctattacagcccagaggccacgtggggcctgagccccaaacctcagctgctgttccagcagccccgtagctgggtggagcctccgggcctgacgtggaccttcactggagaagtgactcagggatcctcccaggatgtctgcctcaccagacgacctgagtacagggggaaggttacagaacatgacagtggatgaatgcttccagtctcggaacaccgtcctccaggggcagccctttgggggtgtccccaccgtgctgtgcctcaacatcgccctgtgggtgctcg

SEQ ID NO: 7600 - DNA, 527 bp, Homo sapiens
atcattcagtgatagtggcggtggataacaatgacctcctaccagctgtgaatttctcgtcttccactagtactagtaaaagagattgctgctggctaagaatacccaccggtggggtcttgagccttggaggagcctccctcggggtcaggaatcgagcggggacaccgctgggccactcagaaggaccgtttcctggggactgatcaagaggagggaaggtcctattacagcccagaggccacgtggggcctgagccccaaacctcagctgctgttccagatatgggaactgaggctgagacagatgaagtcactgcccctggtcacacagctagcaaagcagccccgtagctgggtggagcctccgggcctgacgtggaccttcactggagaagtgactcagggatcctcccaggatgtctgcctcaccagacgacctgagtacagggggaaggttacagaacatgacagtggatgaatgcttccagtctcggaacaccgtcctccaggggcagccctttgggg

SEQ ID NO: 7601 - DNA, 582 bp, Homo sapiens
agtaaaagatgatgaaagccactatcaatcctcactgctgagtggcagggagaagcagcaccactctcagctcttttctaatcttgtaacttagtgctagaagtctctccaggctattaccatgggcatttgttctctgttggagctgtaagcagatgaacccaagtagagaagatagatcttggaaggagagatccattgagtccagaagccagatcagcaaatggaggaacctcggaggtgaccagaaagatctccatcggttgcccaaggctagccttggaggagcctccctcggggtcaggaatcgagcggggacaccgctgggccactcagaaggaccgtttcctggggactgatcaagaggagggaaggtcctattacagcccagaggccacgtggggcctgagccccaaacctcagctgctgttccagcagccccgtagctgggtggagcctccgggcctgacgtggaccttcactggagaagtgactcagggatcctcccaggatgtctgcctcaccagacgacctgagtacagggggaaggttacagaacatgacagtggatgaatgcttcca

SEQ ID NO: 7602 - DNA, 4663 bp, Homo sapiens
atgcggagcccgggcgggatcctgctccaggcgctgccccggctgctgcagcacgccgccctcccgggcctcgccgagctgccggcccgctgggccctgccgcggggtgcgggcggggacggcccggcggaccgccttccccgcgggggcggggcgagcgcggcggcggcagcagcggcggcctcgggcgccctgctcggcgcctatctggagcgccacggtccgcccgaggcttcggagctgccggagccgggcggggccttggcgggcggccccgggagtggcggcggcggcgtggtggtcggcgtggctgaggtgagaaactggcgctgctgctgcctcggcagcacctgttggtgccggagcctcgtgctggtctgcgtgttggccgccctgtgcttcgcttccctggccctggtccgccgctaccttcaccacctcctgctgtgggtggagagccttgactcgctgctgggggtcctgctcttcgtcgtgggcttcatcgtggtctctttcccctgcggctggggctacatcgtgctcaacgtggccgctggctacctgtacggcttcgtgctgggcatgggtctgatgatggtgggcgtcctcatcggcaccttcatcgcccatgtggtctgcaagcggctcctcaccgcctgggtggccgccaggatccagagcagcgagaagctgagcgcggttattcgcgtagtggagggaggaagcggcctgaaagtggtggcgctggccagactgacacccataccttttgggcttcagaatgcagtgttttcgattattataagtataggcctcatgttttatgtagttcatcgagctcaagtggaattgaatgcagctattgtagcttgtgaaatggaactgaaatcttctctggttaaaggcaatcaaccaaataccagtggctcttcattctacaacaagaggaccctaacattttctggaggtggaatcaatgttgtatgattctaatgagatacgtgattgtcaagagcctagtgtgctatctaaggtctagcagtcacttcactagtgggcagagacaagttctaattgtattacagcacaaacaaaactgactagtttttaaattgcacaattttttttttttaaagcaagaatcattttctgggtatgtaagtgtaaatgtagatgcaaatttggctgcacctctttatcatgcctgtattggcctataggtctgcactttagtgttttttaattgttttatttctgtgtatttacgaacagagaaataacccaaatattatttctgcttagtgtctttatttataaagcccatgagtagtttgtatgcatctttcctacttgtaaagatgagtaaaagtatgcagttttaaatttataatattattggatgttctttgctttggtagtctttccagaaaggataaacagtggtttttgttttgttttgttttattgtttaagtgggaccacttagcttcccgtttccttactagttaaagaacagacattaattttcagttgaatgtatttttgcaggcatcatattgttacagggccatttacacctattcacaaagcttaaatcctaccttgtgggactgaagtgctcttaatataactgtttattttcactgtgtaatatgcaaagcaaaagggaaattatttggtggatggtagctcaaaattggaactcttgttctaattcagttacattggctttaccctccttagatttttcatcaaagggctgtcccattgcaatcttactaaaacattttgttaaaataaactcttttcctttttatattaataattaggcttttaaataaagatgttattcctttaaaatggtgggcttaccatcattgaagatgtcactcaggtggccttgtttgatcaaaacgccttttttaaaaaccaagctttaaaaacatgtttataatttcatgaagtacatatatattgttcccatagtcttcagctttaaaactataaatatgcccaaattttgttatttgccctactttaagtaggtttattgtgtttgttttttcagtacttgtttttctctgataagactcaggaattctgaaatgtgaaattgtctcaattctttctcttgtagcatgaatcaaatgtatttattaatagcacttatgactatagaatataatttggcatatgattcatattacatatgtattcgttttatttttaaaatagtttataaacttaatgatttttttttacaaatgaggttatagatattaatgcaaattttctggtaggtatctctttttttgctatgatgattccaacttatcagagacctcccatttgccttttcattacggtgaaagctttgccctcatctactaaagtacaaaggaattctttggaagcagattattctagtcttatgctagagatgaatttgatcattttaatgtgtgatctttttgctctatcaggtataattgttttcctttcctttataatgggtaagttttctcacctttgagtaacagtaaagttcatttatatgtccatacctagaagaccagtgcaaatactttgagagcacctgggtctacaggacataattggcatctaaatcctcatttcttgctattagtaggaaaacagatatagtattgtaatacccttattctttttgaatcctaattactcatttcggttttttttctctcttttgaatctagttgctggttttcgtttaatgattttagtttaacaatcccaaccaacaatacatttgatttatttttttctgtctaacctgacaacctttttcttgtgcttcttgtttgttggttagtttttgtgaaaggaatcattgtttaagatcactgttttcatacttgttttacacttcacgtattttgaagtacatttatttactaagcatttgtgacttgaataatttcaccaaatgaatacattttggtagtttgtaatgagttcttctaattgttacactttgcttggtacttaacaataaatatgtaaaggtaaaagaaataattttctgtattctgccaatcttaattttatataataaatcatccatttttttcttaaaatagtatggattgactgtttctaaaataccaatctgtggctgtggtttttcttttcttcagcatttccagcatccaagtaaacaatagtcccttatagtcctgctacttgatgggtaaatttggttgctgggtttttaagttgcactcacaataaatcgtgcaaagcattgtcatgccttatttactccatttttaatcctgcatcccagatttatggcagcaacacatatctacaggatacttttatgttgtccaaatattgctgtcagtcatatgtacttataaaatgtctccactcatgtatatttatagaaatgaaatgtcaaatttctcagactgttaaagtgcagtataaagttgcttaatgcacacttaaaaatgatatataatttctgaatcctatgaaatatgtgttcttttttaattctttgggagttttcttaagttttacatgttttttggtttattgttaatgattttgtttactctttgccaaattttgtcatgtaggttattttacaatagcacctttaaaaaaaatgtatatgctaatttactaagcatattcatgtccatttttatttgatcatctgatttgtgaaataacttgaaatttgtactgtttggtttgtgaaaataatattaccaaatctctgtcattagaatgtgtactttatgttcagaagtgactgtgggtttattcagagccagccattctctcccttgatgcactttgtaaccagctacacatgcttttaggtggcttttccctgatagggtcaagtatatgactataaaacatttttcttgtgaagctattaagttcattagttactcttatttccccttgttgtaactaagtggtgcaggtataagcatatccccagcattcctgtgtgtgtgaatgtgcactgctgatttggactgttcttgagaaaggtgctgtgacatatgtcaatatttgttagctctggggatatctttagaatgcttgagaaagttgctaggtgtgtgccacattggtgcaggtaaatccatgctgttcacagccaagcagcatttgcagagaaaaggagagttttacatagaccccaggaaaaacagtactaacctggttgatggccttggtggtggaattttgtttcagccagaggctactcattatatcagaatgatgttcagtataacactatctgatttttagattggtcgatttctgttgtaatcaagtatttaggatgtaatctttttaaagtcattgctttaatctgaaaagccattagaagggagaggaatcactgttccacaggatatttaaaactcaggagttcaaataacctcacatattgaacataaactgttaacttattccacaactaaattctaacctgatacttatgaattgcaaagtgattgctgcaaactttttctaaggtggctgaagatttaaaatagatcattctaaagggaaatcagtaaaatgtcttgataattggtatccaaatcacttgtgtgcctgagaaaataaaaggtaatattttactttc

SEQ ID NO: 7603 - DNA, 4997 bp, Homo sapiens
actccccgcctggccgtcgctcctccgctgactccgcgcccttctacgggccgtctcccaccctctgagcggacgcagggagtcgatgccgggcgaaccgggcgccatgaagggcagctgcctaacgggcgccgcggcggaggggctggccggctgagggcccgcgctgggccgaggcatgcggagcccgggcgggatcctgctccaggcgctgccccggctgctgcagcacgccgccctcccgggcctcgccgagctgccggcccgctgggccctgccgcggggtgcgggcggggacggcccggcggaccgccttccccgcgggggcggggcgagcgcggcggcggcagcagcggcggcctcgggcgccctgctcggcgcctatctggagcgccacggtccgcccgaggcttcggagctgccggagccgggcggggccttggcgggcggccccgggagtggcggcggcggcgtggtggtcggcgtggctgaggtgagaaactggcgctgctgctgcctcggcagcacctgttggtgccggagcctcgtgctggtctgcgtgttggccgccctgtgcttcgcttccctggccctggtccgccgctaccttcaccacctcctgctgtgggtggagagccttgactcgctgctgggggtcctgctcttcgtcgtgggcttcatcgtggtctctttcccctgcggctggggctacatcgtgctcaacgtggccgctggctacctgtacggcttcgtgctgggcatgggtctgatgatggtgggcgtcctcatcggcaccttcatcgcccatgtggtctgcaagcggctcctcaccgcctgggtggccgccaggatccagagcagcgagaagctgagcgcggttattcgcgtagtggagggaggaagcggcctgaaagtggtggcgctggccagactgacacccataccttttgggcttcagaatgcagtgttttcgattactgatctctcattacccaactatctgatggcatcttcggttggactgcttcctacccagcttctgaattcttacttgggtaccaccctgcggacaatggaagatgtcattgcagaacagagtgttagtggatattttgttttttgtttacagattattataagtataggcctcatgttttatgtagttcatcgagctcaagtggaattgaatgcagctattgtagcttgtgaaatggaactgaaatcttctctggttaaaggcaatcaaccaaataccagtggctcttcattctacaacaagaggaccctaacattttctggaggtggaatcaatgttgtatgattctaatgagatacgtgattgtcaagagcctagtgtgctatctaaggtctagcagtcacttcactagtgggcagagacaagttctaattgtattacagcacaaacaaaactgactagtttttaaattgcacaattttttttttttaaagcaagaatcattttctgggtatgtaagtgtaaatgtagatgcaaatttggctgcacctctttatcatgcctgtattggcctataggtctgcactttagtgttttttaattgttttatttctgtgtatttacgaacagagaaataacccaaatattatttctgcttagtgtctttatttataaagcccatgagtagtttgtatgcatctttcctacttgtaaagatgagtaaaagtatgcagttttaaatttataatattattggatgttctttgctttggtagtctttccagaaaggataaacagtggtttttgttttgttttgttttattgtttaagtgggaccacttagcttcccgtttccttactagttaaagaacagacattaattttcagttgaatgtatttttgcaggcatcatattgttacagggccatttacacctattcacaaagcttaaatcctaccttgtgggactgaagtgctcttaatataactgtttattttcactgtgtaatatgcaaagcaaaagggaaattatttggtggatggtagctcaaaattggaactcttgttctaattcagttacattggctttaccctccttagatttttcatcaaagggctgtcccattgcaatcttactaaaacattttgttaaaataaactcttttcctttttatattaataattaggcttttaaataaagatgttattcctttaaaatggtgggcttaccatcattgaagatgtcactcaggtggccttgtttgatcaaaacgccttttttaaaaaccaagctttaaaaacatgtttataatttcatgaagtacatatatattgttcccatagtcttcagctttaaaactataaatatgcccaaattttgttatttgccctactttaagtaggtttattgtgtttgttttttcagtacttgtttttctctgataagactcaggaattctgaaatgtgaaattgtctcaattctttctcttgtagcatgaatcaaatgtatttattaatagcacttatgactatagaatataatttggcatatgattcatattacatatgtattcgttttatttttaaaatagtttataaacttaatgatttttttttacaaatgaggttatagatattaatgcaaattttctggtaggtatctctttttttgctatgatgattccaacttatcagagacctcccatttgccttttcattacggtgaaagctttgccctcatctactaaagtacaaaggaattctttggaagcagattattctagtcttatgctagagatgaatttgatcattttaatgtgtgatctttttgctctatcaggtataattgttttcctttcctttataatgggtaagttttctcacctttgagtaacagtaaagttcatttatatgtccatacctagaagaccagtgcaaatactttgagagcacctgggtctacaggacataattggcatctaaatcctcatttcttgctattagtaggaaaacagatatagtattgtaatacccttattctttttgaatcctaattactcatttcggttttttttctctcttttgaatctagttgctggttttcgtttaatgattttagtttaacaatcccaaccaacaatacatttgatttatttttttctgtctaacctgacaacctttttcttgtgcttcttgtttgttggttagtttttgtgaaaggaatcattgtttaagatcactgttttcatacttgttttacacttcacgtattttgaagtacatttatttactaagcatttgtgacttgaataatttcaccaaatgaatacattttggtagtttgtaatgagttcttctaattgttacactttgcttggtacttaacaataaatatgtaaaggtaaaagaaataattttctgtattctgccaatcttaattttatataataaatcatccatttttttcttaaaatagtatggattgactgtttctaaaataccaatctgtggctgtggtttttcttttcttcagcatttccagcatccaagtaaacaatagtcccttatagtcctgctacttgatgggtaaatttggttgctgggtttttaagttgcactcacaataaatcgtgcaaagcattgtcatgccttatttactccatttttaatcctgcatcccagatttatggcagcaacacatatctacaggatacttttatgttgtccaaatattgctgtcagtcatatgtacttataaaatgtctccactcatgtatatttatagaaatgaaatgtcaaatttctcagactgttaaagtgcagtataaagttgcttaatgcacacttaaaaatgatatataatttctgaatcctatgaaatatgtgttcttttttaattctttgggagttttcttaagttttacatgttttttggtttattgttaatgattttgtttactctttgccaaattttgtcatgtaggttattttacaatagcacctttaaaaaaaatgtatatgctaatttactaagcatattcatgtccatttttatttgatcatctgatttgtgaaataacttgaaatttgtactgtttggtttgtgaaaataatattaccaaatctctgtcattagaatgtgtactttatgttcagaagtgactgtgggtttattcagagccagccattctctcccttgatgcactttgtaaccagctacacatgcttttaggtggcttttccctgatagggtcaagtatatgactataaaacatttttcttgtgaagctattaagttcattagttactcttatttccccttgttgtaactaagtggtgcaggtataagcatatccccagcattcctgtgtgtgtgaatgtgcactgctgatttggactgttcttgagaaaggtgctgtgacatatgtcaatatttgttagctctggggatatctttagaatgcttgagaaagttgctaggtgtgtgccacattggtgcaggtaaatccatgctgttcacagccaagcagcatttgcagagaaaaggagagttttacatagaccccaggaaaaacagtactaacctggttgatggccttggtggtggaattttgtttcagccagaggctactcattatatcagaatgatgttcagtataacactatctgatttttagattggtcgatttctgttgtaatcaagtatttaggatgtaatctttttaaagtcattgctttaatctgaaaagccattagaagggagaggaatcactgttccacaggatatttaaaactcaggagttcaaataacctcacatattgaacataaactgttaacttattccacaactaaattctaacctgatacttatgaattgcaaagtgattgctgcaaactttttctaaggtggctgaagatttaaaatagatcattctaaagggaaatcagtaaaatgtcttgataattggtatccaaatcacttgtgtgcctgagaaaataaaaggtaatattttactttc

SEQ ID NO: 7604 - DNA, 873 bp, Homo sapiens
tgtcatccccgcacgtagcaacgcgcggaggggagcgggctctgcccccggcacggccatcggccacggctggagatagcctggggacccctaccagccccacgacggccccaagtgcagggatggaggagggcgtccggacagagagaagggacgaatggcagggcgtttgtcctgagcagccaaagcgcaagctatctcagctcagttcagaacccttgctggagaggtggtgcagtcatttggaggaaagaagaactctggctttttgaattaattcatgaaagctgagcaaattaaagatgagtctttaaagataacacaaaaagttcccagccaagatggacgaataggaacaactctggtctgcagttcccagtgagaccaatgcagaaggaggaggatgaagctcagaaagttcagttgacctgagaaaagtcacacagacagtgactagcaaaactgcaagcggactaatacttacctgattcgaagtctcctgatggttttgctatgcctccacgtattactgatctctcattacccaactatctgatggcatcttcggttggactgcttcctacccagcttctgaattcttacttgggtaccaccctgcggacaatggaagatgtcattgcagaacagagtgttagtggatattttgttttttgtttacagattattataagtataggcctcatgttttatgtagttcatcgagctcaagtggaattgaatgcagctattgtagcttgtgaaatggaactgaaatcttctctggttaaaggcaatcaaccaaataccagtggctcttcattctacaacaagaggaccctaacattttctggaggtggaatcaatgttgtatga

SEQ ID NO: 7605 - DNA, 587 bp, Homo sapiens
atgtcatccccgcacgtagcaacgcgcggaggggagcgggctctgcccccggcacggccatcggccacggctggagatagcctggggacccctaccagccccacgacggccccaagtgcagggatggaggagggcgtccggacagagagaagggacgaatggcagggcgtttgtcctgagcagccaaagcgcaagaattcatgaaagctgagcaaattaaagatgagtctttaaagataacacaaaaagttcccagccaagatggacgaataggaacaactctggtctgcagttcccagtgagaccaatgcagaaggaggaggatgaagctcagaaagttcagttgacctgagaaaagtcacacagacagtgactagcaaaactgcaagcggactaatacttacctgattcgaagtctcctgatggttttgctatgcctccacgtattactgatctctcattacccaactatctgatggcatcttcggttggactgcttcctacccagcttctgaattcttacttgggtaccaccctgcggacaatggaagatgtcattgcagaacagagtgttagtggatattttg

SEQ ID NO: 7606 - DNA, 3228 bp, Homo sapiens
gccgctaggggtagcggcggcggcggcggctgcggctcgggagcgcggctgctttgagggctcgggaaccttacagagtggggacgtggggaggctagagggtgagaaagctggcgggagagtagggcggcgctggaggagggcggtgcgtggctgactcatcctctggaagatcagactgacagagacacacactagcccgccccgcccgcccgcgccgctcctcctcagccgggaggcgcccgcccgcaccgaccgcccgccctctccgggcgctgtccgggcccggccgtctcagagaaagtttttcccatcggaggggcgggagccgccgcgggccttttggaaaggaagtggggacggaacaggaggcgagagccgcgcgggcccgcggagtgcatggtgcccggcgcctcggctgcctggcaggaggacctcggggcggggtcgagctgagcccagctccttctcgcctcagccgcgccagaaaccgccttgccggacggccgcgggggtcccagctcctcagctcgccatgtcccggctgctgccgctgctgaggagccggaccgcgcgcagcctgaggccgggcccggccgccgccgccgcgccccgcccgccgtcctggtgctgctgcgggcgggggctgctggcgctcgcgccccccggcggcttgccgggcggccccaggcggctgggcacgcaccccaagaaggagcccatggaggcgctgaacacggcgcagggcgcgcgcgacttcatctacagcctgcactccacggagaggagctgcctgctcaaagagctgcaccgcttcgagtctattgccattgcccaagaaaaattggaagctccaccacccaccccaggacagctgagatatgtattcatccacaatgcgatacctttcatagggtttggctttttggataatgcaattatgattgttgctggaacccatattgaaatgtctattggaattattttgggaatttcaactatggcagctgctgctttgggaaatcttgtgtcagatctagctggacttggacttgcaggctacgttgaagcattggcttccaggttaggcctgtcaattcctgatctcacaccaaagcaagttgacatgtggcaaacacgtcttagtacacatttgggcaaagctgttggggtgactattggctgcattctaggaatgtttcctttaattttctttggaggaggtgaagaagatgaaaaactggaaacgaaaagttaatcctcttagaatacctataaaaagatgtaaactaatgtacctcagtaattaaatatgctgtcacaacatttaggaattaagacagtaacagtatagatatgggatcaaataatttagcatgtattatggaaaacactaacttattgtggcttgatcttcttaggacatcttttttaaaaagctgtttagtatcattttgtgtatattgttgaaatgctttttcatcaatagcagtcaacattttatcctttctttttatattcataatgttatttaagtgtcattgatgtactgtattgacttggggtttgcttatttgttacttaacatgtgtacatgcatgaaagcatttttcgttgttccctgatagttacatttcaaccttgggatttttccaaattacttaagatgtttaatgtcagttaaagatttttttaccctctttttgggaacatcaattttgtactgttatgcagtaaacatttataataatataatttcagtcatttcttaactgtcacatctattgaaaatggatatagatacaggttttaagtattttaagtatatattacttattttaattttctgactttactattttaagggccagagggttaatcacaaagagcaattatgtggtctccctgctacatgaaaccgtgtatactaacaagcgtacaatttttagttgattttttttaaccttttagtttcccagttttgaataattacatggtggattctgacttttgaggggaagcaaatgattattttagagtctttgaaatggggattgtggaattagattgaactaagggatttaacatgatgcttggaaattaagagactaaagctttttttaaaaaaaggtggaaaataggaactgtcaagaaggtttatggtataaatgatgaagttgaagtgatgtttgaaagattaatgagatacaatttatattatttggtaaggtttttttttttccctccaaagatgtcatcttctcatctgaatggaataagtctgaataccccatattcatactcctaatctcattatatcttatttagtgaattttatttatgaataatttctgttgaagtgaaaactagatatttaatattttgcttttttgctacatagtctactcaaaaattacatgaggagaaatcctttttccctttgtttttcttttttcttcttttgtggtatttaaagcatattttaggttgaagttacttatttctagtcttgtacttctggcttaagtataaccatgtaagaattataaattttagttttctgaacccttaaacttttttagcatgtggtctgttacacatgctaaaaaattagtcttacttgtaacagcgtaattaaacacatcatggaggagagaaacttaaaattaaaatagtattttggcttttgaagttatttgtgttgctaaatagatgcagaggttttacagcagtttattttaaggttttatttatacataattactttgaactcttcagagtagatattttttcacaaggcagtttgtcataaattctctcatgcgcttcagaatgcataagtgccatcctttaatcatagactttgaggagagaaagcataaaaatatagcatataatctaaaaataaatatataacatgcacaaataatgtgacattcttactgaatcaaatcatgattctagaacttgagatcttaaatagaatttcggtttgtatcttccatataataaccacacacagataaccacacaaaaaatcctttgtaaaatttctgattgataggattagagtgcttaaatttttggggggggaagggtggggtaaagtgtaagtgctttcttttgtccctaacttgtgtattgatggcagtccactctgttttctaaaaatgtattttactgtggtgcttaacttcttattaattaaatcccgtatcagaaaccttg

SEQ ID NO: 7607 - DNA, 2154 bp, Homo sapiens
acaccgcctcgccccgccccaagccgcgctgtgctccaggggcgggggcccacggcggccactcactgagccccacgggccgcagcggcagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccattgtggtactccttgggatcgcgtttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtagaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggggtttagtctcattctttctattagcctaggcgcaaataaatgttactttttgtttttttaaaccctttttcccaaaggggaaagtt

SEQ ID NO: 7608 - DNA, 1053 bp, Homo sapiens
atcttcatcgagcgccatggccgcagcctgcgggccgggagcggccgggtactgcttgctcctcggcttgcatttgtttctgctgaccgcgggccctgccctgggctggaacgaccctgtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccattgtggtactccttgggatcgcgtttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgtt

SEQ ID NO: 7609 - DNA, 1529 bp, Homo sapiens
ccttcgccgccgccaggggtagcggtgtagctgcgcagcgtcgcgcgcgctaccgcacccaggttcggcccgtaggcgtctggcagcccggcgccatcttcatcgagcgccatggccgcatttgtttctgctgaccgcgggccctgccctgggctggaacgaccctgacagaatgttgctgcgggatgtaaaagctcttaccctccactatgaccgctataccacctcccgcaggctggatcccatcccacagttgaaatgtgttggaggcacagctggttgtgattcttataccccaaaagtcatacagtgtcagaacaaaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccattgtggtactccttgggatcgcgtttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaa

SEQ ID NO: 7610 - DNA, 1887 bp, Homo sapiens
actgagccccacgggccgcagcggcagtgacgtagggttggcgcacggatccgttgcggctgcagctctgcagtcgggccgttccttcgccgccgccaggggtagcggtgtagctgcgcagcgtcgcgcgcgctaccgcacccaggttcggcccgtaggcgtctggcagcccggcgccatcttcatcgagcgccatggccgcagcctgcgggccgggagcggccgggtactgcttgctcctcggcttgcatttgtttctgctgaccgcgggccctgccctgggctggaacgaccctgacagaatgttgctgcgggatgtaaaagctcttaccctccactatgaccgctataccacctcccgcaggctgggatgggtatgatgtacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccattgtggtactccttgggatcgcgtttgtagtctataagctgttcctgagtgacgggcagtattctcctccaccgtactctgagtatcctccattttcccaccgttaccagagattcaccaactcagcaggacctcctcccccaggctttaagtctgagttcacaggaccacagaatactggccatggtgcaacttctggttttggcagtgcttttacaggacaacaaggatatgaaaattcaggaccagggttctggacaggcttgggaactggtggaatactaggatatttgtttggcagcaatagagcggcaacacccttctcagactcgtggtactacccgtcctatcctccctcctaccctggcacgtggaatagggcttactcaccccttcatggaggctcgggcagctattcggtatgttcaaactcagacacgaaaaccagaactgcatcaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtagaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatctt

SEQ ID NO: 7611 - DNA, 2401 bp, Homo sapiens
ggtgtcacccccatcgcggcccgggctgcagccgccgcttggcttctttcacacgggttgcttcggaggaatccgccgtgcaaatctgtccgcccccttggccactgatcccccgaagagcttctgtcgccgctctaggaatagagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccagggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtgacgaagaatgctgttcaagctttgattgataagcaccaaagaataccaggaaacattatgagtgctttgttagaacgttttcattgataacaaagggtcaactagaagatgatttagtacatttatattaaatgtttgtatctaaggtactgtcttctgaattttgtaggtcctataattagtattttttaaaaaaatcatgttaataagcatctttcacagaattcgtttctttaaaatagtcaattttgtttttgcaattgtgtcaaatactaacaaattacacacctagtaattcagaaaaagatgtcttatttgtaaattcctaacaatttatgctaaacatatagattcttaagtttattaataacagcagtttaggttaaacaaacattcctggataatgcgttaaatttctgtatctgtcgccctgagctgattttgaaagatggtataagctaggggttagtatagttgtttaagttagaaaaaacatgctgttgtctgcccctcattcccttcatgaccttgggcaagtcacgtaatgtttttgtgcctcaacaattcactttttaaaaacatgatcgtatgatgaatgatattattttgttatttatatttactgtgattgataactgttgaaccaaaataataaaataattaatttaaacaatgtcaaaatcctttagcagttatgtatatattttctccattgtgtgtttaaattatgtcatgtccagttgccaagcacaatgaaaaagatgtattattttttaaattgaataaaaaattaggaaaaataaaatttctaattattatttttagtatgatatttttaacaagagtctataggcaaacaatatagggtgtgctgtgcattgtcagccctatactgtggtcttaataatgccagcttaaaaatcactgttgtgctctgcatttcgtgtgttagaagctgattctaggctgaggaaagcaagagttctctacttttgctcaatattgaggcttacccagtttgactctacagccagtgaagtggtttattgcttcaataaaaatatacttgaatgatgaatttatttatgttttgttttgtttttatttagagatggggttttgccatgttggccaggctggtcttgaactcctgacctcaggtgatccacctgcctcagcctcccaacttgctgggattacaggtgtgagccaccatgcccagcctgaatgatgaatttatgtgaacacaaagccctctgaaaaattaatgattttcaatttgttgtcttcttgaaaactgaatttaagtattatttaaacagaaaagtgtcagaaatcaaatgcagtatctccctctcccttttttaaatgttgaattagtagggtttttgtatagctttttgtattgtgtgtatttatgatatgtgaaatgtacataaaattaaacaatgtgaaaataaa

SEQ ID NO: 7612 - DNA, 2549 bp, Homo sapiens
cgggttgcttcggaggaatccgccgtgcaaatctgtccgcccccttggccactgatcccccgaagagcttctgtcgccgctctaggaatagagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccagggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtgcccattattcctatgtttacacaaaatattcgagaaggatttagatcacttggaggaacaaggttatttaggtggctttatgaaaaattccgctatccatttgctccaatgtatggaggttttccagtgaagttacggacctatttaggcgaccccattccgtatgacccacagataacagcggaagaattagctgaaaagacgaagaatgctgttcaagctttgattgataagcaccaaagaataccaggaaacattatgagtgctttgttagaacgttttcattgataacaaagggtcaactagaagatgatttagtacatttatattaaatgtttgtatctaaggtactgtcttctgaattttgtaggtcctataattagtattttttaaaaaaatcatgttaataagcatctttcacagaattcgtttctttaaaatagtcaattttgtttttgcaattgtgtcaaatactaacaaattacacacctagtaattcagaaaaagatgtcttatttgtaaattcctaacaatttatgctaaacatatagattcttaagtttattaataacagcagtttaggttaaacaaacattcctggataatgcgttaaatttctgtatctgtcgccctgagctgattttgaaagatggtataagctaggggttagtatagttgtttaagttagaaaaaacatgctgttgtctgcccctcattcccttcatgaccttgggcaagtcacgtaatgtttttgtgcctcaacaattcactttttaaaaacatgatcgtatgatgaatgatattattttgttatttatatttactgtgattgataactgttgaaccaaaataataaaataattaatttaaacaatgtcaaaatcctttagcagttatgtatatattttctccattgtgtgtttaaattatgtcatgtccagttgccaagcacaatgaaaaagatgtattattttttaaattgaataaaaaattaggaaaaataaaatttctaattattatttttagtatgatatttttaacaagagtctataggcaaacaatatagggtgtgctgtgcattgtcagccctatactgtggtcttaataatgccagcttaaaaatcactgttgtgctctgcatttcgtgtgttagaagctgattctaggctgaggaaagcaagagttctctacttttgctcaatattgaggcttacccagtttgactctacagccagtgaagtggtttattgcttcaataaaaatatacttgaatgatgaatttatttatgttttgttttgtttttatttagagatggggttttgccatgttggccaggctggtcttgaactcctgacctcaggtgatccacctgcctcagcctcccaacttgctgggattacaggtgtgagccaccatgcccagcctgaatgatgaatttatgtgaacacaaagccctctgaaaaattaatgattttcaatttgttgtcttcttgaaaactgaatttaagtattatttaaacagaaaagtgtcagaaatcaaatgcagtatctccctctcccttttttaaatgttgaattagtagggtttttgtatagctttttgtattgtgtgtatttatgatatgtgaaatgtacataaaattaaacaatgtgaaaataaa

SEQ ID NO: 7613 - DNA, 639 bp, Homo sapiens
agtctcttcgcgggcaggctcggcttcccgccggcctcagtgttgcgccccagcgccagagtggccgggtgtggagatcctccctcctctgggtcaaagagcctgctctccccgcccctcttctcccctggcgctctaaaccttcgaatagagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggttatgaagttcatggaatggaaaaaataccagaagatggaccagcacttataa

SEQ ID NO: 7614 - DNA, 2400 bp, Homo sapiens
ggcttctttcacacgggttgcttcggaggaatccgccgtgcaaatctgtccgcccccttggccactgatcccccgaagagcttctgtcgccgctctaggaatagagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggtaagcaaggatactttcacctttgtgttgccattcatgtgtgctgcattggaactgtgttaccattccattttattgattgagaagatactgaaaaatataatagaagtgatatttactattccctgttacctgtttgcatgcattgtgcatatgtatgtgtctttcttaaaatgagttttcccatagacgttggtttccattaaacaaagaaccacgcagcactgtagactataagttgaaataagaaaatttatatttaaaacatctaaaagagtaagagactaaataaagctgtagaaaactgctttaaaaatgcttcaattatttagcatttacttctgttcaaaataagtttgactctaccagtgtggatttaaaaaaatgaaatattaaataatattacattaaatataatttgcataccaaaatttatgcattttctgttgattcattcctgaggttggtgtgtctttctgaataaataagatagcaatagatttctctccaggatagtcattcttttctttattactcgagaaattttgatgttgtatacttaatgattggtggttcttctttgtttggccatcatgaaaattgccttctggtggcctatttttaagtggttagtgtttcactctaccaacttttacttcattattccaacaatatctagtttgttggtctcttttgtttttagactacacaaaaatactgaagattcaataggcaggtaacaaacattggctttctgtattatgttgttgagcatcacagtggtttcatagaaggacatggaaggaagcacagactttaaaagacacttgaggatatatatcactgaactattaggctgctattagcagaaatcaccagtgacatgcttattagactaatgtattttcattttaatactacatacatacttaacgaacctacaaattttttttgagcacctacctatgccagacactgtcaattgcttaatataaattaactgctttaaatctcattaacataatggagtctatgtggtaccccgattatactcatgaggaaactgaggcacagagaggttgttatttgcccaaggtatactaggaatagggccaggttacaaccccagatacctgggagtatacatttgagagagctcttggaggtaaaataaacagaacttggggactgagtgtagagtcttgagggaggaggagttaaagtccagtaagatttctactgctagacagggaaacatgaactggaagtgctccaagtaatagcaaccatgtgagcagaagcacaaaggtggaaaagtactctgggagccacagttagttcatatgatacatgaaataatgtaatgtcactttataggcaattggggcctcaaggggcttgaaaatgttggactagagtggtaatgcactgatactttctcagcagggagtagtatgatcacatctgctctaagagtgacacagttaaatagccctaggttttaaggtttactggcactatagtaaactattttttttaaatatttgattagttggatttttctgctttcaaccaggtggtttggtattatgtgagtagttcaattgtttattatttaaaaaaatactctgtaaaaccagagagaaccttggtaatattctgtatagaatccttcaaaggagtttctttattgctcagaaaatgtatttgatgggacagttgatcctcaaactcagtgactgttttgtagagcttaaagtaaattgaattacttgagttagaattatgtaattggaaagaaatgatataatatggaaacatacaaaatcttggaatatcattaaattatttttcaaaacatt

SEQ ID NO: 7615 - DNA, 1000 bp, Homo sapiens
tgcagccgccgcttggcttctttcacacgggttgcttcggaggaatccgccgtgcaaatctgtccgcccccttggccactgatcccccgaagagcttctgtcgccgctctagggtaaaggagagctgcccctgcccctgcccccgcctatccgagaatagagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattccagggtttagtttattactggatgtgttttgtgctctacatggaccaagagaaaaatgtgttgaaattctgaggagtggccacttgttagctatctcaccaggtggagttcgagaagccctaattagtgatgaaacttataacatcgtatggggtcatcgcagaggctttgctcaggttgcaattgatgcaaaagtgcccattattcctatgtttacacaaaatattcgagaaggatttag

SEQ ID NO: 7616 - DNA, 826 bp, Homo sapiens
agccgccgcttggcttctttcacacgggttgcttcggaggaatccgccgtgcaaatctgtccgcccccttggccactgatcccccgaagagcttctgtcgccgctctagggtaaaggagagctgcccctgcccctgcccccgcctatccgagaatagagacattgaagtttgggacaagatatttatctaacttctgtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggtaagcaaggatactttcacctttgtgttgccattcatgtgtgctgcattggaactgtgttaccattccattttattgattgagaagatactgaaaaatataatagaagtgatatttactattccctgttacctgtttgcatgcattgtgcatatgtatgtgtctttcttaaaatgagttttcccatagacgttggtttccattaaacaaagaaccacgcagcactgtagactat

SEQ ID NO: 7617 - DNA, 510 bp, Homo sapiens
agccgccgcttggcttctttcacacgggttgcttcggaggaatccgccgtgcaaatctgtccgcccccttggccactgatcccccgaagagcttctgtcgccgctctaggaatagagacattgaagtttgggacaagatatttatctaacttctgagttatctcaatatggctgggcatggtggctgatgcctgtaatctcagcactttgggaggctgaggtgggtggaccacttgaggtcaggagtttgggaccagcctggccaacatagtgaaaccctgtctctactaaaaatacaaaaattagccaggcatggtggcacatgcctgtagtcccagctgctcgggatgctgaggcaggaggattacctgaacctgggaggcagaggtttcagtgactgagatcgtgccactgtactccagcccgagcaaaaggtgtcaaaattagcgacctgctatggcaatgaagaaagaaactgaatttgtcattttcacctgaagaaaaatgata

SEQ ID NO: 7618 - DNA, 710 bp, Homo sapiens
gccactgatcccccgaagagcttctgtcgccgctctaggaatagagacattgaagtttgggacaagatatttatctaacttctgagttatctcaatatggctgggcatggtggctgatgcctgtaatctcagcactttgggaggctgagtgtcaaaattagcgacctgctatggcaatgaagaaagaaactgaatttgtcattttcacctgaagaaaaatgatagacaaaaatcaaacctgtggtgtaggacaggattctgtgccctatatgatttgtctgattcacatactcgaagaatggtttggtgtggagcagttggaggactatttgaattttgcaaactatctcttgtgggtttttacaccactaatacttttaatacttccttactttactatctttcttctctaccttactattattttcttacacatttataagagaaagaatgtattgaaagaagcctactctcataatttatgggatggtgcaaggaaaacagtggcaactctgtgggatggacatgcagccgtttggcatggttatgaagttcatggaatggaaaaaataccagaagatggaccagcacttataattttttatcatggagctattcctatagatttttactatttcatggctaaaatatttatacacaaaggcagaacttgccgagtagtagctgatcactttgtctttaaaattcca

SEQ ID NO: 7619 - DNA, 4550 bp, Homo sapiens
gatcaagttgggataaagtaatgcttgtggctttaaggatgaaagcttgcgtgccagtgtagaaaccatattcccagactatagtgaggaatactgagcctgctagggtaagctttcttttatttagtgggccctagaaatgtccagcttctagagaggtagctatttaaggaatgatatttcaacaggaaagtctttaaatgcatacatcaatacagaattctgggatcatgccagtcagtagatataaatccagccatactggttggaagtggcaaatggtatatgcatgagctgaaatatttctgtttcttcttggacattttaggttctcaactataaagacattttataactatttaaaacattaggatttcagccatactaatattttattttacaaaactagttttattttacaaaactagtagtgatttccagataacagtctgaattttttactgaagaattcagtgtctgagtattgtggaagctaccaaaataataataataataataattaaaggccaggtatggaggctcatgcctgtaatcccagcactttgggaggctgaggcaggaggatcccttgaaaccagttcaagactagcctgagcaacaaagcaagaacccatctctacaaaaacaagcaaataaactatatttacttatatgtataaataattcagtgtattttgtcttctttatcttcttgtgttttagctttatgagttaactccatcaaattttaatttcttcatttgactgctcttttttacttttaatttttttgagacagagtcttgctctgtcacccaggctggagtgcaatggcgtgatctctgctcattgcggcctccacctcccgggttcaggtgattctcctgcctcagcctcccgagtaggtgggttacagacgctggccaccacgcctggctgatttttgtatttttagtagagatggggttcaccatgttggccaggctggtcttgaactcctgacctcaagtgatccacctgccttggcctcccaaagtgctgggattacaggcatgagccaccatgcccggccctgactgcgcttcttttctttacctaacttctccccttttcctaactgattttgagattgctgctgtctatttctgacttttgtattcagagaatacaaattaattcatttagaagcattgtctctttgctctgtttactcactgtttgtttaattcctccatctcactttctgttagcacctagtggattccaggcacagttctaggtgctatacaacagtgaacaaaacaatgtccttgcagtatattaggcgtcttccttctggcgagaggagagatataacaaatgattggttagttatatgtgaagtagtaggttttatgaaggctttgcctgtagtctctttcctttagtccactgtattttactgttttccaaagcttagtaggaataacttttaagcttatttaaatatctcacctattaagcaggtaattttatattaggcatttactcatggttgactgtaagtaatgtaatactcccccaaccaaaattttatctattctgaaacatcatttaattcagtatattatgtatatttttaagtgtttcattcaattttttatctattttagtattcacagtggcataacctctttacatatcaatacttcattattttatatgtatttaaggttttcattattaaaaatatactgaatcattgatatttttggagaataaaaatcatgaacttattagcagaaattctctacaatcaattatggagaattcttttttttttttttttttttttttgggagacagtgtctcgctctattgcccttactggagtgcagtggtgtgatcttggttcactgcaacctctgcctcctggtcttaaacaatcctcccacctcagcctcccaggtaactgagactacaggcacgtaccaccgcaactggccaaattctttaatatatgtgcttttcctttttgtctgtgtggttgagtcttatagttacttttcattgatgttgagtattttagatttaatagactcacaaaaaattttaccaattccacgacagcatcttgccaaaacttgtcatttaaatatacataaatttccctttggagccaggtgcagtggctcacgcctgtaatcctaacactttgggaaactaaggttggaggattgcttgaacctgggaggttgagactgcagtgagccgtgatcacgccactgcaatccagcctgagccacagagtgagactctgtccccaactccccccgaaaaattacccttagaatccctgcttgcaacttttctccagtgagcgtactattcagtagcccactaaagacaattcagtttaccacattcattttatttagtgaaattaatgattactgtaatctctattttgagtttcaaggttttatgtgaaatgttaggaaaactggtcaatgaaatattatatattaccactggagggtagtgtttccaatttctatttttacaaatgatcaagttgaatttagttgatagactaatcgtgtgcttttattttaaaaatattttattttcataatatcaaacaggccctcaaaagtttgcataatcactttgtgatcccctcacgcccccatgctaatgaatttgtaccccttttctctttctcccatgccaatactaacgagacccgaccctgcttagcttctgggatcagacgagattgggcatgttcagggtggcatggccataggtgccttttctctttcttaaaaaaaaaaagtttgcattagttactctaatggagacattgaatggattaatttatttactttttaattcaaattctccttttctttagcccattattcctatgtttacacaaaatattcgagaaggatttagatcacttggaggaacaaggttatttaggtggctttatgaaaaattccgctatccatttgctccaatgtatggaggttttccagtgaagttacggacctatttaggcgaccccattccgtatgacccacagataacagcggaagaattagctgaaaagacgaagaatgctgttcaagctttgattgataagcaccaaagaataccaggaaacattatgagtgctttgttagaacgttttcattgataacaaagggtcaactagaagatgatttagtacatttatattaaatgtttgtatctaaggtactgtcttctgaattttgtaggtcctataattagtattttttaaaaaaatcatgttaataagcatctttcacagaattcgtttctttaaaatagtcaattttgtttttgcaattgtgtcaaatactaacaaattacacacctagtaattcagaaaaagatgtcttatttgtaaattcctaacaatttatgctaaacatatagattcttaagtttattaataacagcagtttaggttaaacaaacattcctggataatgcgttaaatttctgtatctgtcgccctgagctgattttgaaagatggtataagctaggggttagtatagttgtttaagttagaaaaaacatgctgttgtctgcccctcattcccttcatgaccttgggcaagtcacgtaatgtttttgtgcctcaacaattcactttttaaaaacatgatcgtatgatgaatgatattattttgttatttatatttactgtgattgataactgttgaaccaaaataataaaataattaatttaaacaatgtcaaaatcctttagcagttatgtatatattttctccattgtgtgtttaaattatgtcatgtccagttgccaagcacaatgaaaaagatgtattattttttaaattgaataaaaaattaggaaaaataaaatttctaattattatttttagtatgatatttttaacaagagtctataggcaaacaatatagggtgtgctgtgcattgtcagccctatactgtggtcttaataatgccagcttaaaaatcactgttgtgctctgcatttcgtgtgttagaagctgattctaggctgaggaaagcaagagttctctacttttgctcaatattgaggcttacccagtttgactctacagccagtgaagtggtttattgcttcaataaaaatatacttgaatgatgaatttatttatgttttgttttgtttttatttagagatggggttttgccatgttggccaggctggtcttgaactcctgacctcaggtgatccacctgcctcagcctcccaacttgctgggattacaggtgtgagccaccatgcccagcctgaatgatgaatttatgtgaacacaaagccctctgaaaaattaatgattttcaatttgttgtcttcttgaaaactgaatttaagtattatttaaacagaaaagtgtcagaaatcaaatgcagtatctccctctcccttttttaaatgttgaattagtagggtttttgtatagctttttgtattgtgtgtatttatgatatgtgaaatgtacataaaattaaacaatgtg

SEQ ID NO: 7620 - DNA, 2439 bp, Homo sapiens
gggattccggcgagagcctgcgcttgcgacagtgccgtttctcctacctgaagtctcattgggtatcgcactactggaaggggcggcgctgccatgacagagaaggcaataaaactgaaggcctagctcgactaaaagcgcttactattaaggaagacttcgctgtggctccatccggcacggaaagctaaaccgtgtaatggctggcaaccaggaagctagactacctagaatccggaggattggagggactggccggcgtgggcccctgagatctcctactacatgtcttcagttttatccatagacacggaagggcactaaaattgcctggtgccatttcctgtgaaacaagtctagataagagaagggacttgcccaaggtcacatagccgagaaataaagccgagggcagtaggagaaatgatctgactttccgaaccacccccaagcctagggcccttatcaccacacctttcatggaagtgaaaatcctgctcttgtgctctttaacccttaatgaagtttataggtcccagcaaagaaaatggatgtaagaactgggcttttttccccctctaaatgatagtaaagggccctaatgcagtgagatgtgtccccataggccttataaaccctgttttgcaaagtaaaacataagtcccacagatggcaagcaattcaggtcacactgggcctaaaatcccgtctcttaccttccttcaccaccatcattctgagattgtttcagtacttgcactctacttacccgaactctgtgggcagattctgctgcctgggagccctggaatagaacttcaaggaccgttcaacatctggattcaactagaaattaagaatggcccccaaacagaaagccgggcctaggaaccaattagcgcaggtcaagtccctacccggactcattttttttcagccctcaggaagtaggggcctctctgaatccacttgccggaagtgcctttccagtggacctgggctgttgttgcggttgttttccttctctccgtgcaacgctggcaagtctcaaagtcgccacagaaacatgcccctgattcagtgcctctgcttagctgtaacatgttaatcagaactacctggcatcttcctgaacaagactttcaataggggccagtatgcttcgcttcatccagaagttttctcaagcatcttcaaagatactgaagtactctttcccagtgggactaagaaccagcagaacagatatactttctctcaagatgtctctccagcaaaacttttccccatgtccaaggccttggctttcctcatcatttccagcgtatatgagcaagacacagtgctatcatacatccccctgcagctttaaaaagcagcagaagcaagcacttctagccagaccctcaagcaccatcacttacctaactgacagcccaaagccagcattatgtgtaactctggcaggactaatccccttcgttgctccaccactggtcatgctgatgacaaaaacttatattcccatattagcttttactcagatggcttatggagccagtttcctatctttcttgggtgggatcagatggggttttgctctaccagaaggtagtccagccaaaccagactaccttaatttagctagcagtgcagctcctcttttcttttcatggtttgccttccttatttctgaaagacttagtgaagccatagtcacagtaataatgggtatgggagtagcattccaccttgaactttttctcttaccacattatcccaactggtttaaagccctgaggatagtagtcactttattggccactttttcatttataatcactttagtagttaaaagtagttttccagaaaaaggacataagagacctggtcaagtataaaaaatataaaagtctgggaagtgaggagcacctctgcccagctgctgccccgtctgggaagtgaggagcgcctctgcctggccgcctgaccatctgggaagtgtgacaagcgcctctgcccggccgctgtgcaaccttccacgtgtgaagtgacagccttgtgtgtgatcttttctgtcttccccaagtttgcattttcgacattaaagtttactttttagttaaaagttttaaaaatatatatatataaatacactgtagataacatttgtatgccagctacacctttttctacttctgtttggctttttttccccacaccaatggtaatttatcttcacagattgttcttcatttctagaaattgttacttcatggtaattacttgagcaaaagcttgaaaatccctgacaagtacttttcatctcatagtatattagttttcactcagtcattttatgaataatatagttatccacttaaacatttcaatattttaaccatcttgaaaattaaagattaaaaatcccctttgtta

SEQ ID NO: 7621 - DNA, 3009 bp, Homo sapiens
gatctcaggcggctgggctgcgctggggctgagcggctccagcccaggctggggttgtgtgagcagcaggagcattcttccaaggtaatgattaagctgagtgcctggcaagggcacgggctgagagcacagaaggtgagccctattcacacctcggccaggctgcggtggccaggactggtttgggaaggcagggccccggtgtgcagccacagccagcagcctcctacctacacaagggtgttcgggagcatctcagggccgaagactttgctgcctgccctgccaggactttgtcctcacccctggcaccatgcagctccaggtgttctggactgggctggaatacacctgccggctcctgggcatcaccactgctgcagtgttgatcggcgtgggcactgagaccttcctccagggccagttcaaaagcctggctttctatctgctgtttacaggagccgctgtctccatatgtgaaggggcctactttgtggctcagctgctggccatctgcttccagtgtcaaccagggtccctggcagacagagtaagggagaaagcccactggctgggctgcttccagaagttcctggcctacctgctgctgtcggtggcctgcttcctccacccggtcctggtctggcacgtgaccatcccaggctccatgctcatcatcaccggcctggcctacttccttctgagcaagcggaagaagaggaaagctgcccccgaggtgctggcctccccagagcagtacacagacccctctagcagcgctgtgagcaccaccggctctggggacacagagcaaacctacactttccatggggccctcaaggaggggcccagctcccttttcatccacatgaagagtatcctgaaggggactaagaagcccagtgccctccagccccccaacaccctgatggagctgagcctggagccagccgactccctggccaagaagaagcaggtgcactttgaagacaacttggtccgcatagtcccctccctcgccgaaggtctggatgatggggacagtgagccagaggagaccacctctgacacgacacccatcattccccctccccaggccccactcttcctgtcatctcttacagccaccggcctgttctgagcgcttgctccagcctggaggacgctcagtgaggggtctacctagctcaatggccctccctggagtttcagggtcttctctggtcagcttttcaaggggtaaccagacacccccacactggctgggcccctgaggccatcaggaggtgtgactggccagcatttctggagaggcctcgagggaggcacaaacaaggctcacgccacctcaagccagcacaagctccttcctcctggccacaggtggggaaacccttatgcttccccaacaagaccatcactgccactgcgcacgaggctgcaggtgccattgactcagcccagaagggacagaggatgtctgcccagcaaaagcctctgggcttttcttactcccaacccagggcacaacactcagtgaggaacctatggtccacccatctctgcaggcccagggaagtgtcagtaacttaagcatctctaaggcagagaaggtggctgtgggtcttgaccaaccaagactgctcagggtcgggaggggaggctgcaggcctctggtgggagcagccgggccgtgggccacattctctgcatgctctagggctggggctgagctgctcaggaaaacaatgccgctctgtgctcactgtgggaaagccaggccagatgagcaaagctcattccagaaacatggctggggacttccagcctccttaccacatggcctttccaagattccaggttgatgatgcaaactgaacgcagtgaatgccagggcccagaaggcaatgtctgctgtgggcaggaccacagaggctgcccaggggtggcacagcacagagaagtgtcagtgccgtgtttaggcacttggtagcagaataggtgataaatataaatgtcttcaaaatgaaaggaagtgaggggggaagaagaggagggaaaatgggaggataggaggaagtgggcaggcaggcaagttctctgccatggggccacggaagtgacagttaacccagaaggaacaaagacatctgaatcagatattcctttgtaaatctgtaaaggatttgcaatataggctttacttctaaaaattgttgtcgggtccatgaggctgttgccaggaagagcacacacaccattcttcatggcaactgcagtgagggagcagtcaggaggaagagtcctgtggcttctcagtccctgtggaggctaacgcaaagctctgtagaacaagccttagagtgcatgctctatggtctaatgagaaacttgtgtttgtgcttgcacacgtttcaatgttccctacaggatattttacaaaggtatgaaaataatggccaaccagaagctagtatcagtttggggcctaaatgcagcaggtgttcctgataagcagataagcagagctcttcctgcagtagcccaggtctcaccaaatgacaaatggctaatcaagacactcctgcaagcccttgatggtgagagctgcagagctgtttcttcagctgccatcaaggcaggacctcaggacctgactgtctacagtcagggaatagtgaacaatatgggatatgggtataggtaggtggtagacaaggatcgtgccccatggctgatgggccgggtgtctcaggcaggccccctgtgcacagaaagagcctaagtgcagagaagccaggcatctttcccctgtcaactgtggaaggggaatgtgatggccacagacaccctcatggcacagacatggccagcctctgacgttcctctgcatcagagtagttctgtcctcgaagccccagtcagcagagctggatgaccagatcgcaagaagcaaaccagaaagtgtgatggcagagatgtcagatcccgtttaataaacacttcagt

SEQ ID NO: 7622 - DNA, 1018 bp, Homo sapiens
cgggctgagagcacagaaggtgagccctattcacacctcggccaggctgcggtggccaggactggtttgggaaggcagggccccggtgtgcagccacagccagcagcctcctacctacacaagggtgttcgggagcatctcagggccgaagactttgctgcctgccctgccaggactttgtcctcacccctggcaccatgcagctccaggtgttctggactgggctggaatacacctgccggctcctgggcatcaccactgctgcaggtttacaggagccgctgtctccatatgtgaaggggcctactttgtggctcagctgctggccatctgcttccagtgtcaaccagggtccctggcagacagagtaagggagaaagcccactggctgggctgcttccagaagttcctggcctacctgctgctgtcggtggcctgcttcctccacccggtcctggtctggcacgtgaccatcccaggctccatgctcatcatcaccggcctggcctacttccttctgagcaagcggaagaagaggaaagctgcccccgaggtgctggcctccccagagcagtacacagacccctctagcagcgctgtgagcaccaccggctctggggacacagagcaaacctacactttccatggggccctcaaggaggggcccagctcccttttcatccacatgaagagtatcctgaaggggactaagaagcccagtgccctccagccccccaacaccctgatggagctgagcctggagccagccgactccctggccaagaagaagcaggtgcactttgaagacaacttggtccgcatagtcccctccctcgccgaaggtctggatgatggggacagtgagccagaggagaccacctctgacacgacacccatcattccccctccccaggccccactcttcctgtcatctcttacagccaccggcctgttctgagcgcttgctccagcctggaggacgctcagtgaggggtctacctagctcaatggccctccc

SEQ ID NO: 7623 - DNA, 1730 bp, Homo sapiens
gactgcagatgaaattagtaactggtggggtcgtggggtgtgaatggtgggcgggagcagctatgtcagttggtgtgtttctgcttatgttagggtaattgggcacggcctttgtgtaactggtgaatatctctgaacctgggcatgaaacagagagatgtcctaactctgggtgagaggaatcctcatttttctctgccctctcactgtggcatcctaagaaaaaagttttgggttcctgcagcatgaaggagagctctgctcccagaatttgggagctccagatttcttccagggtgtggaggcatcaatatatcagtctgggaaaggggttcctgggccactccaggagctgagttgggtggaaggtgctgagggtgtgggtgggggccacttctgagcacccatgtggcacccactgctggtccctgtttgtggctgggcactcaggaaaatgtttttggtgctaagagtaaaaagccaaccaacaaacacatctcttttttctgtctattcactggaaagtaaaagcagtctgggcgcaggctggggacccagatggaattcaaacttatgcctgctctcaaggtgctcacggttgctgataaacagctggataaaatgaagagtctatgagtgagggatgcagagccagggaaggctggtggagtgatgccaccagcacaggggtatgagtttgcagctgccaaggggccaagggatgagctggggccctccttcccaatggcatctccccctggtctggaactgaagacactgagcaatggtccccaagccccaaggagatcagctcccctgggcccagtggccccaaccagggagggtgtggagaatgcctgcttctcctcagaggagcatgagacccatttccagaaccctgggaacacgagactgggcagctcacccagtccccctgggggtgtctcctcactgccccgatcccagcgggatgatctgtcccttcattcagaggaggggccagccctggagcccgtgagccgcccggtggattatggctttgtttccgccctcgttttcctggtgagtgggattcttctggtggtgacagcatacgccatcccccgtgaggctcgagtcaatccggacacagtgacagcgcgggagatggaacgactggagatgtactacgcccgcctaggctcccacctggacaggtgcatcatcgcaggcctcgggctgctcacggtgggcggcatgctcttgtcggtgctgctcatggtctccctgtgcaagggcgagctgtaccgccggaggaccttcgtccccggcaagggctccaggaagacctacggctccattaacctgcgcatgagacagctcaatggggatgggggccaggccctggtggagaatgaagttgtccaggtctcagagactagccacaccctccagaggtcttaagaactagcccaccttatctggctgctttagctccagtgctacaaggtccaccccctgctcccgcccacctgacccctgccaaggccctggggttttaaactgagctcacatagggccttgtggaagaagtactgggtgctggagggagagctcggggcccagcccatgccccacacgggcaagcagcccactgatctgttttgtagctgaggttttgcatacggttttgtttggaggatggcttctgctgctaaaaatacaaaagtttggaaaccgctgctcttgga

SEQ ID NO: 7624 - DNA, 983 bp, Homo sapiens
ctcactcccaggggcactttgtgtgtgtgtgtgtgtgtgtgtgtgtgtgtgtgtacgcgcgtgtgcgtgtgacggggtactcgcgtggcccgaagatccgagggtcacactacgtgacttctgggtgtctgtgggtactgctgtgggaacagctgctgggggagtgtgtgtggaactggagtgttcctttcaggacctgtctgactgcagatgaaattagtaactggtggggtcgtggggtgtgaatggtgggcgggagcagctatgtcagttggtgtgtttctgcttatgttagggtaattgggcacggcctttgtgtaactggtgaatatctctgaacctgggcatgaaacagagagatgtcctaactctggtaaaagcagtctgggcgcaggctggggacccagatggaattcaaacttatgcctgctctcaaggtgctcacggttgctgataaacagctggataaaatgaagagtctatgagtgagggatgcagagccagggaaggctggtggagtgatgccaccagcacaggggtatgagtttgcagctgccaaggggccaagggatgagctggggccctccttcccaatggcatctccccctggtctggaactgaagacactgagcaatggtccccaagccccaaggagatcagctcccctgggcccagtggccccaaccagggagggtgtggagaatgcctgcttctcctcagaggagcatgagacccatttccagaaccctgggaacacgagactgggcagctcacccagtccccctgggggtgtctcctcactgccccgatcccagcgggatgatctgtcccttcattcagaggaggggccagccctggagcccgtgagccgcccggtggattatggctttgtttccgccctcgttttcctggtgagtgggattcttctggtggtgacagcatacgccatcccccgtgaggctcgagtcaatccggacacagtg

SEQ ID NO: 7625 - DNA, 1466 bp, Homo sapiens
tgagaaaccagacgggaccacctagagtcggtctccttcccccaaacgccctggacctaccatgggcacaagctggggctcagggaatacctctgtgctccaccactcagcagctgcttttcaagagaaggaaaacactactacacgccatccacagccaccgcacaatactgtatccctttgtcagggataataaaacagacgggaagtcactctggaacttactatggccttgggtcaaaggcaggctgaccggggctggcagaagaaagctaaaacttacttctctgggattctaggaatttcaacaaatgagaccaacagcagatagtttcagattaaagaaaggcaatgtgttcccaaactttgacccctgtgcacaggctctgcagaaaagctgtcactttgcactcagtttccttataggtaaaatggggataataatattgtctgtctgcctaatttgtacaaggctcttacaagagggtatagcacaaagtaagtgcttaataaatgtgagcttttctttgtattcctgtttcatagtatttgtaactatttcacaagattcagaaaccttgtccctggactgtgatcatcgccttttcttcagtcttccattcacagacccagcctctggtgggcagtcacaacacagctggccatgtccagagaggtccaaaaacctgccccaggtgtcaaagcagctaagaaacagggccgggtgagactctgcctgactctttcattctgccaaatctaagctaagcagtgattcctatgcccacctgggaggggagaaacctgaggcccaccttgtaaatccctacaggctcagtgtgcctggcattgggatgggcagaggagacagagggaatgccaaaaaaagagcagttacaaaggacagaccacaggtccaggatgaggggactttcaacggcttgttcgtggttccgtttttgcccaaactctctcgatccacctttgagcaacagtaattatctctttgcctccatcaactccatttaccatccctgtccaattctttcccaataagccagagaataagagtgcagacattaaaggtcagattttcatggtgctgaacccatttaacccagctgtgtggctttgagtaagctacctaagctctctgagcctccatttcctcgtgtgcaaaccaaggaaaatactcacctacttattagaaggaaagaaaagactgagtacctgccatgtgacaggctttcaacaagggaccacctcttgtcataaacaagaggcacatgaacaagtgaccacgggtttaacttgtacacaggtattatgaaaacaacaagtctgcatttcaataaatatttgttatataaatgaacgggactgttcccagagcctgctgcttggaggaagctagggaataaggaactcaaaaacaaggtaagaatgtcagagcagggaagggaagg

SEQ ID NO: 7626 - DNA, 2175 bp, Homo sapiens
aaggtagagacaaccatgaaagttgaacacgtcatctgtgcaggaccgttcatactgacatgtggcttgacaccagaaatctgggtattgtaatatcatgttggaaaggagtttgtgtgcctcaaacaactactctagagatgttttacaatgacaatgatagagtagaggaatcttctaattcctaccaaatcagaagggaattcctccttcctgcctgcctgcctgccttcctttctttctctacttccttttctttctttctttccttccttcctctctctctttctctctttcttcctttctttccttctttctttctttctctctctctctccccttccttccttccttccttcctgagacaaggtcttgctctgtctcccaggctagaatgcgatggtgcaatcatgattcactgcagcctcaacatcccaggctcaagtgatcctcccacctcagcctcctgagtagctgggactacaggggcttgccaccacgcccagctaatttgcgtgtgtgtgtgtgtgtgtgtgtgtatgtggtagagatggggtctcactatgttgcccagctggtctcaaactcctggtcataagcaatcctccacctcggcctcccaaagtgttgggattacacgtgtgagccaccatgcccagtctctatttcttaatagtgtcagcaactgaaagatatagaaaaggaagtctgtttggtgtgtctgttgcctccccaaaatcttcagcctttgtaggacagtgcatcccactgggcaaaaccagagaatattcttttgtgagcccgtaagtaattgtctgcaatagacatgcaggggcctctactgtcatctcttatgcaactgaacttcctaaaaactgtggtgtttatctcttctgttgctcagcactgctgggactgggactgcaaaaaacaaaaaagcacccaggtttactgcccttaaaaaactgactgctagaggagatgagcatatacatgacaggatgtgataagatattaagcagaatgtgatcagaatcataggaagtatatacaaaagatgggaacactaatagaggtgactacaaccacctgctttgtagaggagatgacattcaagctgagttttaaaggatgagtaggagttggccagaaatggagagggagaataaaccatggggaagtagtacacaggcatggcatgtttagagcatttttggagcagggtaaccagaatatactggaggttgctagtagaggagattggaaaagaaagggtcagattattaatggatttacgtattatgcaaagaagtttatatttgaccctttttttgacaatctggcatttagccttatcataaaataaagatctctcaatgcttcacatagaaacttcatctgatctcttgaggatcaaaaaatggctttctgggttttttttctttctctctctcttttgtttttaatatctcacatatactttaaccaccataaattcaagttttctcttactcagacatgagttgcttaacaatggaataattcatttctttatttctcaacattgcccttttgaaggttttaggttttaggttttctaaaactctgaatacttttggctatcattatccagggaaagcctgaagacactccaaagcacaaggacaaaagagaccttgttagatctaattaagcgctccagcaccaggggcacggggagcaagagaaaaatacagagtcagaaactgagccgagttctatggtggtacagagtgaggcctgcttcactgtgggctggggctggggcagggaggccttcatcttgctctaagctgtgcaaagtacctcccacgaggctaagtatagagctactcaataaaaattatgcaatgtggctgggcacggtggctcacatctgtagtcctagcactttgggaggctgaggcaggtggattgcctgagctcaggagttcgagaccagcttgggcaacacggtgaaacctcgtctctactaaaatacaaaaaattagctgtgcatggcagcatgtgcttataatcccagctactggggaggctgaggcaggagaatcgcttgaacctgggaggcggacgttgcagtggggcaagatggcgccattgcactccagcctgggtgacaacgcgagactccatctc

SEQ ID NO: 7627 - DNA, 2191 bp, Homo sapiens
ggcagcatggcgtctttccggcttctccaaacccttgcgaaaaactttattggcaaagctatcagagaacggacagtgtacccactgaggcggccaaagcttaactggatcagggcaggatgacatgaccttgtggtagatcccagaactgaggccccaggatgacagaacaggagaccctggccctactggaagtgaagaggtctgattccccagagaagagctcaccccaggccttggttcccaatggccggcagccagaaggggaaggtggggccgaatccccgggagctgagtccctcagagtggggtcttcagctggatctcccacagccatagagggggctgaggatggtctagacagcacagtaagtgaggctgccaccttgccctgggggactggccctcagcccagtgctccgttcccggatccccctggctggcgggacattgaaccagagccccctgagtcagaaccacttaccaagctagaggagctgcccgaagacgatgccaacctgctgcctgagaaagcggcccgtgccttcgtgcctattgacctacagtgcattgagcggcagccccaagaagaccttatcgtgcgctgtgaggcaggcgagggcgagtgccgaaccttcatgcccccccgggtcacccaccccgaccccactgagcgcaagtgggctgaggcagtggtgaggccgcctggctgttcctgtgggggctgcgggagctgtggagaccgtgagtggctaagggctgtggcctccgtgggagccgcactcattctcttcccttgcctactatacggggcatatgccttcctgccgtttgatgtcccacggctgcccaccatgagttcccgcctgatctacacactgcgctgcggggtctttgccaccttccccattgtgctggggatcctggtgtacgggctgagcctgttatgcttttctgcccttcggccctttggggagccacggcgggaggtggagatccaccggcgatatgtggcccagtcggtccagctctttattctctacttcttcaacctggccgtgctttccacttacctgccccaggataccctcaaactgctccctctgctcactggtctctttgccgtctcccggctgatctactggctgacctttgccgtgggccgctccttccgaggcttcggctacggcctgacgtttctgccactgctgtcgatgctgatgtggaacctctactacatgttcgtggtggagccggagcgcatgctcactgccaccgagagccgcctggactacccggaccacgcccgctcggcctccgactacaggccccgcccctggggctgagcctctccgccctcgccctcggagtagggggtagcggcttgggtctgacacatctttgaaccttgtggccaggcctggacttcgcccccaggcctaggaccgcggtgggtggaaccctgctactgccccaacagggactccaatcaatcggagttctccccttgccggagctgcccttcacctttggggcccgagacagtcataagggatggacttagttttcttgcagggaaaaaggtggacagccgtgtttcttaaggatgctgagggcatggggccaggaccaggggagaggcacagctccttcctgagcagcctctcaccactgccacaaggctccctaatgctggtctctgctccactccccggcttcccgtgaggcaggaggcagagccacagccaaggccctgaccacttctgtgccagttgtctaagcagagcgcctcagggacgctggaaatgccttaaggatagaggctgggcatcacatcaaatgggactgtggtgtttggtgaaaaccttcctgaggatctggattcaggaccctccatgactggcctatttactgtttacagctggccagtgcagagctgctgctcttttacctttttaggcccctgtaacttcccacctttaaactgcccagaaggcatgcctctcccacaggaagaggggagcagacagggaaatctgcctaccaagaggggtgtgtgtgtctttgtgcccacacgtggtggctggggagtgcctggatggtgcggtggttgatgttaacctagtgtgtgtgtgtgtgtgtgtgtgtgtgtgtgtgtgtgtgtgtgtgtaacaataaattactaccagtc

SEQ ID NO: 7628 - DNA, 975 bp, Homo sapiens
catggcgtctttccggcttctccaaacccttgcgaaaaactttattggcaaagctatcagagaacggacagtgtacccactgaggcggccaaagcttaactggatcagggcaggatgacatgaccttgtggtagatcccagaactgaggccccaggatgacagaacaggagaccctggccctactggaagtgaagagggatcctggtgtacgggctgagcctgttatgcttttctgcccttcggccctttggggagccacggcgggaggtggagatccaccggcgatatgtggcccagtcggtccagctctttattctctacttcttcaacctggccgtgctttccacttacctgccccaggataccctcaaactgctccctctgctcactggtctctttgccgtctcccggctgatctactggctgacctttgccgtgggccgctccttccgaggcttcggctacggcctgacgtttctgccactgctgtcgatgctgatgtggaacctctactacatgttcgtggtggagccggagcgcatgctcactgccaccgagagccgcctggactacccggaccacgcccgctcggcctccgactacaggccccgcccctggggctgagcctctccgccctcgccctcggagtagggggtagcggcttgggtctgacacatctttgaaccttgtggccaggcctggacttcgcccccaggcctaggaccgcggtgggtggaaccctgctactgccccaacagggactccaatcaatcggagttctccccttgccggagctgcccttcacctttggggcccgagacagtcataagggatggacttagttttcttgcagggaaaaaggtggacagccgtgtttcttaaggatgctgagggcatggggccaggaccaggggagaggcacagctccttcctgagcagcctctcaccactgccacaaggctccctaatgctgg

SEQ ID NO: 7629 - DNA, 2201 bp, Homo sapiens
aggttttgagacacaggtaaagggagggagacagagagaaatacttgcagagccagcaggtagctgggcagctccttcccggacggacggatggacagacgctggggaccctccactccatatggaaagatgacatgaccttgtggtagatcccagaactgaggccccaggatgacagaacaggagaccctggccctactggaagtgaagaggtctgattccccagagaagagctcaccccaggccttggttcccaatggccggcagccagaaggggaaggtggggccgaatccccgggagctgagtccctcagagtggggtcttcagctggatctcccacagccatagagggggctgaggatggtctagacagcacagtaagtgaggctgccaccttgccctgggggactggccctcagcccagtgctccgttcccggatccccctggctggcgggacattgaaccagagccccctgagtcagaaccacttaccaagctagaggagctgcccgaagacgatgccaacctgctgcctgagaaagcggcccgtgccttcgtgcctattgacctacagtgcattgagcggcagccccaagaagaccttatcgtgcgctgtgaggcaggcgagggcgagtgccgaaccttcatgcccccccgggtcacccaccccgaccccactgagcgcaagtgggctgaggcagtggtgaggccgcctggctgttcctgtgggggctgcgggagctgtggagaccgtgagtggctaagggctgtggcctccgtgggagccgcactcattctcttcccttgcctactatacggggcatatgccttcctgccgtttgatgtcccacggctgcccaccatgagttcccgcctgatctacacactgcgctgcggggtctttgccaccttccccattgtgctggggatcctggtgtacgggctgagcctgttatgcttttctgcccttcggccctttggggagccacggcgggaggtggagatccaccggcgatatgtggcccagtcggtccagctctttattctctacttcttcaacctggccgtgctttccacttacctgccccaggataccctcaaactgctccctctgctcactggtctctttgccgtctcccggctgatctactggctgacctttgccgtgggccgctccttccgaggcttcggctacggcctgacgtttctgccactgctgtcgatgctgatgtggaacctctactacatgttcgtggtggagccggagcgcatgctcactgccaccgagagccgcctggactacccggaccacgcccgctcggcctccgactacaggccccgcccctggggctgagcctctccgccctcgccctcggagtagggggtagcggcttgggtctgacacatctttgaaccttgtggccaggcctggacttcgcccccaggcctaggaccgcggtgggtggaaccctgctactgccccaacagggactccaatcaatcggagttctccccttgccggagctgcccttcacctttggggcccgagacagtcataagggatggacttagttttcttgcagggaaaaaggtggacagccgtgtttcttaaggatgctgagggcatggggccaggaccaggggagaggcacagctccttcctgagcagcctctcaccactgccacaaggctccctaatgctggtctctgctccactccccggcttcccgtgaggcaggaggcagagccacagccaaggccctgaccacttctgtgccagttgtctaagcagagcgcctcagggacgctggaaatgccttaaggatagaggctgggcatcacatcaaatgggactgtggtgtttggtgaaaaccttcctgaggatctggattcaggaccctccatgactggcctatttactgtttacagctggccagtgcagagctgctgctcttttacctttttaggcccctgtaacttcccacctttaaactgcccagaaggcatgcctctcccacaggaagaggggagcagacagggaaatctgcctaccaagaggggtgtgtgtgtctttgtgcccacacgtggtggctggggagtgcctggatggtgcggtggttgatgttaacctagtgtgtgtgtgtgtgtgtgtgtgtgtgtgtgtgtgtgtgtgtgtgtaacaataaattactaccagtc

SEQ ID NO: 7630 - DNA, 524 bp, Homo sapiens
cttgcagagccagcaggtagctgggcagctccttcccggacggacggatggacagacgctggggaccctccactccatatggaaagatgacatgaccttgtggtagatcccagaactgaggccccaggatgacagaacaggagaccctggccctactggaagtgaagagggatcctggtgtacgggctgagcctgttatgcttttctgcccttcggccctttggggagccacggcgggaggtggagatccaccggcgatatgtggcccagtcggtccagctctttattctctacttcttcaacctggccgtgctttccacttacctgccccaggataccctcaaactgctccctctgctcactggtctctttgccgtctcccggctgatctactggctgacctttgccgtgggccgctccttccgaggcttcggctacggcctgacgtttctgccactgctgtcgatgctgatgtggaacctctactacatgttcgtggtggagccggagcgcatgctcactgc

SEQ ID NO: 7631 - DNA, 906 bp, Homo sapiens
cgaacgtcggttctccacctcttcccttccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcgggtaagatggcggccccgcggcgagggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcg

SEQ ID NO: 7632 - DNA, 1572 bp, Homo sapiens
tccgaaagtgcccgagcggtgccggacggactaatcgggcctcggccgtggctcggacgtccgctcccgaaacgcggcgcggtcgggccccttcgtcaggagacgcgaaaatggccgaaggagcgcgagcgcgcgggccgagaggctgccgggatcgcgacggaccggcgggcggggcggggagaggatcctccacagtgctctcttcagttccccttcaaatgctgttttatctcagcggaacgtactacgccctgtatttcctcgccacgctcctgatgatcacgtataaaagtcaggtgttcagctatcctcaccgctacctggtcctcgatcttgctctgctgtttctgatggggattctagaagcagttcggttatacctgggcaccaggggcaacctgacagaggctgagaggccgctggccgccagcctggccctcacggctggcaccgccctcctctctgcccacttcctgctttggcaggccctagtgttgtgggcggactgggccctcagcgccacgctcctggcccttcacggcctggaggccgtcctgcaggtggttgccatcgcggccttcaccaggtagctacggacacccgggataccccacactggggccctcctcctgggcctgaccagtcccccagctgtcacctccccattcctggacaggaagggcacttttcctagtgactggccatagatggttttggatggttccatctgttctggcaggagtgggagcaggagccagggcagaacaaactgctggaggccctggtgttgggaacagctgcggggagggtagggaccagacagaactgccttcaagatgagtcccaggagcgcacactcagccctgtcagtggggtctggctttagcagccaggcctccacagacccccatgggcccccagggccgagagggaggacagagcccttcagaacagaggcctcatctcactgcatcccccatcaccccctagttccccaatggtcctaatttgtgttctgagatcccagtttactccgtggccaggccccacctgtgtttccaagtcgggctggagacgcaggatggggtaggccttgtgctctgagcaaccccagctctgcctcacaggcaggcaggcccggtgcaagagtggactctgggttcctaaagcaataaatgcaaacaagccaacagctctgctgcctagcaatttccatcttagccacacttctcccttcaggggcttcggaggagaggtcagggctaaggccggggatgagactgcaggagagagagcagcggagggccacattcggagcctccgtccactccagttttatcagcttttgccttttgcacggagtgctaaacaaattctagctctgtgtttttttcccattcccagatttactatcagttctccttaaaaagtatctaagctgttacagtagctttcccttcacttgattctattgtgtgttttctatgtttggaataattacacccaaatatctagatattttctcttcaccgcattttgtaaataaagagatgtgtatgcctccctgaa

SEQ ID NO: 7633 - DNA, 1388 bp, Homo sapiens
ctgccttgtggcctcacctgtttataaggactggacttttatttattaagttgtgttgttttattgacaatacatgcatcatatcttttgactttgaaggatatctcatgtcaaaggaatcaagttatgatttatagaggattcagctggaataccttgtgggtgctggctgagggtggcaaaacgcctaccgagacatgaaggttttagccactagttttgtccttgggagcctggggttggccttctacctgcctttggtggtgactacacctaaaacactggccatccctgagaagctgcaagaagctgtggggaaagttatcatcaatgccacaacctgtactgtcacctgtggccttggctataaggaggagaccgtctgtgaggtgggccctgatggagtgagaaggaaatgtcagactcggcgcttagaatgtctgaccaactggatctgtgggatgctccatttcaccattctcattggcaaggaatttgagcttagctgtctgagttcagacatcttggagtttggacaggaagctttccggttcacctggagacttgctcgaggtgtcatctccactgacgatgaggtcttcaaaccctttcaagccaactcccactttgtgaagtttaaatatgctcaggagtatgactctgggacatatcgctgtgatgtgcagctggtaaaaaacttgagactcgtcaagaggctctattttgggttgagggtccttcctcctaacttggtgaatctgaatttccatcagtcacttactgaggatcagaagttaatagatgagggattggaagttaatctggacagctactccaagcctcaccacccaaagtggaaaaagaaggtggcgtcagccttgggaataggaattgccattggagtggttggtggcgtgttggtgaggattgtcctctgtgcgctaagggggggcctgcagcagtgacagcttcaagaacttaacagccttgctcctgaagaactggctgcccaggaagccaagctagctttttaggggagtgttccagctgctggtagtggatcagcttagagggaacactcccacagccaaaagaatgagtgggagaaatggaggggacaatctcctgggagctatgcgcagtaacctaacttccttatgtcccatggatctcttcctgatcttccctgcccattgggtacccaggaaactgcaagcattgcctgtgttcctgggaagagttctaagaagcttgcattcattttctaccctttatgacttggatgcctccccacctccatttcccctcttctgagctgtgtattcatgtagagggatgtattcagcctttttagtgaacattttttttcaataaaagtaattcacagt

SEQ ID NO: 7634 - DNA, 1520 bp, Homo sapiens
gctctcctcccctcccctcccctgggcctttgacccctcccagcctctctccttccctccaccgacacctttgcccagtgacgttggtctgtccttacgcagacctggccggaggctggggctccttccggggctgccatgttctctcttccatccctcccctcctggctccccggcctcccctccctcgagtggggctctagcctccttgactccctcctgcaaggcctgatcggggcccttggagtcttggtcctgaacagcctcctgaaagtttacttcttcgtgggctgtgccaatgacccgcagcggcgacccgaaaaggagcggcttcgggcccagtgggcctccctggaaacggtgcacctggcagggctggccctgtttctgacggtcgtggggtcccgggtggctgccctcgtggtgctcgagttctccctccgggccgtgtccacgctgctgtccctgggcaagggctcccagggtgccgccgagaggctgcagctctacctgctgtgccagtactcgctgggctgcgggctgacctgtggcctgagcttcctgcaggagggcgcccctcaccgcacgctgaacctgctgctgagcctcgggctggccacgctgctgggcctgggtgcccggcgcctccaccgccacgtctgccgcctctacgagctgcacagcagccagcgctactgtggggtgtgcctgggcctgctggcccatgcacatggcctcccccagctgctgggccgtgccctggccatagcctttgccgtgggtgacctggcagctgtggccctcatcaaccaggacttcctgaccacctcggaggccatgcggttctggacaccgctcaccatctgctacacgctgctggtcatctacatgcaggaggagcagcggcagcaccccggcctgcagagccaggtgcagacggtgctggtgcgcatgggcggcctcttcgtgctgctgctgactgtgggtcgctggctggacctgctgggcatccttgtctccctactgggcgagctctggtgtctcgtgggcgtccgcaccctgcttgacctctgccagatacaggattttccatcccagaggcctccagtgtcaacaccaagccagcccctgccctcggcaccccagtcccagagttcggccccctcttgacctgcctcagggaggatctggagtctgtctcaagcccactagcctgatctccgaggccttgaccccagggcgatgcctggaggcagagtggcagagctggcctcctgcccagagctcagcacaggccctgggagccccgagaagggaaggcaggatttggggatgggagcctctggagaggggacacctggggacccctggttgaaccctctttttcttggggtgggcaatgatgcagcctctcagacctgccttcctgggcaggggtgggggtgcatcctcaggagggctccccctttactggtctcccttcccttctccatgaacaataaagacgatgtctttctcaa

SEQ ID NO: 7635 - DNA, 852 bp, Homo sapiens
agtgcatttgcagagtgagacaaagcggagaacgctggtgggcctgttgtggagtacgctttggactgagaagcatcgaggctataggacgcagctgttgccatgacggcccaggggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccaagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgc

SEQ ID NO: 7636 - DNA, 1036 bp, Homo sapiens
attcacgcgccggaagtgcatttgcagagtgagacaaagcggagaacgctggtgggcctgttgtggagtacgctttggactgagaagcatcgaggctataggacgcagctgttgccatgacggcccaggggggcctggtggctaaccgaggccggcgcttcaagtgggccattgagctaagcgggcctggaggaggcagcaggggtcgaagtgaccggggcagtggccagggagactcgctctacccagtcggttacttggacaagcaagtgcctgataccagcgtgcaagagacagaccggatcctggtggagaagcgctgctgggacatcgccttgggtcccctcaaacagattcccatgaatctcttcatcatgtacatggcaggcaatactatctccatcttccctactatgatggtgtgtatgatggcctggcgacccattcaggcacttatggccatttcagccactttcaagatgttagaaagttcaagccagaagtttcttcagggtttggtctatctcattgggaacctgatgggtttggcattggctgtttacaagtgccagtccatgggactgttacctacacatgcatcggattggttagccttcattgagccccctgagagaatggagttcagtggtggaggactgcttttgtgaacatgagaaagcagcgcctggtccctatgtatttgggtcttatttacatccttctttaagcccagtggctcctcagcatactcttaaactaatcacttatgttaaaaagaaccaaaagactcttttctccatggtggggtgacaggtcctagaaggacaatgtgcatattacgacaaacacaaagaaactataccataacccaaggctgaaaataatgtagaaaactttatttttgtttccagtacagagcaaaacaacaacaaaaaaacataactatgtaaacaagagaataactgctgctaaatcaagaactgttgcagcatctcctttcaataaattaaatggttgagaacaatgcataaaaaaa

SEQ ID NO: 7637 - DNA, 3595 bp, Homo sapiens
tccgggctttgtagaatcgtcgccggcttacctggccgtgggcgcgtcctggccgctgcagcccggagcagggtgccagccgccgccgccgccgccatggtgtccccggtcactgtggtgaagagtgaaggacccaaactggtgccgttcttcaaggccacctgcgtgtattttgtgctctggctgccctcatctagcccatcgtgggtcagcaccctcatcaagtgcctgcctatcttctgcctctggctcttccttctggcccatggcctgggattcctgctggcccaccccagcgccacccgcatctttgtggggcttgtcttctctgctgtaggtgacgccttcctcatctggcaggaccaaggatacttcgtgcatggtctgctgatgtttgctgtgacccacatgttctacgcctcggcctttggcatgcagccactggctcttcggacaggtctggtgatggcagcgctgtcgggcctgtgctatgccctcctctacccatgcctctcaggtgccttcacctacctggtgggggtctatgtggcccttatcggcttcatgggctggcgagctatggcagggctgcggctggccggggcagactggcgctggacagagctggcagctggcagtggtgcactcttctttatcatctcagacctgaccatcgccctcaacaaattctgttttcctgtgccctactctcgggcgcttatcatgtccacctactatgtggcccagatgctcgtcgccttgtcagctgtcgaaagccgggagcctgtggaacactacagactgaccaaggccaactgaggtgccagggtctggtcacccctctctcctcctggggctggggcccagatcctggggacctgcaggagctggatcaggatggctgcagtgccagcctggggcagcaggtactgcctgaggaatttgcaagttcgtgtggggaggctggaaaaggatctccctagcagaactcgtggttcaggacaatgctgagagctaaaagagccagcctaatatcagactggagccagaagtagacatctccccacctctaccctatcaggactttcaaaacccccctggaaggtgatggtgctcagcttcttgacacccccccacccacttcccctaccaggtggaagagtctgactccatgtgttatgcctaggaccaatggcagtgctgggttcacccactcctcccctttttcatctgcacaaagttgagggaaacgggagaatctgtgctgagaagactcagacccaggagcccctttcacaggcccctagttgggaagactggatgagagtggagcctccgtttcttttccctcttctatccttgttacttgaacaatctcagtctctaagtggtgggtggggacatgaagaggtgtgggtccaggttaggcaggagagagaacttctttggtctcggagtttggggtctcaagaattcaagtagccccatctctctctcgggcaagcccaaagctcaggtcccatacgctacccttagatcctatccccagggctagggtgaaccatgccaaaggaaggggccagcttctctgtgtgtgtgtgtagcctgtctcctagtctgcctatgtctttctctgctatatgtttctgtcctgctgtctgtcaaaagtctcacagagagagggcctcagggagctgctgaggggtgctgagcctggctcagggagctgggacccctcccctccaacacacatactcacagtgctttcctccttgtccctcctacactaggagcaagaggagggggctccaatgacactccggggttttaagacccaaggcacattcaatgcaaggggagcaaggatgggacaactccatcttctgctgcccatgtgaaaaataataaaaatcaagagccattggctgccctgcttgtgggcctgtgtggcacatgcctatcttggagagggcatgggggcatggtgccagaggctctggctgtcctcacagcctagtcacagtcctgggcagtgcatcttggtgccaggctggctacctggctctggtgacactgtgccggttggagtgtgtctcacttccctggtgtgggtgaggatgtggtttaggaggatgggggatgagtggtatttgccactgtccaaatttgtccttgatgtactcccctgtgcacaggtgcccagcacccttggtgacctttagttacccagtgtcatctattgctgcccacctcctcccctccccacttgagacctgctgcttccttcaaaatgatccagattcccttcaagcatctccctcatcctggactctgggcttagttgaacagctgggagcaatgggattagattggctgattcattcattagttgtaaagccctggcagaataatacatcactctgctccaggagcatttgtaacttaacagacaatgccctaacccagaagtagaaagggaagccttgggtggtggtggatatgccatcagtagaggtgttgctcatttgtggggatgtgatttaggagactcaagtctcaggggtggttggatgagtcagtgatttccaaattagtttttacagagattcctggtaagggggtagtgaaggaataatgagagaaggcaggctcaaagacctcctatccttatttcaagtccagtagcttcttaggttgtgtttttttttgttttgttttgttttggaaggattccactgaaaaacgtaagtttgaaacttagtgagctggatgatcaatcccttctagctctgaaccctggacactaaagagggaagatcttgatcctttcaaacttcagaactctgaacacagacctacctagtgtgaagaaatgggagggagcaggatggagagcaggatgaagtcagcaggacttgcccccaagctctgaggggagggggaaagtgccatgtagatgtggaggaggggaagggaagaccaggcccagtcacaagaaggctggtcactgccttgtgggtgggtttggactaggctttcaggggtccaggtctgggattccctatcatgcaatcacatccatccccttggtccctgctgtatatcaccctcaggaacgggaaaggatgagttacgtttattgccccatcccttcactgaatgtttacattaacaaacaccagagagcaaactgggcttcctacactgggccatgcagaggacaggccaagaaactccacatcataacagcctcctgatgcctgggcttggctggagctcacatgaggtgctttgatttcttctgcagactctcggtgatggatgctacaactgacttatcatctttgtctgaaagagcaaaggaagtattcgttatattaatgatgctggcgaccagggaaattccaaactgctggacttcctatgcaggaaaccaggagctggaccctgggacccttaatcttgggttggcagagtgtgaaggggcaagagctgccatttatctagcacttaatatttgccagacattgtgccaggcagttgtgtactgtctcatttaagcctcatagtcctataaagaagatgagaaaacagg

SEQ ID NO: 7638 - DNA, 1855 bp, Homo sapiens
attgtccgtccctccgggctttgtagaatcgtcgccggcttacctggccgtgggcgcgtcctggccgctgcagcccggagcagggtgccagccgccgccgccgccgccatggtgtccccggtcactgtggtgaagagtgaaggacccaaactggtgccgttcttcaaggccacctgcgtgtattttgtgctctggctgccctcatctagcccatcgtgggtcagcaccctcatcaagtgcctgcctatcttctgcctctggctcttccttctggcccatggcctgggattcctgctggcccaccccagcgccacccgcatctttgtggggcttgtcttctctgctgtaggtgacgccttcctcatctggcaggaccaaggatacttcgtgcatggtctgctgatgtttgctgtgacccacatgttctacgcctcggcctttggcatgcagccactggctcttcggacaggtctggtgatggcagcgctgtcgggcctgtgctatgccctcctctacccatgcctctcaggtgccttcacctacctggtgggggtctatgtggcccttatcggcttcatgggctggcgagctatggcagggctgcggctggccggggcagactggcgctggacagagctggcagctggcagtggtgcactcttctttatcatctcagacctgaccatcgccctcaacaaattctgttttcctgtgccctactctcgggcgcttatcatgtccacctactatgtggcccagatgctcgtcgccttgtcagctgtcgaaagccgggagcctgtggaacactacagactgaccaaggccaactgaggtgccagggtctggtcacccctctctcctcctggggctggggcccagatcctggggacctgcaggagctggatcaggatggctgcagtgccagcctggggcagcaggtactgcctgaggaatttgcaagttcgtgtggggaggctggaaaaggatctccctagcagaactcgtggttcaggacaatgctgagagctaaaagagccagcctaatatcagactggagccagaagtagacatctccccacctctaccaggtggaagagtctgactccatgtgttatgcctaggaccaatggcagtgctgggttcacccactcctcccctttttcatctgcacaaagttgagggaaacgggagaatctgtgctgagaagactcagacccaggagcccctttcacaggcccctagttgggaagactggatgagagtggagcctccgtttcttttccctcttctatccttgttacttgaacaatctcagtctctaagtggtgggtggggacatgaagaggtgtgggtccaggttaggcaggagagagaacttctttggtctcggagtttggggtctcaagaattcaagtagccccatctctctctcgggcaagcccaaagctcaggtcccatacgctacccttagatcctatccccagggctagggtgaaccatgccaaaggaaggggccagcttctctgtgtgtgtgtgtagcctgtctcctagtctgcctatgtctttctctgctatatgtttctgtcctgctgtctgtcaaaagtctcacagagagagggcctcagggagctgctgaggggtgctgagcctggctcagggagctgggacccctcccctccaacacacatactcacagtgctttcctccttgtccctcctacactaggagcaagaggagggggctccaatgacactccggggttttaagacccaaggcacattcaatgcaaggggagcaaggatgggacaactccatcttctgctgcccatgtgaaaaataataaaaatcaagagcc

SEQ ID NO: 7639 - DNA, 1751 bp, Homo sapiens
cctggtcacccattgaagcagtgtttgtggtggagcccctgagggcttggtggggttgagcagaatgaggaaaggtttcatggagcagggagggagacggctagggcagcaagtgaaggacagactcgccttcccatccctccaggggcactcctgccagccagcccctctcccgcttcccatgatggggtggctgttggaattctgcaccccatctcttctgattgttggggcccaggacaaggggacaggcatttgtgggcctaacctccccaggcagataggaggaggaagccatgtcccagcaggctagggcagagggacccccagtgccaacagtgctttatcagcgggcgccaggcagggccatccccagggtgaggacaacatctccctgggccctgttatcagtcacagagtccacaggacgctccttgggttaacgtgtaaccatgagccctcccctccaccccctgaagccactcgctcccagattaggtcgctctggggctatcaggccagcatggacgctggcaaagcggggcagaccctgaagactcactgctcagcccagcgcccagatgtctgcaggtggctgagccccttcatcctctcctgctgcgtgtacttctgcctctggattcccgaggaccagctgtcctggttcgctgccctggtcaagtgcctgcccgtcctctgcctggctgggttcctgtgggtcatgtccccaagcgggggctacacccagctcctccagggagcccttgtgtgctcggctgtgggggacgcttgcctcatctggccggcagccttcgtccctggcatggccgcctttgccaccgcccacctcctctacgtctgggccttcggcttctctcccctgcagcccggcctgctgctgctcatcatcctggcccctggcccctacctcagccttgtgctccagcacctcgagccggatatggtcctgccggtggcagcctatgggctgatcctgatggccatgctgtggcgcggcctggcccagggcgggagtgccggctggggcgcgctgctcttcacgctctctgatggcgtgctggcctgggacaccttcgcccagcccctgccccatgcccacctggtgatcatgaccacctactatgctgcccagctcctcatcacactgtcagccctcaggagcccggtgcccaagactgactgactagggagcttgaagggccggtgttcaggccctctcctcctgcaaggacctgggcctcccagcccagcccagcctgagaaataccctcagcagcgaagcttcctgacgcctgtctgcaggcgccgctgccgccgtcgcttctggctgaagacgtttgaggacgatttgcggaattccaagtccactactgggttccagctgccttcccccggttctgactccagatccctggctcctcagccaggcccacatggagccctcccagccaccagcctgcctccatgttcactgtcggccccacagcctgcccgccccctgctgctgctctgaatccgttttccctgtgggtgtggaaccgtagatgttgctgttaccgtaggagaggcctcggggagggtcatgattgtgataaaccatcgcggttaatgacagcagaaggttctttgtcgctccccatggaccaggcctggtgcccagtgggaccctccatggccctctggtggggggattcggggggataaagtgaggattgtgcagaactgagcca

SEQ ID NO: 7640 - DNA, 1716 bp, Homo sapiens
gacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccattcagatgcctttcttgaagaaacatttcttggattgttgaaagactttaataatttccaaagttccaaaagttgattttgatagtttttgccagtgttttcgttgcttttatggatgagtagattttcagagtttcttattctgccattctgaaagtgttctcactacctaaaccccagttttatttgtacagaattttaactgaatgtaagttaggcatgacagtctttgttaatttttttaaacaaaagatagccattaggactgggtacagtggctcacgcctgtaatgccaacactttgggaggccaaggtgggcagatgacttgaggttgggagttcgagaccagcttggccaatgtggtgaaactttgtctttactaaaaatacaaaaattagttgctcatggtggcaggcacctgtaatccaagctactcaggaggctgaggcaggagaatcgcgtgaacttgggaggtggaggctgcagtgagctgagatcacgctactgcactccagcctgggcagccagtgagattccatctcaaaaaaaaaagaaaaaagatattcattggattttctcttactaataggtatatattcactgtgaaaatggagacgatatacataaatgaaaagaagaaaatagtaatctataataccatgcagtgatatatttatcttcctattcttttgtatatgggcatgtttatattattttaaaaagggaatcttagagtatgtattatatgacttttttttgtagcttagcaatataacatggacatgtcgtcagtttggtaaatattgtattgcatcgttacttaaatgcttgtatagtgtcttattgtatgagtacattgcaatttgttcaattctctgttcttgaacttttatgagtttcattatcttggaattttatgcagtgttgtgattaatattttaactacatttgcttttaagtctttattttctgatctcagaagaattgtatattgggataagtttttaattctataacttaaaagtaaaaatcctttgtaattttatgttc

SEQ ID NO: 7641 - DNA, 3005 bp, Homo sapiens
gacgactgtctgagagaggggccgctacgccgcacagcaaacaagctccgcgacgtttccaggacccggataatcccgcccttagagcagagccggaagaaggcgggacgaaccggaagagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatcaaaagaaaaaaaaaaaaagagaaactgttacagtatgattcagatcatttaaaaaagcaaaatcaagtgcaattttgtttacaaatggtgtatattaaagatttttctatttcagatgtactttaaagagaaatattagcttaactcttttgacatctgctattgtgacacatcccattgctggcaatgtggtgcacactccgaaacttttaactactgttttgtaagcctccaagggtggcattgcagggtccttaggcaatgttttgtttgcctttatgcagagaggtgctccaagtgctgtgattgagcaccgtgctagaggaactgtaatgcttcagaagttgtagcttatacaaaggaaacaggtcctgctggcttaatttaaacagttattgcatgaagtagcgtggaggccctggactgctgctcgttctttaggatggactgttctggtatctggtattggtttagagactgttaataagggacatcacaaggtgatgggattcatttgaagcactctatttctgttttaatggttttatccaattttgccttcccaagatttttgttctacataaaaagttcatgccactttttaatataaaaaaatttaacaaaatt

SEQ ID NO: 7642 - DNA, 2200 bp, Homo sapiens
agagggtgaaatgctttcggtaggcactccacggctgtgaagatggcggcggctgcgtggcttcaggtgttgcctgtcattcttctgcttctgggagctcacccgtcaccactgtcgtttttcagtgcgggaccggcaaccgtagctgctgccgaccggtccaaatggcacattccgataccgtcgttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataatatgtaatctccaggagcaactgcctgtaatttttatttatttagggagttacataggtgatgggggaaattgttaactacctttcattttcctgggaagtcaaggttacatcttgcagaggttgttttgagaaaaaagggcccttctgagttaaggagccatagttctatcaatgatc

SEQ ID NO: 7643 - DNA, 2072 bp, Homo sapiens
tagcgggaatgtaagggccacttcagcaacagaaaggagtggtggagcggcttctcatcagaaaaacagaactttcagtgcctgacttgagatgtaaacttgatgtacaaacggagagttgtttatctttcagatgtttcacagaatccagtgtccccgggttggataagaaaggggaaaaattattttagttttggaaagatcctcttcagaaataccactatcttcctgaagtttgatggagaaccttgtgacctgtctttgaatataacctggtatctgaaaagcgctgattgttacaatgaaatctataacttcaaggcagaagaagtagagttgtatttggaaaaacttaaggaaaaaagaggcttgtctgggaaatatcaaacatcatcaaaattgttccagaactgcagtgaactctttaaaacacagaccttttctggagattttatgcatcgactgcctcttttaggagaaaaacaggaggctaaggagaatggaacaaaccttacctttattggagacaaaaccgcaatgcatgaaccattgcaaacttggcaagatgcaccatacatttttattgtacatattggcatttcatcctcaaaggaatcatcaaaagaaaattcactgagtaatctttttaccatgactgttgaagtgaagggtccctatgaatacctcacacttgaagactatcccttgatgatttttttcatggtgatgtgtattgtatatgtcctgtttggtgttctgtggctggcatggtctgcctgctactggagagatctcctgagaattcagttttggattggtgctgtcatcttcctgggaatgcttgagaaagctgtcttctatgcggaatttcagaatatccgatacaaaggagaatctgtccagggtgctttgatccttgcagagctgctttcagcagtgaaacgctcactggctcgaaccctggtcatcatagtcagtctgggatatggcatcgtcaagccacgccttggagtcactcttcataaggttgtagtagcaggagccctctatcttttgttctctggcatggaaggggtcctcagagttactggggcccagactgatcttgcttccttggcctttatccccttggctttcctagacactgccttgtgctggtggatatttattagcctgactcaaacaatgaagctattaaaacttcggaggaacattgtaaaactctctttgtatcggcatttcaccaacacgcttattttggcagtggcagcatccattgtgtttatcatctggacaaccatgaagttcagaatagtgacatgtcagtcggactggcgggagctgtgggtagacgatgccatctggcgcttgctgttctccatgatcctctttgtcatcatggttctctggcgaccatctgcaaacaaccagaggtttgccttttcaccattgtctgaggaagaggaggaggatgaacaaaaggagcctatgctgaaagaaagctttgaaggaatgaaaatgagaagtaccaaacaagaacccaatggaaatagtaaagttaacaaagcacaggaagatgatttgaagtgggtagaagagaatgttccttcttctgtgacagatgtagcacttccagcccttctggattcagatgaggaacgaatgatcacacactttgaaaggtccaaaatggagtaaggaatgggaagatttgcagttaaagatggctaccatcagggaagagatcagcatctgtgtcagtcttctgtacggctccatgggattaaaggaagcaatgacatcctgatctgttccttgatctttgggcattggagttggcgagaggtgtcagaacaaagagaacatcttactgaaaacaagttcataagatgagaaaaatctacgagcttcttatttacaacactgctgccccctttcctcccagactctgacatggatgttcatgcaacttaagtgtgttgttcctgaactttctgtaatgtttcattttttaaatctgacaaactaaaaagtttaacgtcttctaaaagattgtcatcaacaccataata

SEQ ID NO: 7644 - DNA, 5212 bp, Homo sapiens
gcgctcgggctgccagccctcccttgcacgttccggctcctcttctatcttcacgcccacgctaggccctgagcccagcctccacgtctcgccgccaactccacatcctggctcctatctctgccttccaggcatctcccagctgcacgctcgggcccggctcagagccctaagccctgcctcccggtcctggccgggtttcccagaactgcacggcgcctctccgcccaggcccaagcgcgagcccctcctccacacccgagtccgagccccgcgtcccggattcggacccgcctgcctggggcggtgctgcaccaggtgcgggtgtggcaggcgtctcggagcgccaggtgcagcttcctggtcaagatggtcgccgcctgccgctcggtagccgggctcctgccacgccgccgccgctgctttcccgcccgggccccgctgctgcgcgtcgccctctgcctcctgtgctggaccccggcggctgtgcgcgcggtccctgagctcgggctctggttagagacagtcaacgacaaatcaggacctttgatatttaggaaaactatgtttaactctacagatatcaagttatctgttaagtcattccattgttctgggcctgtgaagtttaccatagtgtggcatttgaagtatcatacctgtcacaatgagcattctaatctggaagagctgttccaaaaacataaacttagtgttgatgaagacttttgtcattatttgaagaatgacaactgttggacaacaaaaaatgaaaacttagattgcaacagtgattcacaggtgtttccctctttgaataataaagaactaataaatatcagaaatgtttcaaaccaggaaagatcaatggatgttgtagccagaacacaaaaagatgggtttcatatctttattgtttctattaaaacggagaatacagatgcaagctggaatttgaatgtttctctttctatgattgggcctcatggatatatctctgcatcagattggcccctaatgattttttacatggtgatgtgtattgtttatatattatatggcatactctggctgacgtggtctgcctgttattggaaagatatattaagaatccagttctggattgcagctgttatttttttgggaatgcttgaaaaagcagttttttatagtgaataccaaaacatcagcaacactggactgtcaacccaaggcttattgatatttgcggagttgatttctgcgattaagaggacgttggctcgccttctcgtgatcattgtgagcctgggctatggcattgtgaagcctcgtttaggaacagtcatgcaccgggtgatcggactggggcttctatacttaatctttgcagctgttgaaggcgtgatgagagtcattgggggttctaaccatttagctgttgttcttgatgacattattttagcagttattgactccatttttgtgtggttcatttttattagtttggcacaaactatgaagaccctaaggctaagaaagaacactgtgaaattttcattatatagacattttaaaaatactctgatctttgctgtgctggcttctatagtgtttatggggtggacaactaagacatttagaattgcaaaatgccaatcagattggatggaacgctgggttgacgatgcattttggagcttccttttttcgcttatccttattgtaatcatgtttttgtggagaccatcagcaaacaatcagagatatgccttcatgcccttaatagatgattctgatgatgaaattgaggaattcatggtaacttctgaaaatttaaccgaaggaataaaattaagagcctcaaaatcagtttccaatggaacagctaagcctgccacttctgagaactttgatgaagatttgaagtgggtagaagaaaatattccctcttcattcacagatgtagctcttccagtgttagtggattcagatgaggaaatcatgaccagatctgaaatggctgaaaaaatgttctcttcagaaaagataatgtgattggaacccgtataagaaatgtagttaagcctgaaggactatccttcatcaagactgaaagtgagctttgatttgatattgcctaaaaatttttattgtgttatcttggaagtctgtgtatcaaaatgaagaattcagatggtaggaggttctatagtccttttaaagctgactcttgagtgtcagttgaatatccattaaattggatttggaaataacctgaggaaagtattatgataaagatctgcacagatgcctcttagctgataggtggcaggcctgtgggtttgggttctccctcttttctctggaacatatgacaattccagattaaagaaaaatgttttttaataaatacccttggtctttcttctagtcacctttgaggtagatattgtgattttctggagtatagtatatccgtgtctctgtgtcttaggtttactagatgcaataatacttctctttgacatttgtactgaagtgatttgatattaagtaaaacagttaatgtttgaatataggcatatttataggttttttccgctcccccccaacccaccctttttaaaaaatctatacaaagcccttgtttgagtctcatcatgcacatcaaatcatggagttaggtcttctctgagctcaggggaacacaagtgcacagagagagatgtcttgagggtcactaccaaagaattaccctcattgtccctcactcaggccatgtgtacatgcgatgctgctgagtgtgctggggtgggtggtggccacgtggctcccccagagcacttcctaactggcaagctgggagacccattactggtgaactttgtggaaattagaactgtatcttttacataatcttggcatattacatttcataataaaaacatacatttagttgcatgctacatcactattgattttataattaatttcttaagcttcaaccatgttttataccttatttcgttacatcatatatttgtaatgtgtaatatgaaatcttttgctttaatgtctttttttaaaatgtagaatgttctaaacttgaaaggcaattgaatgtagtatgatgaaaatgtgaatgttttgctgctttcatgaccaaagatacagggctagtggacatttagaataataattaaagctagagtcttgtatgtcttttctttgaaggagttctaaccttgtaaattgagaatgacttcagagaattttgattaagaaaacattaaaatcttaaccggcacaaacactccaatttttttcactgtgaagccgcaagcaattttttttctttttctttcaaaagcctaccttctgaatttatttcttgtttactcatttcagagagggtagtaaagaagatctatttctggtagtcatatcgcttgaaaggtattggtaaatgtgttttcagtcgtgaccatgtggaaagtgaacagtgttggcaaacattaccgagaaaatcatgcttttcaagatgcccttgctttgggatatccttcctagggagaaaaaaaaaaagtagtttaacaattgtgaattccatttcttatttcagtttctgctgcagtaatgggttcccacccactataattcccagcatttatgttctgttgtattctccccttagcccagtaacatttttatctaataccccattccccaagttttgagacagattgaccccctactcattatgtggctctagttgaattttaaaatgtggaatattgggcttgcaggcagtaggagctgcaaatctggtagagtgggagtgtggagttaatggtgagtatgttaataaagggaaactgtctctgacagaatctcagtaatgtttaccaaaacatgtctttctacagctggtaggataaatgatgctaccctgtagctcagctacaggctgcagtgcaaacttttcttccatccagagaaagcagaattccctcctagtaacctcattacaaatactgttactagaagggcatgtgctgtctgtcaccttcagtaatatttgtgccatctcttgatgactgatgacctggatcgagtatttctatgaagggtcttcttaggccccttacatacgcaagaggggtgctctagtgccatagctgtagttcacaggaaggacaccaggagaagttatacctagggctactgagcagctcatcatccctgtttctgcacagtttcctgaaactggccatcagggcctctgaggcactcaaatcagtttacttttagcatgcccccatcagggtgggtctcactgttagtgaggatacgggtctggtttgatgtttttctaggcaaaatgcttaagtgttctggttatgccattcattcatacgatgtgtgaaatttgcttaaaagggaattttcatgatttgatttagattagtatttaaatatctgctttagatagcaattaattttattgtaaaaataaggaaaaatatgtgaatatgtgaattttttaagcctgagagatgatagaatgttcccatatttttcttgtaaagaaaataatattttaacttacacatcctgtagaaaataccaccttttccccttgtattacagtacaatgtttacattactatactgtcaagctgaaagtataaaaaatgtacatatacattttgagttatgtatcctttttttaaaaaaaagttcgagtctgttgcactaggctgtacatgactaaagttgacagatgctatgctagatttataatcactagttctggtacttgtgtctttgtatgatcaaagcatgcaataagcaatacaaaataccaagccttatacttaaaagaagtttaacatattggttaatatactggttaatatactggttaaacatattgaatgtatataagtggcaaaactagatttttaaggaagtgtacattataatattggagctcagtactgcatgaagagacttcattaaaactaagaaaacatttatttggggagaaattttaggcatttaagaacttgtatttttctattttaaaaagttaaattattccgtaatttggaagaagtttcgttgaatgtaggacataaccgtttgaagggttttcatttgaaaaattgatgtattttgtgccttaatattttgttcttttaataaaaatgctctgaatttgaatgat

SEQ ID NO: 7645 - DNA, 872 bp, Homo sapiens
aggcgggccatggcggatgtccccggggcacagcgagcggttcctggtgacggcccagagccccgggaccccctggactgttgggcctgcgctgttcttgtaacagcccagaatctgctggtggctgccttcaatcttctcctgctggtgctggtgctagggaccatcttgctacccgctgtcaccatgctgggcttcggcttcctctgccactctcagttcctgcgctcccaggcacccccttgcaccgcgcacctgcgggaccccggtttcacggccctactggtcaccggattcctgctcctcgtgccgctgctcgtgcttgctctggccagctaccgccgcctctgcctgcgcctccgcctagccgattgcctcgtgccctacagccgagccctttatcggcgtcggcgcgccccgcagccgcggcaaatccgggcctcaccagggtcccaggccgttcccacatcaggaaaggtctgggtctaatgaccctcgagtcaagaacaaccctgacggctgccctccctcttattcggcccaaggacttgaagcccggcatcttccgacctgccctgcccccacccctgcctgagcggagtcctagcatccccttgggagcagcagcgtcagtggacccagtgctgagaaaagcccccacatcccggaaaacccactttcctttcacgacccacatctcaatcctgaacatctaggctggaacctgcacacctccccctcagctccgtcgtgaatgggacaacaatctcgtgccctcgttttatggtgcagcttctctagtatttctggggctggggggcggggctggaggggaaggagtgtccacgcatcaataaagatttaacgaactg

SEQ ID NO: 7646 - DNA, 662 bp, Homo sapiens
ggctggaacctgctgccttagagccaggcctcttcccgggggaggggcgtttgcccgttgccaggtgcccgggttccggccctggcactagcgacggccatgctgcatgtgctggcctcgctgcctttgctgctcctgctggtgacgtctgcctccacccacgcctggtcgagacccctctggtaccaggtggggctggacttgcagccctgggggtgtcagccaaagagtgtggagggctgtaggggtggcctgagctgtcctggctactggctgggccctggagcaagccgcatctaccccgtggctgcggtcatgatcaccaccacgatgctgatgatctgccgcaagatactgcaggggcggcggcgctcacaggccaccaagggtgagcatccgcaggtgaccactgagccctgcggaccctggaaacggcgggccccaatctcagaccacaccctgctccgtggggtcctgcacatgctggatgccctcctggtccacatcgaaggccacctacgtcatctagccacccagcggcaaatccaaataaaggggacttccacccagagtgggtgaccgaacatgtgcctctctttgcctgacagcctgaggtcctgggccaggtctgctctttccaggcctgtctggaccgtgtgtcc

SEQ ID NO: 7647 - DNA, 2229 bp, Homo sapiens
agtgcccggggcgacggcggcggggaccggccgggccatgggcgccgggggcagaggcggaggcggcagaggctgtccttctacagctggtacggcagtgccaggctcttccgcttccgcgtgcccccagatgctgtgcttctacgctggctcctgcaggtctcccgggagagcggcgctgcctgcaccgacgcggagatcaccgtgcacttccgttccggcgcccctccggtcatcaacccgctgggcaccagcttcccggacgacaccgcggtacagccctccttccaggtcggggtgccgctgagcaccacaccgagaagcaatgcctccgtcaacgtttcccacccggcccccggggactggttcgtggccgcccacctgcccccctcatcccagaagatcgagttgaagggcttggctcccacctgtgcctacgtcttccagcctgaactgctggtcacgcgggtggtcgagatttccatcatggagccggacgtgccccttcctcagaccctcctctcccatcccagctacctcaaggtctttgtccccgattacacgcgggagcttctgctggagctgcgggactgcgtgtccaatgggagcctgggctgccccgtgcgtctcaccgtgggcccggtcaccctgcctagcaacttccagaaggtgctcacctgcaccggtgccccctggccctgccgcctgctgctgccctcaccgccctgggaccggtggctgcaagtgacagctgagagcctggtggggcccctcgggacagtggctttcagtgctgtagctgccctcacagcttgcaggccacggagcgtgaccatccagccccttctgcagagcagccaaaaccagagcttcaatgcctcctctggtctgctgtccccgagccccgaccaccaggacctgggcaggagtggcagggtggaccgcagccccttctgcctcacaaactacccagtcacgcgggaggacatggacgtggtgtcggtgcacttccagcccctggacagggtctcggtgagggtgtgttcggacacgccctccgtgatgcggctgcgcctgaacaccggcatggacagcgggggttccctcaccatctccctgcgggccaacaagacagagatgcggaacgagaccgtcgtagtggcctgcgtgaatgctgcctcgcccttccttggcttcaatacttcgctcaactgcaccacagccttcttccagggctaccctttgtctctgagcgcctggtctcgcagggccaacctcatcatcccctacccagagacagacaactggtacctctccctgcagctcatgtgccctgagaatgctgaggactgtgagcaggctgtggtccacgtggagaccaccttgtacctggtgccctgtttgaacgattgtggaccctatggccagtgcctcctgctccgcagacacagctacctgtatgccagctgcagctgcaaggcaggctggcgtgggtggagctgcacggacaacagcacagcccagacggtggcccagcagagggcggccacactgctgctcacgctcagcaacctcatgttcctggcccccatcgccgtctcagtgcggcgattcttcctggtggaggcctccgtctacgcctacaccatgttcttctccacgttctaccacgcctgcgaccagcccggggaggcggtgctgtgcatcctcagctacgacacgctgcagtactgcgacttcttgggctccggggcggccatctgggtcaccatcctgtgcatggcacggctcaagacagtcctgaaatacgcttaccgctgcgggcaccggcgccagtgctaccccacctcgtggcagcgctgggccttctacctcctgcccggcgtctctatggcctctgtgggcatcgccatctacacctccatgatgactagcgacaactactactacacccacagcatctggcacatcctgctggccgggagcgcagccttgctgctgccgccacctgaccagcccgccgagccctgggcctgctcgcagaaattcccctgccactatcagatctgcaagaacgatcgggaggaactgtacgcagtgacgtgacactggcctggggacagctgctgctctgatgacctcttcagccaggagctgtatcgagggggaggcgcctggtccagccctggacagattgatttccagctgaataaattggcctagataccc

SEQ ID NO: 7648 - DNA, 3691 bp, Homo sapiens
cggaagtgcccggggcgacggcggcggggaccggccgggccatgggcgccgggggcagaggcggaggcggcagaggcggaggcggcagaggctgcccgggcggcggcgggggccggcggcgcgggacgcgggccgggtagcgccgggccgagcgcggagccatgggccgggctggcaccgggaccgggggcgaggcggtggccgcggtggtggcggggccgctgctgctgctgctgcttgcccggcccccgcctgcctccgccggctacagcgggaagagcgaggtggggctggtgtccgagcacttctcgcaggccccgcagaggctgtccttctacagctggtacggcagtgccaggctcttccgcttccgcgtgcccccagatgctgtgcttctacgctggctcctgcaggtctcccgggagagcggcgctgcctgcaccgacgcggagatcaccgtgcacttccgttccggcgcccctccggtcatcaacccgctgggcaccagcttcccggacgacaccgcggtacagccctccttccaggtcggggtgccgctgagcaccacaccgagaagcaatgcctccgtcaacgtttcccacccggcccccggggactggttcgtggccgcccacctgcccccctcatcccagaagatcgagttgaagggcttggctcccacctgtgcctacgtcttccagcctgaactgctggtcacgcgggtggtcgagatttccatcatggagccggacgtgccccttcctcagaccctcctctcccatcccagctacctcaaggtctttgtccccgattacacgcgggagcttctgctggagctgcgggactgcgtgtccaatgggagcctgggctgccccgtgcgtctcaccgtgggcccggtcaccctgcctagcaacttccagaaggtgctcacctgcaccggtgccccctggccctgccgcctgctgctgccctcaccgccctgggaccggtggctgcaagtgacagctgagagcctggtggggcccctcgggacagtggctttcagtgctgtagctgccctcacagcttgcaggccacggagcgtgaccatccagccccttctgcagagcagccaaaaccagagcttcaatgcctcctctggtctgctgtccccgagccccgaccaccaggacctgggcaggagtggcagggtggaccgcagccccttctgcctcacaaactacccagtcacgcgggaggacatggacgtggtgtcggtgcacttccagcccctggacagggtctcggtgagggtgtgttcggacacgccctccgtgatgcggctgcgcctgaacaccggcatggacagcgggggttccctcaccatctccctgcgggccaacaagacagagatgcggaacgagaccgtcgtagtggcctgcgtgaatgctgcctcgcccttccttggcttcaatacttcgctcaactgcaccacagccttcttccagggctaccctttgtctctgagcgcctggtctcgcagggccaacctcatcatcccctacccagagacagacaactggtacctctccctgcagctcatgtgccctgagaatgctgaggactgtgagcaggctgtggtccacgtggagaccaccttgtacctggtgccctgtttgaacgattgtggaccctatggccagtgcctcctgctccgcagacacagctacctgtatgccagctgcagctgcaaggcaggctggcgtgggtggagctgcacggacaacagcacagcccagacggtggcccagcagagggcggccacactgctgctcacgctcagcaacctcatgttcctggcccccatcgccgtctcagtgcggcgattcttcctggtggaggcctccgtctacgcctacaccatgttcttctccacgttctaccacgcctgcgaccagcccggggaggcggtgctgtgcatcctcagctacgacacgctgcagtactgcgacttcttgggctccggggcggccatctgggtcaccatcctgtgcatggcacggctcaagacagtcctgaaatacgtgctgtttcttctgggtacactggtcatcgccatgtccttgcagctggaccgcaggggcatgtggaacatgctggggccctgcctctttgccttcgtgatcatggcctccatgtgggcttaccgctgcgggcaccggcgccagtgctaccccacctcgtggcagcgctgggccttctacctcctgcccggcgtctctatggcctctgtgggcatcgccatctacacctccatgatgactagcgacaactactactacacccacagcatctggcacatcctgctggccgggagcgcagccttgctgctgccgccacctgaccagcccgccgagccctgggcctgctcgcagaaattcccctgccactatcagatctgcaagaacgatcgggaggaactgtacgcagtgacgtgacactggcctggggacagctgctgctctgatgacctcttcagccaggagctgtatcgagggggaggcgcctggtccagccctggacagattgatttccagctgaataaattggcctagataccctcttacttcctcctactgaggagagggccacccctccctcacacgcacctctcctcgccagctgcctgctcgctgctgagatccctctgcagatcccagctgctgtctgcagtggcccctggggcctgggcttggttacttggagaccacaggtgcctgtgcgagggtggggctgtgtgctctgctggcctgtgggtggctagagatggggagaaggactccctatggtcctgttccctggcgaggctgtggtgagacccatggcgcccaggagccctgagcccaccactggggccgggagctgtggactccgagacccctgctcctggcccctgtgtggccctgatgccagcctgcctggggcatggaggatccccctctgctgctgtggtcaccatagggacgggagacggaggtttcccccagagctgatgggcactggggatgcaggctcccgccccgcccctccctttttcctggctctggagccttgggtccctgagaagagcttccttggactggggtgctctgctgctctgggggtttggcccagaaggaacccctacccagccctgtccacccaccccagcgttcctgggcccccctctgggagcttcctcttggtcccaggagctgcggtggtgtctgccccctgcactgggctctgtgccctgtgggtgttcaggagactggactgtctctgctcctcatgcaaaccttgtgggggaagcaatgaccaggagcagcacctggcccctccctgaggcctgtgagtgtctcggatccgccctggagaagtgagtggctgagacccgggtggggccctcctacccttggctctgggggcttcccttctgggtcttgtccgggatatggccttcctgaaggtcttacctcccccagccgccctgcacttgaccaccaaagcaatctctaagcttataaaggagaaacatatatatatggggttttttggagtaaaggaaaattctaagatattaagacatatttttatgtagatctgatctatctgtgtttggtgaatttaatattctacattgatttttcaaactaaacgagtttttacattt

SEQ ID NO: 7649 - DNA, 3713 bp, Homo sapiens
gccccgcttcccacatcggccccagcccctgcctgggtccccatccaggacccccttccagtctctgcccctggcctggcccccatcccggcctcggccctcgttccaccccctgtcacaaatcccagcccaggccctgtcccagccccattcccagtgtttgcttaaggccctggctcaaccccgtcccttgctgcagtccccatcacagcccttccttccatcccactccctgcccttgttcaagccccagtgtccagcccagcccaacccattatctcagcctttgccctcatctctgtgtttacccaagtctctccctctagtcccccctatctctcatactctgcccctctcccagcctagactcaagtctgggtttcagctgccgccagccctattgctgctgttgctgttctctgtccttggcccaggggctggaggccttttcctgactgattactccacctgctcaccccgcaagctgagtcctttccgctcctttgccagcaccgagctcttccacttccatgttcctgaggacacattcctggctgtttggaacctcatcatcttcaaggagcaagggggaacttttggggaccactgcccagaccaaagtgtgactgtgtatttccggtccggggcaccccctgtcatcaatcccctgcatacacacttcccaggggacacagctgtgcctggggttttctcactgaccctcagctggacactgcccaaccgcacctcaggcatctttaacgtcagcagccccttacctggggactggttcttggctgcccaccttccccaggcccacggccacatctctgtcaagggtctccaggatgagtgtcagtacctccttcagccgcagctgattgtccggcgtttgctggacgtcgctgtgctggttcctggccggccctcagagcaaaccctctccccacacaatcgctcagccctgtacaaggtctttgtgcccagcttcacttacagggtttcagcacagctggtgtgtgtggggggccgtggggtatctgcctgccccctgtcactgcgtctgcgtcccaaagccccacccctgcacaactcaagctctgtggcctgtggaggtgcctcaggatgccagctggagctggcactgcccccctgggggcactgggtctacgtgcgtgtggaaacatcatcccggggccctggtaggaccatccgcttccagctgtgtgtgcggttgcaagagtgcccacagcccggcctgctccgagccctggtccctggagctgccatgaacatgccccagtccctgggcaaccagccactgcccccagaaccgccatcccttggaacccctgcggaggggcctgggaccacgtccccacccgagcactgctggccagtgcgcccgactctgcgcaacgagctggacaccttctctgtccacttctacatcttctttggcccaagtgtggcccttccccctgagcgcccagccgtgttcgccatgaggctgttgccagtgctggacagtggaggcgtcctcagcctggagctccagctcaatgcgagctccgtgcgccaggaaaacgtgacggtgtttggatgcttgactcacgaggtgcccttgagcctgggggatgcagcagtgacctgttccaaagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacgttctatcatgcctgtgaccagccaggcatcgtggttttctgcatcatggactacgatgtgctgcagttctgtgatttcctgggctccttaatgtccgtgtgggtcactgtcattgccatggctcgtttacagcccgtggtcaagcaggtgctgtatttgctgggagctatgctgctgtccatggctctgcagcttgaccgacatggactctggaacctgcttggacccagtctcttcgccctggggatcttggccacagcctggacagtacgcagcgtccgccgccggcactgctacccacccacgtggcgccgctggcttttctacttgtgccctggcagccttattgcaggcagtgccgtcctgctttatgcttttgtggagacccgggacaactacttctacattcacagcatttggcatatgctcattgcgggcagtgtgggcttcctgctgccccctcgtgccaagactgaccacggggtcccatctggagcccgggcccggggctgtggttaccagctatgcatcaacgagcaggaggagctgggcctcgtgggcccaggaggggccactgtcagcagcatctgtgccagctgagaggggctttgggcctggccctgaggggatatgaatgcttcctagagttctttctgggggtgtggagccctcttagaaggagacaggctgtatttcttgaggacatggagtctttctcaaggacacaaaactcttccagggacctggagcccttcccaggacatggagaacttcctgagggcctggagtccccctgcatcatggagtccttcttaaggactggagcctatgcaggcacagagtccctcaggaccaaggagtccctcctgcaggtgtggagcctttcctgggatgcagagccttcccaagacatggattccttcccagggagacaaagccctgtcaggagcacagcatctttccagaggaggtggagtctatcttggggaaaccaaatttccagattttcccagaggctcagcaactctggcctcaggcttccttcccagaggcagcgtctgggctgtgctgtgctgtggaggagggattgcaggatggatggagctgggactggggctgtctgggtggctggtatcctcgtttgatacaggtggagtctgtgtgtctccagtgattgattggttcagaatggttctgtgatgccttttttccccctggggtcaggggtgtggggaagtggggaaagagggcccctcagggaatcagcagggctgatgggagctactgccggaggcttttgtcacaccctgtacacagtctgatcccgctcatctgggccctgcattcatttctaaacagtttctaatgcctattccccaattcctattgagcccgatttgcagtatctgaggggtgtgtgtgtgtgtgtgtgtgtttatgtatgtatacgtatgctgagatgatttaaatcagtgagacagactttccttatgatgcccacacccaacacagaaggaagccgaggtcccaggaaattggaatagcaggtacacgtctcaggtgtgcaagaaatatcacaagaatgtaacttctgttttgagccccc

SEQ ID NO: 7650 - DNA, 3441 bp, Homo sapiens
cgacgtcaagtcgaggccgccgccgcggggcctggttatcgccggttcagcgcagcccggagtcgcccaggcctgaactcctacccagcctagactcaagtctgggtttcagctgccgccagccctattgctgctgttgctgttctctgtccttggcccaggggctggaggccttttcctgactgattactccacctgctcaccccgcaagctgagtcctttccgctcctttgccagcaccgagctcttccacttccatgttcctgaggacacattcctggctgtttggaacctcatcatcttcaaggagcaagggggaacttttggggaccactgcccagaccaaagtgtgactgtgtatttccggtccggggcaccccctgtcatcaatcccctgcatacacacttcccaggggacacagctgtgcctggggttttctcactgaccctcagctggacactgcccaaccgcacctcaggcatctttaacgtcagcagccccttacctggggactggttcttggctgcccaccttccccaggcccacggccacatctctgtcaagggtctccaggatgagtgtcagtacctccttcagccgcagctgattgtccggcgtttgctggacgtcgctgtgctggttcctggccggccctcagagcaaaccctctccccacacaatcgctcagccctgtacaaggtctttgtgcccagcttcacttacagggtttcagcacagctggtgtgtgtggggggccgtggggtatctgcctgccccctgtcactgcgtctgcgtcccaaagccccacccctgcacaactcaagctctgtggcctgtggaggtgcctcaggatgccagctggagctggcactgcccccctgggggcactgggtctacgtgcgtgtggaaacatcatcccggggccctggtaggaccatccgcttccagctgtgtgtgcggttgcaagagtgcccacagcccggcctgctccgagccctggtccctggagctgccatgaacatgccccagtccctgggcaaccagccactgcccccagaaccgccatcccttggaacccctgcggaggggcctgggaccacgtccccacccgagcactgctggccagtgcgcccgactctgcgcaacgagctggacaccttctctgtccacttctacatcttctttggcccaagtgtggcccttccccctgagcgcccagccgtgttcgccatgaggctgttgccagtgctggacagtggaggcgtcctcagcctggagctccagctcaatgcgagctccgtgcgccaggaaaacgtgacggtgtttggatgcttgactcacgaggtgcccttgagcctgggggatgcagcagtgacctgttccaaagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacgttctatcatgcctgtgaccagccaggcatcgtggttttctgcatcatggactacgatgtgctgcagttctgtgatttcctgggctccttaatgtccgtgtgggtcactgtcattgccatggctcgtttacagcccgtggtcaagcaggtgctgtatttgctgggagctatgctgctgtccatggctctgcagcttgaccgacatggactctggaacctgcttggacccagtctcttcgccctggggatcttggccacagcctggacagtacgcagcgtccgccgccggcactgctacccacccacgtggcgccgctggcttttctacttgtgccctggcagccttattgcaggcagtgccgtcctgctttatgcttttgtggagacccgggacaactacttctacattcacagcatttggcatatgctcattgcgggcagtgtgggcttcctgctgccccctcgtgccaagactgaccacggggtcccatctggagcccgggcccggggctgtggttaccagctatgcatcaacgagcaggaggagctgggcctcgtgggcccaggaggggccactgtcagcagcatctgtgccagctgagaggggctttgggcctggccctgaggggatatgaatgcttcctagagttctttctgggggtgtggagccctcttagaaggagacaggctgtatttcttgaggacatggagtctttctcaaggacacaaaactcttccagggacctggagcccttcccaggacatggagaacttcctgagggcctggagtccccctgcatcatggagtccttcttaaggactggagcctatgcaggcacagagtccctcaggaccaaggagtccctcctgcaggtgtggagcctttcctgggatgcagagccttcccaagacatggattccttcccagggagacaaagccctgtcaggagcacagcatctttccagaggaggtggagtctatcttggggaaaccaaatttccagattttcccagaggctcagcaactctggcctcaggcttccttcccagaggcagcgtctgggctgtgctgtgctgtggaggagggattgcaggatggatggagctgggactggggctgtctgggtggctggtatcctcgtttgatacaggtggagtctgtgtgtctccagtgattgattggttcagaatggttctgtgatgccttttttccccctggggtcaggggtgtggggaagtggggaaagagggcccctcagggaatcagcagggctgatgggagctactgccggaggcttttgtcacaccctgtacacagtctgatcccgctcatctgggccctgcattcatttctaaacagtttctaatgcctattccccaattcctattgagcccgatttgcagtatctgaggggtgtgtgtgtgtgtgtgtgtgtttatgtatgtatacgtatgctgagatgatttaaatcagtgagacagactttccttatgatgcccacacccaacacagaaggaagccgaggtcccaggaaattggaatagcaggtacacgtctcaggtgtgcaagaaatatcacaagaatgtaacttctgttttgagccccca

SEQ ID NO: 7651 - DNA, 2473 bp, Homo sapiens
ttgcatcacgttgggggagaacgggacggaatgaattctctgacctccgagccgcttctggcaagtgcagaagagaggttaacactagtgctcattaggaggccagaagcctgaggagggcagagcactggctccaagaagagaaagctcatttcctgcagggggcatcgggccagctgggctgcaggcagtggaaagaaggcggcagccgctgcactgaccctgtcccgacctcggcgccccggcctgcgcagggcgggaatcagcaccagctcgttctccggagccaccagttcgacctcaccacacagccccggagcttgtgcctcggaggggcagaggccacaggcaggagctctgcgcggctctgcgcgccttcgggaccccctggccccggatggcttcggagcccgcaggaccccctactcgctcccgcgccacttctcacctgccccccgcgcacccccgtggccgccacggctctgcgcgccgcgcgcaacccagcagccagcaccacggctgccgccatcttccctgagccgcgggaacctctcacccgggtcagcactcggctccgcggccggccgtgggtggggactccgggcgcggggaagcggggtagtggcggccgggcgagccctgctaccccattggagcgcgcctctgagcacgattcaccccattgcctctgcagccactttggaggcgggctcttttcatctcattggctgcttctaccaacgcgaggacaattttccattccattggtttcgtcttctagtccgtgtgaacgttcttttcccattggatccccttactagtttctctgtgagagaaacttccactccattggaaggattaatggagcctggagagacggggtttcaccgtgttagccaggatggtctcgatctcctgacctcgtgatcctcctgcctcggcctcccaaggtgctgggattacagggtctccaggatgagtgtcagtacctccttcagccgcagctgattgtccggcgtttgctggacgtcgctgtgctggttcctggccggccctcagagcaaaccctctccccacacaatcgctcagccctgtacaaggtctttgtgcccagcttcacttacagggtttcagcacagctggtgtgtgtggggggccgtggggtatctgcctgccccctgtcactgcgtctgcgtcccaaagccccacccctgcacaactcaagctctgtggcctgtggaggtgcctcaggatgccagctggagctggcactgcccccctgggggcactgggtctacgtgcgtgtggaaacatcatcccggggccctggtaggaccatccgcttccagctgtgtgtgcggttgcaagagtgcccacagcccggcctgctccgagccctggtccctggagctgccatgaacatgccccagtccctgggcaaccagccactgcccccagaaccgccatcccttggaacccctgcggaggggcctgggaccacgtccccacccgagcactgctggccagtgcgcccgactctgcgcaacgagctggacaccttctctgtccacttctacatcttctttggcccaagtgtggcccttccccctgagcgcccagccgtgttcgccatgaggctgttgccagtgctggacagtggaggcgtcctcagcctggagctccagctcaatgcgagctccgtgcgccaggaaaacgtgacggtgtttggatgcttgactcacgaggtgcccttgagcctgggggatgcagcagtgacctgttccaaagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacggtatgcggtggtgtctgcatcttatcactgggtgcttgtgcatggtggtgggtcacagtctgtatttccaccacgttctccgagggtttgggaatgtctgtgccttcactgtgtcttctacagacagagacagcagtgcttcccaaactgtcatgcatagataatggtcatttttgtaagacacattggagtaaatgaacaaaactgtttgcaacttaataaagtaagtttgggcctcc

SEQ ID NO: 7652 - DNA, 2150 bp, Homo sapiens
acgccgacgtcaagtcgaggccgccgccgcggggcctggttatcgccggttcagcgcagcccggagtcgcccaggcctgaactcctacccaggtccccggcccccgccccgggcccgcgaggacaccggaggccaccccccgggggtggggagcggagccgcggcctagactcaagtctgggtttcagctgccgccagccctattgctgctgttgctgttctctgtccttggcccaggggctggaggccttttcctgactgattactccacctgctcaccccgcaagctgagtcctttccgctcctttgccagcaccgagctcttccacttccatgttcctgaggacacattcctggctgtttggaacctcatcatcttcaaggagcaagggggaacttttggggaccactgcccagaccaaagtgtgactgtgtatttccggtccggggcaccccctgtcatcaatcccctgcatacacacttcccaggggacacagctgtgcctggggttttctcactgaccctcagctggacactgcccaaccgcacctcaggcatctttaacgtcagcagccccttacctggggactggttcttggctgcccaccttccccaggcccacggccacatctctgtcaagggtctccaggatgagtgtcagtacctccttcagccgcagctgattgtccggcgtttgctggacgtcgctgtgctggttcctggccggccctcagagcaaaccctctccccacacaatcgctcagccctgtacaaggtctttgtgcccagcttcacttacagggtttcagcacagctggtgtgtgtggggggccgtggggtatctgcctgccccctgtcactgcgtctgcgtcccaaagccccacccctgcacaactcaagctctgtggcctgtggaggtgcctcaggatgccagctggagctggcactgcccccctgggggcactgggtctacgtgcgtgtggaaacatcatcccggggccctggtaggaccatccgcttccagctgtgtgtgcggttgcaagagtgcccacagcccggcctgctccgagccctggtccctggagctgccatgaacatgccccagtccctgggcaaccagccactgcccccagaaccgccatcccttggaacccctgcggaggggcctgggaccacgtccccacccgagcactgctggccagtgcgcccgactctgcgcaacgagctggacaccttctctgtccacttctacatcttctttggcccaagtgtggcccttccccctgagcgcccagccgtgttcgccatgaggctgttgccagtgctggacagtggaggcgtcctcagcctggagctccagctcaatgcgagctccgtgcgccaggaaaacgtgacggtgtttggatgcttgactcacgaggtgcccttgagcctgggggatgcagcagtgacctgttccaaagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacggtatgcggtggtgtctgcatcttatcactgggtgcttgtgcatggtggtgggtcacagtctgtatttccaccacgttctccgagggtttgggaatgtctgtgccttcactgtgtcttctacagacagagacagcagtgcttcccaaactgtcatgcatagataatggtcatttttgtaagacacattggagtaaatgaacaaaactgtttgcaacttaataaagtaagtttgggcctcca

SEQ ID NO: 7653 - DNA, 1764 bp, Homo sapiens
cggcattgggggaggggacgggggtcgcggggctattgggggtcccagtccggcttaagacctctgggcgtggtgggcaccggccttcgccgtcggagcaggggtcccagactcgcacccaaaagttcccgtcgggcccgagcggggaggagctgcggggcgggcagaggcggagatggcggagggcggtgggacgtgatgcgcgggtcagagccgggccttgagaaggaactggaggcccctggcagcggtgtcccctcgaggacccctctgccgggctcaccaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatatactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctctgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttcttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctc

SEQ ID NO: 7654 - DNA, 1959 bp, Homo sapiens
gtggacgcggcattgggggaggggacgggggtcgcggggctattgggggtcccagtccggcttaagacctctgggcgtggtgggcaccggccttcgccgtcggagcaggggtcccagactcgcacccaaaagttcccgtcgggcccgagcggggaggagctgcggggcgggcagaggcggagatggcggagggcggtgggacgtgatgcgcgggtcagagccgggccttgagaaggaactggaggcccctggcagcggtgtcccctcgaggacccctctgccgggctcaccaggtggctggcggagagccggagagttgggcgggagggaagcagggtttggcgaccaggtttagcaggccttggaatcctggagcccagcccccaaccccattcccacttggccggatggttaagggcctagcgtgctggctgcggtgtggccaccttccccttctccgactccgtatctctttttccaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatatactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctctgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttcttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctc

SEQ ID NO: 7655 - DNA, 1544 bp, Homo sapiens
agaagctaggagagggcggggacaactgggtcttttgcggctgcagcgggcttgtaggtgtccggctttgctggcccagcaagcctgataagcatgaagctcttatctttggtggctgtggtcgggtgtttgctggtgcccccagctgaagccaacaaggtgagggagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatatactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctctgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttcttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctc

SEQ ID NO: 7656 - DNA, 1572 bp, Homo sapiens
tgctaggctctgtcccacaatgcacccgagagcaggagctgaaagcctctaacacccacagatccctctatgactgcaatgtgaggtgtccggctttgctggcccagcaagcctgataagcatgaagctcttatctttggtggctgtggtcgggtgtttgctggtgcccccagctgaagccaacaaggtgagggagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatatactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctctgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttcttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctc

SEQ ID NO: 7657 - DNA, 1529 bp, Homo sapiens
aggagagggcggggacaactgggtcttttgcggctgcagcgggcttgtaggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatatactgagcaactgcacaatgaggaggagaatgaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctctgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttcttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtggatctgaacaccacagcccctgtacttgggttgcctcttgtccctgaacttcgttgtaccagtgcatggagagaaaattttgtcctcttgtcttagagttgtgtgtaaatcaaggaagccatcattaaattgttttatttctctca

SEQ ID NO: 7658 - DNA, 397 bp, Homo sapiens
ggctgcagcgggcttgtaggtgtccggctttgctggcccagcaagcctgataagcatgaagctcttatctttggtggctgtggtcgggtgtttgctggtgcccccagctgaagccaacaaggtgagggaggtgagcctgcagcacctggtcacgaccacagtgcacggccaccctgtctacagggctgactcagagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaag

SEQ ID NO: 7659 - DNA, 507 bp, Homo sapiens
ggacgggggtcgcggggctattgggggtcccagtccggcttaagacctctgggcgtggtgtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatatactgagcaactgcacaatgaggaggagaatgaggatgctcgctctatg

SEQ ID NO: 7660 - DNA, 487 bp, Homo sapiens
gtccggctttgctggcccagcaagcctgataagcatgaagctcttatctttggtggctgtggtcgggtgtttgctggtgcccccagctgaagccaacaagagttctgaagatatccggtgcaaatgcatctgtccaccttatagaaacatcagtgggcacatttacaaccagaatgtatcccagaaggactgccctgtctctctctgttgtagcaactgcctgcacgtggtggagcccatgccagtgcctggccatgacgtggaggcctactgcctgctgtgcgagtgcaggtacgaggagcgcagcaccaccaccatcaaggtcatcattgtcatctacctgtccgtggtgggtgccctgttgctctacatggccttcctgatgctggtggaccctctgatccgaaagccggatgcatatactgagcaactgcacaatgaggaggagaatgaggatgctcgctctatggcagcagctgctgcatcc

SEQ ID NO: 7661 - DNA, 454 bp, Homo sapiens
gtggtttgtgatgcagtggggagtagggttgtgcacggagtcaattgggataaatgtgaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagaccaacaa

SEQ ID NO: 7662 - DNA, 944 bp, Homo sapiens
gggttgtgcacggagtcaattgggataaatgtgaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagcatccccagtgcctgacctatagtaggtgctacgtatctgcttttggaatacatgcatgaatgaatgaatgggtatgttgggtgggggagggaccaggggaagggtctgggactgaggggatgcctgggtcactgctgcccactgcctctacagaccaacaaggcttgggccaagggggacatccagggggcaggggccgcctcccgccgtgccttcctgctgggggtcctcgccgtcgggctgggcgtgtgcacgtatgcggctgccctggtgaccctggctgcctaccttgcctcccgagacccgccctagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagccaaa

SEQ ID NO: 7663 - DNA, 1386 bp, Homo sapiens
gaatgtaaagcgtttaacacagggcttgggtacagtctgccctcaatgaaccaatgatgtacccctaggcaatttacctaacctcggcttgccagtttcctcccgcgtgaaacaggacaataaacgattatgcctcttagggttgtgctgaggaatacatgtgtatgtaagtttatttgcaaagcacttagaacagggcgcacggtccttgttgctgttattattattggctattattgcgcaaaggggaagggaggcggggccaagccaggaaggccctggagaatccggggtgccccctcctccggcagagcttgggcctgggctcacgaggaaggggctgcagttctccaaggattcccgcctgctcccagacccccgggagtcgtaggaacccgttcctggacgctgacgtcggctttcagggatccctcgccggacgccgcggagggacagagcctgggaagccgtcgccccgccccgtccccgcccccgcgcgcagcgggcccggggcgctgagacccgcgtagagcaaagcgcaaggtcccagcgccccttggatcctcggtggcagggtccgggcaagtgtcattgcgagggttcaggaagccccggcctgtgatcgtgagcggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagaccaacaaggcttgggccaagggggacatccagggggcaggggccgcctcccgccgtgccttcctgctgggggtcctcgccgtcgggctgggcgtgtgcacgtatgcggctgccctggtgaccctggctgcctaccttgcctcccgagacccgccctagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagcc

SEQ ID NO: 7664 - DNA, 650 bp, Homo sapiens
ggctcgcgcctctcccaggacccgcctggctgcgagatatgaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagacccgccctagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagccaaa

SEQ ID NO: 7665 - DNA, 864 bp, Homo sapiens
ggattcccgcctgctcccagacccccgggagtcgtaggaacccgttcctggacgctgacgtcggctttcagggatccctcgccggacgccgcggagggacagagcctgggaagccgtcgccccgccccgtccccgcccccgcgcgcagcgggcccggggcgctgagacccgcgtagagcaaagcgcaaggtcccagcgccccttggatcctcggtggcagggtccgggcaagtgtcattgcgagggttcaggaagccccggcctgtgatcgtgagcggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagccaaa

SEQ ID NO: 7666 - DNA, 721 bp, Homo sapiens
ggggcgctgagacccgcgtagagcaaagcgcaaggtcccagcgccccttggatcctcggtggcagggtccgggcaagtgtcattgcgagggttcaggaagccccggcctgtgatcgtgagcggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagccaaa

SEQ ID NO: 7667 - DNA, 400 bp, Homo sapiens
ctgggatggaggcagccgtctttcaccatttctaccccacgaccacctcggcttggctgtcttctccatgctgtgttgtttctggcccgttggcatcgctgccttctgtctagcccagaagcatccccagtgcctgacctatagtaggtgctacgtatctgcttttggaatacatgcatgaatgaatgaatggttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagcc

SEQ ID NO: 7668 - DNA, 450 bp, Homo sapiens
gcaggcaggaggcttggggaccttccagggggatcgtaggacgagaagaagaatattctttctggttgtgttgcgtgtgaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgcct

SEQ ID NO: 7669 - DNA, 725 bp, Homo sapiens
tgagacccgcgtagagcaaagcgcaaggtcccagcgccccttggatcctcggtggcagggtccgggcaagtgtcattgcgagggttcaggaagccccggcctgtgatcgtgagcggaaacccctcctggagtttccccaaagccatggacagccctagtcttcgtgagcttcaacagcctctgctggagggcacagaatgtgagacccctgcccagaagcctggcaggcatgagctggggtcccccttaagagagatagcctttgccgagtccctgaggggtttgcagttcctgtcaccgcctcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagacccgccctagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgcagccaaa

SEQ ID NO: 7670 - DNA, 489 bp, Homo sapiens
tcttccctccgtgagcgctggcctgggggaaccaaggccccctgatgttgaggacatgtcatccagtgacagtgactcggactgggatggaggcagccgtctttcaccatttctaccccacgaccacctcggcttggctgtcttctccatgctgtgttgtttctggcccgttggcatcgctgccttctgtctagcccagaagcatccccagtgcctgacctatagtaggtgctacgtatctgcttttggaatacatgcatgaatgaatgaatggacccgccctagttgcccctacagccctcactgtgaaccctgaggccggcagcccagcaaatctgtgggcagagagtggagaatcttggtggatgaggctgcggcggcggcaggagcatctagaaacgggagcgagctggactggaacccttccccttcctggccaccgctcttcgggcggcagcaacctgagattaaacaccagacacccttgca

SEQ ID NO: 7671 - DNA, 2765 bp, Homo sapiens
gtgtgatctcagctcactgcagccttgaactcctaggctcaagtgatcctcctacctcaacctccagagtaactgggactacaggaaagctcagtggcccccaagccaggatgtcccaagcttgggtccccggcctcgcgcccaccttgctgttcagcctgctggctggcccccaaaagattgcagccaaatgtggtctcatccttgcctgccccaaaggattcaaatgctgtggtgacagctgctgccaggagaacgagctcttccctggccccgtgaggatcttcgtcatcatcttcctggtcatcctgtccgtcttttgcatctgtggcctggctaagtgcttctgtcgcaactgcagagagccggagccagacagcccagtggattgccgggggcccctggaactgccctccatcatccccccagagagggtcagagtatccctttctgcgcccccacccccctacagtgaggtgattctgaagcccagcctgggcccaactcccacagagccaccccctccctacagcttcaggcctgaagaatataccggggatcagaggggcattgacaacccggccttctgagtcacctcctgcctggaatcttgccatcagcaacctcctccccagtgcctcctggatcaagctagagactgctggcaccccaggaatgtccctgcccatcctgccgtgtctctgttcattcttggatttaacttattactttttctgcttctgtttccaccccagctgcctctcttgtcctgagggttaggctggagtgacagtttccgcccaccccccagcccaagaaagaggctgccggaaagaaaatgctgaccattggaggtgcccaacagtagaatgggctactgtgaggggtagtaagagccccatttctggaggtatgcaaatcttgactggacagccagctctgagattttatcagggcacttctatacctgtgggacattggactggatgagccctgagccagcttccactcctacctgaatagagaactcactgcacccacccacaacacatgataaacacatgtcctcactgaatgttactgattgcggctgagggcctgcctctggctgtgtggggaggtgggtggagaggtgagcccaggcactgctgaggggtgcggtgatggggtcgctgcgccgcaatcccaccactgatgagccacctgggaggtctgggaggacagtccatccatgggccgccctcggagagaggcttgttctagatgtattggctgtctgttttttgatgtctctgtgtgccaaacagcctggaaatggggtacgcgtgtcccttgtgtgggtttcccaatcccttccgcccaaggctttcctgggacacatggagcccagctctctggctgtcttaccatgagaagttggtaagttggctgtgagggggttggatccaggaagcagccctgggacagcccattctgctgttgatagcaggaaaccacctgctgggagacaatgggggtggggaaaagcccaggagagcagtgggtggggctgggcatccgtggagtggggctttaggagaccttgaacggccccaccctggaatctcctacaggaaggtgaggaggtggcaggttccacccttctctaccagccccgctcgctcgtgggagttaaccccctaggggagaagagtcttcactggggttcgacccatgggggcctggcatagtcatgcagaatggggcgggacaatgccaatgccttgggactcagacagggctgagtgcctccaccctgatttttgcctctgcactgcgcccccacagcccactcaatgccagcctccttctccaggcagagagccccatgtcaatgctggccaaagctctcaggaggattggaggtagaactggccctggtatgccaacaggggtgcctcttttagtgctctcccaataatgctcatcctgggggcatcaggacgcaggcaggtggcagagctgggggcagcttgatggcacaggcagccccaaagatgccaggaacagggactgtccgggtgtgggttcccagtgagatagggccctggaaggagtgcagcagttactgacaatatagtgccagggttggccataggagaatgagcccaagcgtaagtggaagtttccctttactttcagggattggtcaggggtggcagaaaacatgtgggttctttgtgtagatgtggctagttccaattagagaagtcctgcagctgatgttgccctcaccgtgatagcaggaggatgttgagaaatgggcttgggagacctggaggagaagttaccctcggcccagacgttgccttcctttcatcacagggcctttaactcctcctagggagtagcagagtggccctagggaaagtggccatcctgaaacctagtgttgctgtgacctggtgacagaaatggaaacctctgtggctcttctggtcatccttggtgggagtgggaatggtgtcacctttctagagggccatctggcaccatgtaatcacgccacagatctttacgaagctcctgctatgtaggaaacactatgcctggcactgggtatccattaaaatgtaaaatgcacgtgacctggcaattccacttctagaaatgagccttcagaagtgctcatacaaaagagctcaataagtatcatgcactaattcattgtgccaccagagctccctatgcagccttttaaaagaataaataggatctgtagcacc

SEQ ID NO: 7672 - DNA, 573 bp, Homo sapiens
ataggtggagagaagtgggagaggtcgcagccccgccttctctacacaggaaagctcagtggcccccaagccaggatgtcccaagcttgggtccccggcctcgcgcccaccttgctgttcagcctgctggctggcccccaaaagattgcagccaaatgtggtctcatccttgcctgccccaaaggattcaaatgctgtggtgacagctgctgccaggagaacgagctcttccctggccccgtgaggatcttcgtcatcatcttcctggtcatcctgtccgtcttttgcatctgtggcctggctaagtgcttctgtcgcaactgcagagagccggagccagacagcccagtggattgccgggggcccctggaactgccctccatcatccccccagagagggtcagagtatccctttctgcgcccccacccccctacagtgaggtgattctgaagcccagcctgggcccaactcccacagagccaccccctccctacagcttcaggcctgaagaatataccggggatcagaggggcattgacaacccggccttctgagtcacctcctgcctggaa

SEQ ID NO: 7673 - DNA, 675 bp, Homo sapiens
cccgagacctcccggcagtcttccgagcaagatggcgccgcgggcatttcttccactgcccgtctgagggaacgctaagtagtgtgtccggcgccgtgttccagctccgcgttgttccgcgagaaagcgagaggccgagcccgggctggtgcgatggccgcggtggtggccaagcgggaagggccgccgttcatcagcgaggcggccgtgcggggcaacgccgccgtcctggattattgccggacctcggtgtcagcgctgtcgggggccacggccggcatcctcggcctcaccggcctctacggcttcatcttctacctgctcgcctccgtcctgctctccctgctcctcattctcaaggcgggaaggaggtggaacaaatatttcaaatcacggagacctctctttacaggaggcctcatcgggggcctcttcacctacgtcctgttctggacgttcctctacggcatggtgcacgtctactgaaatgggggcccgggggacttttttaaaaaaccagatcgggaggactgtggccagcaattaacaccatgtagacttccttagttcttaagtggttgaattcgctgcttgttctgtaacgttataaataatttatatctgaagacggagagcctgtaatattcttcagattaaatgaagcgtgagacactt

SEQ ID NO: 7674 - DNA, 788 bp, Homo sapiens
cccgagacctcccggcagtcttccgagcaagatggcgccgcgggcatttcttccactgcccgtctgagggaacgctaagtagtgtgtccggcgccgtgttccaggtaactgggccaccgtggccggggaacgcagacgcgccaccacctcccggccggcccggaccctcaatctcctcggcgtctttggaagatccgaggcccaggactggtgccagctccgcgttgttccgcgagaaagcgagaggccgagcccgggctggtgcgatggccgcggtggtggccaagcgggaagggccgccgttcatcagcgaggcggccgtgcggggcaacgccgccgtcctggattattgccggacctcggtgtcagcgctgtcgggggccacggccggcatcctcggcctcaccggcctctacggcttcatcttctacctgctcgcctccgtcctgctctccctgctcctcattctcaaggcgggaaggaggtggaacaaatatttcaaatcacggagacctctctttacaggaggcctcatcgggggcctcttcacctacgtcctgttctggacgttcctctacggcatggtgcacgtctactgaaatgggggcccgggggacttttttaaaaaaccagatcgggaggactgtggccagcaattaacaccatgtagacttccttagttcttaagtggttgaattcgctgcttgttctgtaacgttataaataatttatatctgaagacggagagcctgtaatattcttcagattaaatgaagcgtgagacactt

SEQ ID NO: 7675 - DNA, 1768 bp, Homo sapiens
tccgctcccctctccgtctgccgcccggacgggccaccgcgggggcgcgaggaaggggtgttgggtcgccagggcccgcctcccagctgccccggccgccggggggcctggcggtgacggcggcgcctggcggcggggatttggcgcgggccgggggccgggggccggggcgcgggggcgcgaggctggattcctagggccgcggcgcttcccggcatgctccgctgcaggcccgcgcccgcgcccggactttgccatcggcggggcagtcgcgggatgcgcccgggagccacagcctgaggccctcaggtctctgcaggtgtcgtggaggaacctagcacctgccatcctcttccccaatttgccacttccagcagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccacggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttccctcaa

SEQ ID NO: 7676 - DNA, 1698 bp, Homo sapiens
cccggggcggggcgcaggcagggaccctccgctcccctctccgtctgccgcccggacgggccaccgcgggggcgcgaggaaggggtgttgggtcgccagggcccgcctcccagctgccccggccgccggggggcctggcggtgacggcggcgcctggcggcggggatttggcgcgggccgggggccgggggccggggcgcgggggcgcgaggctggattcctagggccgcggcgcttcccggcatgctccgctgcaggcccgcgcccgcgcccggactttgccatcggcggggcagtcgcgggatgcgcccgggagccacagcctgagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccacggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaat

SEQ ID NO: 7677 - DNA, 808 bp, Homo sapiens
tggcggtgacggcggcgcctggcggcggggatttggcgcgggccgggggccgggggccggggcgcgggggcgcgaggctggattcctagggccgcggcgcttcccggcatgctccgctgcaggcccgcgcccgcgcccggactttgccatcggcggggcagtcgcgggatgcgcccgggagccacagcctgaggccctcaggtctctgcaggtgtcgtggaggaacctagcacctgccatcctcttccccaatttgccacttccagcaggtaagacccacctgtcccactctctttcgtggcttcttgaccagatctgctctgacttcatgttctctcaagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccag

SEQ ID NO: 7678 - DNA, 896 bp, Homo sapiens
gggatgcgcccgggagccacagcctgagggtttaaaaagctattttaaggccgggctcggtgtctcacgcgtgtaatcccagcactttgggaggcccgaggccctcaggtctctgcaggtgtcgtggaggaacctagcacctgccatcctcttccccaatttgccacttccagcagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggag

SEQ ID NO: 7679 - DNA, 4434 bp, Homo sapiens
tccgctcccctctccgtctgccgcccggacgggccaccgcgggggcgcgaggaaggggtgttgggtcgccagggcccgcctcccagctgccccggccgccggggggcctggcggtgacggcggcgcctggcggcggggatttggcgcgggccgggggccgggggccggggcgcgggggcgcgaggctggattcctagggccgcggcgcttcccggcatgctccgctgcaggcccgcgcccgcgcccggactttgccatcggcggggcagtcgcgggatgcgcccgggagccacagcctgaggccctcaggtctctgcaggtgtcgtggaggaacctagcacctgccatcctcttccccaatttgccacttccagcagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccacggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttccctcaagtgtgtagttattgagtcaaattcatatgcatggtgtattgtgggacatacttagatggaaggagagagcctaagaatcctgaggatgatttctgtgtatgcctcaaaatgagatatttaggctgggcgcggtggctcacacctgtaatcctcgcactttgggaggctaaggtgggtggattgcttgagcccaggagtttgagaccagcctgggcaacatggtgaaacctcatctctacacaaactacaaaaattagctgggcatggtgacacgtgcggctgcttggtaggctgaggtgggaggatcgcttgagcccaggaggtgaaggttgcagtgagccctgattgtgccactgcattccagcctgggcgacagagtgagaccatgtctccaaaacatacatatatataaaatatatttaaagacctcttggagttcaggcagaagtgaagatagcactatgaagtagtttccacattaacaatagcaatgacttgaacgatgtgttccccctttcttctgatattaatatctgttcattttgcaaacattgaaagattatgaaagctatgacccagaatcacaattatataatttggatacatacccaaatggcataatttctgtcataagcctgtaggaaaagcttgaattcttcacttctcagattctcagagccagcttgctcttgggagaggggcctggtataggggctgcccaggttcgtagcctatgctgtcaagcatgtttggagttgcacatctgttcccatgtcattttctctgtctaactgaagtcagaaaattcctcagctggattctggggaaccaggaacccatattcccaaatccaagattgggacctggtttgtctttccatttgggcacatttcattctttccaggaaaacaggccacttccaacctgcacaatgtacaccaaaccacagaaccacagctgggatatggagtcaggagagggaagctggagctcaactctcatggactaaaggatggattctggatgggctccaggggacaccttattggattggtggcttccatcaactcttaaaaacgttaagtggtgaactttcccgtcctgtcaagctgtgaatggggaatgtatacaaagtcactttgacttttctatttgaggcctccacagtaaacatccagagtcatcctatttttgtctttttacctccctttcagaacctgttttcgtaattagactggaaagcaattcatgctaagtttgcaatggctgccacagttgtaagtgtcccctgcattttaacctgcactagagccctaagccacagagaagcagttctgaattggtatctcaaataccatccacctggtgtgggtctgcagggtggagagctttcccagcacccctgaagcaatgcccaatgtcgattaccttctctgagtcctggcaagtcctggcacattggctttctggatcccttagatgctgccctttctgttgtgaggagaggttgccgaagatattggaggtgtctgctggactgtaggatttctgatcccactgctgtgtagtttttttttctagtgctggacaagtaagaagcctctggataaatttggtgttggtggctgatggttgaagtggaagcagtctttggggtaggaggcaatgccactcctctaggcccttcgggagttggctgaagttacttcctcccttggaaggggctggttagtgagtgccagggatctcaggactgtctctgtgccaggtgtggtttcccaggcaacagacacattcctaagtgcctagttctctagcgtctgtatacatggtagtagagccttccttccatgtctctcttccctctggcctggaataggagcattagactcaaattctgatgaaaaagaaattacttggagatagagattcaatgtgaagagaacaagatatttgaagtcagaattaggtttgaatttgggctcagtgacttacagtgtgagcttggtcaagttcttaacattctggtccttagcattctcatctgtatggtcaaggctattgtcattgggttggtatgtcaacaagcaaaacggtatgtgtgagctgcccaattgtgggcctggttctgattagccaatgttaacacccttctctccacagcttcccattctctgatgccgctgacccagatggcgtcacctcagttaccatggcttggtccaagcagtgacttctgttcatgggctctggaattgagtggccaaaaatctggaatccctacagtagggagagtagccttgtccctgccccactacaagtctgttcatatgaagacatacaaagccgtcgcctctaatcagtgttcaaagggtcgattgtgcaactcacattcctccagagaaattcccccagcttgtgagatctccaagagggaacacgtattcctggcatccaacttcccctggtgctccccctgacctgcctcattccaggagttccctctccagagaccctgtgtgcccacacgagcagacttttagaaaatggcctacagttcaaaggccctgcattgctttatggccttggaaatgtggggaaagtgtcagatgaagaatttctatcctcctcacctcctccctgtctccaataaatgcataccaaga

SEQ ID NO: 7680 - DNA, 2058 bp, Homo sapiens
gccgaaacttccgccgccgcgtccgccgcctccggaactaaacggggtgaggtcacattcggttatctctaacgttggaaaacgatggagctaacacccattatggagattaaccacttttcatcaggtttttaacttaagtcgtgaggaatacaacggtgaacacaagattcattttattttcatcaccatgggacgtatcctgttgttgagttctctgggtcagacctctgaagacttctcagatggatcctagtctctgggcttgccctgaaattactcgctgctcagggagagagttgaaatggttggcatcctcccactctgttgctccggctgtgtcccctcgctctgttgttccagctatgtgccctctgttgctccaactgcagctcattctgttagagttcctcattcagctggtcactgtggccagagggtgttggcctgctcccttcctcaagtattcttaaagccatggatttttgtggagcatttttcttcctggctctcccttgagttattttcctttcttcgctatcttgggactcttctttgtgcttgcggtcatcggttgagagaaggacttcttcttccttgtctccttggtgttggctcgtggttgctcttcaacaactggactggaggctcttggttttctcttcatcttcaacaagtcagtctctctcaagggtctcacgttgcagcattcttaccagaggccattgggcctggagttccagttccagtgtctggagagtccacctcagctcagcaatctcatgccggttggcaattgtcagcagaagccgatgcctgcccatcagttctttactctgaggtgttagagtggaataaaaatataaatacttatactagttttcatgacttctgcttaatattgggtatttttttgttttgttttgttttggcggtgataggcttaccttacattaaaccaggccttagcctttctgtggctttgttatggcaaagcctcatattactctctagtctggttcagcaggacagtcaggtccacacctggggctgtttgttttctacgtttacctcaacataaggtaccttatcattgtcagccttcatctcctgatccaaaataaaataaaatgccacaggttacttgattttgcatctggaatatgattatttaaagaaattaaaaatttaaaactgaaaatgtagagtttagaaatcttttttaaggtttcaaaaaaatttctaggagacaacaaaatagtgttactagatttagcaaataaaatacagaatgccaattaaatttgaatttcaaatgaacattgaatactttttttggtataactatattccatgcaatatttgggacatatctgttatattattcattgtttacctgaaattataatttaaactgagagttctgtattttatctggcaaccttattatgaaaatatttaggatcaatataaaggaataatatttttaatttttacaaactattttaatataagtaatttatttgattttcattgtcatcctgagagttaagttttgccttacagtctatgttactttacctgtgttttatgaaaagactgtctcttataatgatagccaccaccaccatatcttgacaagtattgacatactgaaactttaaattcattttgtgtagttcccgcctcttcatgattgtttctgaggtaattcagcttctccgtctggctttccattttcaactctaggttagtcttgttcaaagtcaactcatctaagacacttcgcaggcccttgctatcagcctcaacacagtgataaaggacaactttactctggcatctgaacagagcccaattggaagaatcaatacagcttagatggaggtctcctcatccagtggtaataaaacatcccacatagtggagcttagagagcacagcactgggatgtgaagacatgggttcaaattgcacctctgccatgttcagctgtcaccttgggcaaattacttctctgaaccttagttttctcatcattaaaatgggaatattggt

SEQ ID NO: 7681 - DNA, 854 bp, Homo sapiens
ttccgccgccgtagccgccgccgaaacttccgccgccgcgtccgccgcctccggaactaaacgggatggagctaacacccattatggagattaaccacttttcatcaggtttttaacttaagtcgtgaggaatacaacggtgaacacaagattcattttattttcatcaccatgggacgtatcctgttgttgagttctctgggtcagacctctgaagacttctcagatggatcctagtctctgggcttgccctgaaattactcgctgctcagggagagagttgaaatggttggcatcctcccactctgttgctccggctgtgtcccctcgctctgttgttccagctatgtgccctctgttgctccaactgcagctcattctgttagagttcctcattcagctggtcactgtggccagagggtgttggcctgctcccttcctcaagtattcttaaagccatggatttttgtggagcatttttcttcctggctctcccttgagttattttcctttcttcgctatcttgggactcttctttgtgcttgcggtcatcggttgagagaaggacttcttcttccttgtctccttggtgttggctcgtggttgctcttcaacaactggactggaggctcttggttttctcttcatcttcaacaagtcagtctctctcaagggtctcacgttgcagcattcttaccagaggccattgggcctggagttccagttccagtgtctggagagtccacctcagctcagcaatctcatgccggttggcaattgtcagcagaagccgatgcctgcccatcagttctttactctgaggtgttagagtggaataaaaatataaatactta

SEQ ID NO: 7682 - DNA, 1194 bp, Homo sapiens
atgaaaggaacatccattttattcaaagcacctccaaacctgcaatcctaagttccaggcaactcaatcccaaaaatccactgtagatgcccaaaggctggggtgttcggtcttcaacatttttgcctttgtggctcccagtcaagatagagctgcaccaagtccaattccattcctcatcacagatgattttttctactttaagatcagaactatacaagcttcttgctttgtgtcagcatgctgttgtacccatgggcaaattcttaggtaagacaaaaacacagtcccaagggcaggtagtaattttttcagaaaaaggtaaggcaatcatttatctcagtctgcccaggacagtcccaatttacacatgtatattctcccaatctgtaggctgtcttttcattttgttgattatttcacttaattttttattatttatttattttatagagacagatctcattatgttgcccagggtgatccttgatctcctggcctcaagtgatcctccaaccttggtctcccaaagtgctgggattacagatgtgaactaccacacccagtcaacgtgcagaaggttttcagtttgatgtagtctgatgtagtctcatgtatttatccttcttgttgttgcctgagcttttggtgtgatatccaaaaatatcattgccaagatcaatatcaagaaactttccccctatgtttcttacagaaattttatggtttcagatttttcatccattttgagtatatttgtgtgtatgatgtaagataagggtccagtctccccagtgttggatatccaattttcataacaccatttattgaagagattattctttctccactgtgttttcttgatgtccttgtcaaaaattagttgacttttatatgcttgggtttatttctgggctctattctgtttcattgctttacatctctgttttcatgccagtgccacagtgttttgattactatagctttgtaatataatttgaaatcagaatgtgtaatacctataactttgttttttgctctaaagatttatttatttatttatttttgccatttcaggtcttttgtggtttcatatgaatttcagaattgtttttcctatttctgtgaaaaatgccattgacattttgatagggattgtgttgaatctatatattgctttggatagtatggatg

SEQ ID NO: 7683 - DNA, 3962 bp, Homo sapiens
agctcggtcgcttgtgcgttccgctccggccgccctttgcgcttggatccacttccccatctgtaacgaggtgttgagacgaggcggagttgacctggaaacctctccttggccactgtcctttctaaggaactcatttccagagtccaccagcacagaactggtgggggagcctactaggagcagagaaaatggccatcttcaggcagctgtccctaggcgcgaaggccaccctggctgctgtcactgtcttcgtgtccatgatcgcctcccgctcgtatctggcagagagccttgagctcagggcctggcgttggctgcttcgcttgcagcttgccctgtttgtcaactcgctcttgctcattggctccctctacatttggcgcagcacagtgagcaacctctgccactccccagctgcagagtcaacctgttttcagctttggaaggtggtggttctggcatttctggccctggcccattccagtttctttaccatgttctttttagtggccgaagagccctatctcttttccttggcggcctactcctgcctgggtgcttacatcatcatgctcttcttcctcttcatcctcagcggcatggagcaggcctaccagctcttggcctggcgcagtggtagggtcgtgggcagccttgagaagacaaggaagctcgtgctcaggcctgccctggcagtgggagtgactgctgtgctcagcgtggccgggattctgaatgccgcgcagcccccggctgtgaaaactgtggaggtgcccatccatcagctgcctgcctcaatgaacaacctcaagatcgtgctcctctcagacattcacttgggccccacagtgggcaggaccaagatggaaatgtttgtgaggatggtgaatgtgctggaaccagacatcacggtgattgtgggtgacctctccgactcagaagcctcggtcctgcggacggctgtcgctcctctgggccagcttcattcacatctcggtgcctacttcgtcacaggcaatcatgagtactacacgtcagatgtcagcaactggtttgcacttctggaatccctgcatgtccagcctcttcataatgagaacgtgaagatttccgccacacgggcccaacgtggtggtggtggcagtggcagtgggagtgaggatgaggactggatctgcttggctggggtggacgatattgaagcagacatcctgcactactctggccatggcatggatcttgacaaggccctggagggctgcagcccagaccacacaatcatcttgctagctcaccagcccctggctgccaagagagctctccaggctcggccagatattaacctgatcctttctgggcacacacatgctgggcagatcttccccttgaacgtagcagcctatctcctgaatcccttctttgctggtctctaccaggtggcccaggctacattcgtgtatgtcagcccaggcacagcctactacgggatacccatgaggctgggtagcagggccgagatcacagagctcatcctgcagcggtctccctgaactggccctgccctgtgcacctctgccctgcccttgtcctcgaccctccatcctgcttcagagtggtttgcctgcttttcccctccagccttgcccactcatccttgcctacacacccttggtcacaagcctgactcaaacagtgacttatggtgggcctgcctggcatgttcaggctggtttaactatttccttggccagttgctttttttgatgcacttgtgagatcactaaggtcacatatattagcactcccctctattttccagatgatgtggaatggggaccttctcctgcagagctcccagggatgaacctcccctcggggttgctagaaaggcatacctctagaaggtggggcggggaggagcaggagcatttttctcctggtgttttaaaattgtctttaggacttaagtggtttccagaatcattgatccagagcctttctggggaaggggtagtgttgccaggtaatttgggagaacaggcaagatggaagggccctctggctgctagagaagaatattttcttttcctctgattctatcaggatcacctctattgagggcatcagcaaaatctactggaatgcaaagctcctcctgttccaggccttgagggatgctatttaactgtctgtgctcctgggcctttgggggcaaggtcaggggagaagaacggtgggcgccatggtcggtgatggtgagaacatggctgcttaggaattcagagggctttgcctcccttgtctcattttatacaacccttcggggagctcactggggacaggctgcttttccctatttggagataaggaaaccaaggcaaagagagatagggcacaggcagtatgacaagatatgtaggagatttggggctagaaaccaggtcttgtacctcccagtaaaagcggtgcttttgcccttttgccagaagcaatagatcctttgatcctgagatggagataagcacccgtgttagaaaaggcctcactgagaagacagggctgggctggtttcctgctgggtgatttaggcttgtgatggaaagtcttcctccaatggggagtgaagacactcgctctgactggagaggctaaccctgctgctcactcatagggcagcgttgggtgggtgactttccctcactcagccttggtttccatcaaccctaaaatggggataattatcgtatctacctcaagattgttttgtcaggagggatccatcaagccttgtgcatgagttccacatggcacagcgtgcacagtaaacactcaatgttaatttttcaacgttccagtggagcttgctaaggaactctgttgggcacaggtgcccagaggattcatggagcagccagtcctggggaatgtgagtgggtagcgagctgcctgctgctggggcaggtgatgtgtcaaagcagcaactgctaggggtttgccttccttccctcatgtgcattctggcaggcaaagggggtttcttcctttcctccttgtcctcctggtgtatagtggggttctgggggatctggagaccaccctttttgttcccaggcagccacggtattgacagtgggccataccatgcagtttaaaatgtatctttgagttgaaattttggtggtttccttattcttttttctctcttcactgtccttccaaactcacttttcttgtgtcccgaccgcattttgtgaatcatccttactccctttaagttctcgctttggatttcaccaggtgggctagatggtgccatttcacttccactgtttgatgcggctggtaatgtttgactcacctgttacgtgttatttcactggtttcttgattttacatctttctcatcagtgacctgggcttgatgaaattagctttcattaagtcctattttttttttaattttgcatccttacctcttttctttctcttgaatgccatcattgtgtggtcttatgtacccttcatccactctgaagtccttgcttgactgattgctttctattagcagaaagaaaacaggtccatcctatgtatctgagaaacaacatcaacaccctctcgtatgtggtttgtattccctgacgcggcggacatttttgcagcagaaatttctccatcactgtccagattctggccctggtgggcaggtctccatgacacctttagtccctttgttcaacattcttaaaccatggacctttttgtttgtttgtggccgggggaggtggtgagaaacgttacttgaagcttgatcattctttcaatttcatttgtttctttatttttaatctgttagatgcaaattgaaatgcaatgctttttgaaaatcagcaatagtgtctgtagtatatgatgctgtcacaaaatctcaataaattgatcctgctgccattccttcc

SEQ ID NO: 7684 - DNA, 3451 bp, Homo sapiens
agctcggtcgcttgtgcgttccgctccggccgccctttgcgcttggatccacttccccatctgtaacgaggtgttgagacgagcggcatggagcaggcctaccagctcttggcctggcgcagtggtagggtcgtgggcagccttgagaagacaaggaagctcgtgctcaggcctgccctggcagtgggagtgactgctgtgctcagcgtggccgggattctgaatgccgcgcagcccccggctgtgaaaactgtggaggtgcccatccatcagctgcctgcctcaatgaacaacctcaagatcgtgctcctctcagacattcacttgggccccacagtgggcaggaccaagatggaaatgtttgtgaggatggtgaatgtgctggaaccagacatcacggtgattgtgggtgacctctccgactcagaagcctcggtcctgcggacggctgtcgctcctctgggccagcttcattcacatctcggtgcctacttcgtcacaggcaatcatgagtactacacgtcagatgtcagcaactggtttgcacttctggaatccctgcatgtccagcctcttcataatgagaacgtgaagatttccgccacacgggcccaacgtggtggtggtggcagtggcagtgggagtgaggatgaggactggatctgcttggctggggtggacgatattgaagcagacatcctgcactactctggccatggcatggatcttgacaaggccctggagggctgcagcccagaccacacaatcatcttgctagctcaccagcccctggctgccaagagagctctccaggctcggccagatattaacctgatcctttctgggcacacacatgctgggcagatcttccccttgaacgtagcagcctatctcctgaatcccttctttgctggtctctaccaggtggcccaggctacattcgtgtatgtcagcccaggcacagcctactacgggatacccatgaggctgggtagcagggccgagatcacagagctcatcctgcagcggtctccctgaactggccctgccctgtgcacctctgccctgcccttgtcctcgaccctccatcctgcttcagagtggtttgcctgcttttcccctccagccttgcccactcatccttgcctacacacccttggtcacaagcctgactcaaacagtgacttatggtgggcctgcctggcatgttcaggctggtttaactatttccttggccagttgctttttttgatgcacttgtgagatcactaaggtcacatatattagcactcccctctattttccagatgatgtggaatggggaccttctcctgcagagctcccagggatgaacctcccctcggggttgctagaaaggcatacctctagaaggtggggcggggaggagcaggagcatttttctcctggtgttttaaaattgtctttaggacttaagtggtttccagaatcattgatccagagcctttctggggaaggggtagtgttgccaggtaatttgggagaacaggcaagatggaagggccctctggctgctagagaagaatattttcttttcctctgattctatcaggatcacctctattgagggcatcagcaaaatctactggaatgcaaagctcctcctgttccaggccttgagggatgctatttaactgtctgtgctcctgggcctttgggggcaaggtcaggggagaagaacggtgggcgccatggtcggtgatggtgagaacatggctgcttaggaattcagagggctttgcctcccttgtctcattttatacaacccttcggggagctcactggggacaggctgcttttccctatttggagataaggaaaccaaggcaaagagagatagggcacaggcagtatgacaagatatgtaggagatttggggctagaaaccaggtcttgtacctcccagtaaaagcggtgcttttgcccttttgccagaagcaatagatcctttgatcctgagatggagataagcacccgtgttagaaaaggcctcactgagaagacagggctgggctggtttcctgctgggtgatttaggcttgtgatggaaagtcttcctccaatggggagtgaagacactcgctctgactggagaggctaaccctgctgctcactcatagggcagcgttgggtgggtgactttccctcactcagccttggtttccatcaaccctaaaatggggataattatcgtatctacctcaagattgttttgtcaggagggatccatcaagccttgtgcatgagttccacatggcacagcgtgcacagtaaacactcaatgttaatttttcaacgttccagtggagcttgctaaggaactctgttgggcacaggtgcccagaggattcatggagcagccagtcctggggaatgtgagtgggtagcgagctgcctgctgctggggcaggtgatgtgtcaaagcagcaactgctaggggtttgccttccttccctcatgtgcattctggcaggcaaagggggtttcttcctttcctccttgtcctcctggtgtatagtggggttctgggggatctggagaccaccctttttgttcccaggcagccacggtattgacagtgggccataccatgcagtttaaaatgtatctttgagttgaaattttggtggtttccttattcttttttctctcttcactgtccttccaaactcacttttcttgtgtcccgaccgcattttgtgaatcatccttactccctttaagttctcgctttggatttcaccaggtgggctagatggtgccatttcacttccactgtttgatgcggctggtaatgtttgactcacctgttacgtgttatttcactggtttcttgattttacatctttctcatcagtgacctgggcttgatgaaattagctttcattaagtcctattttttttttaattttgcatccttacctcttttctttctcttgaatgccatcattgtgtggtcttatgtacccttcatccactctgaagtccttgcttgactgattgctttctattagcagaaagaaaacaggtccatcctatgtatctgagaaacaacatcaacaccctctcgtatgtggtttgtattccctgacgcggcggacatttttgcagcagaaatttctccatcactgtccagattctggccctggtgggcaggtctccatgacacctttagtccctttgttcaacattcttaaaccatggacctttttgtttgtttgtggccgggggaggtggtgagaaacgttacttgaagcttgatcattctttcaatttcatttgtttctttatttttaatctgttagatgcaaattgaaatgcaatgctttttgaaaatcagcaatagtgtctgtagtatatgatgctgtcacaaaatctcaataaattgatcctgctgccattccttccaaat

SEQ ID NO: 7685 - DNA, 1725 bp, Homo sapiens
ggctggacgaaaaagacggtcttgctttcccggtcgccgctgtcgggaagggctgcagggtgtccgcgagacccgcggcccggcgagctgaccccgcctcgcctttcctgcctagccctcattccacggagccggtcgcgcccggtccttgcgcgacgcttcccggcccaggccgcctggtctggcgctggaggccggagtcccgcggcctgtgctggatccgcgcacacccagtggcggcggatgggcggccggggcggccggggcggccggtcctgagcgcggcccgggctgtcagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctgctgtgtagatgccacaaccttcctgtacttcagcttcttcgctccgctcatctacgtggctttcctccggggcttcttcggctcggagcccaagatcctcttctcctacaaatgccaagtggacgagacagaggagccagatgtacacctaccccagccctacgctgtggcccggcgggagggcctggaggctgcaggggctgctggggcctcagctgccagctactcgagcacgcagttcgactctgccggcggggtggcctacctggatgacatcgcttccatgccctgccacactggcagcatcaacagcacagacagcgagcgctggaaggccatcaatgcctgagggcagctgccagggcctgtggaggacaggccagagaggaggccagcaggcccagagtccccaggggaggaggaccaggtcaagggacgttctgtgggcagtagccctgtgtggccctgttcccaccatgagtctggaggccccacctccctggggctcccaatcccctttgccatctctgctctcactggggaccctcctccccttcccacctgctctcatactgctcagtgacatggcccaggctttccttccagggccatgcttggcaaggttggctgagggcaccctccttctctgcacccttggcacgagggcagggctggctctcccaatgcctccatcccatccccatggtgctttggcctcctcaaagcatccaccatggtggatggactgaagtgtgtatattttcttgatctattttttaataaaaaggaaaaggagcagaa

SEQ ID NO: 7686 - DNA, 1933 bp, Homo sapiens
gagtgataacagggactctgggactctgggacttgtgggactgtggccgttttcgcaatttgggctggacgaaaaagacggtcttgctttcccggtcgccgctgtcgggaagggctgcagggtgtccgcgagacccgcggcccggcgagctgaccccgcctcgcctttcctgcctagccctcattccacggagccggtcgcgcccggtccttgcgcgacgcttcccggcccaggccgcctggtctggcgctggaggccggagtcccgcggcctgtgctggatccgcgcacacccagtggcggcggatgggcggccggggcggccggggcggccggtcctgagcgcggcccgggctgtcagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggtctactctctggtggtcatccttcccaagaccccgctgaaggagcgcatctccctgccttctcggaggagcttctacgtgtatgcgggcatcctggcactgctcaacctactgcaggggctggggagtgtgctgctgtgcttcgacatcatcgaggggctctgctgtgtagatgccacaaccttcctgtacttcagcttcttcgctccgctcatctacgtggctttcctccggggcttcttcggctcggagcccaagatcctcttctcctacaaatgccaagtggacgagacagaggagccagatgtacacctaccccagccctacgctgtggcccggcgggagggcctggaggctgcaggggctgctggggcctcagctgccagctactcgagcacgcagttcgactctgccggcggggtggcctacctggatgacatcgcttccatgccctgccacactggcagcatcaacagcacagacagcgagcgctggaaggccatcaatgcctgagggcagctgccagggcctgtggaggacaggccagagaggaggccagcaggcccagagtccccaggggaggaggaccaggtcaagggacgttctgtgggcagtagccctgtgtggccctgttcccaccatgagtctggaggccccacctccctggggctcccaatcccctttgccatctctgctctcactggggaccctcctccccttcccacctgctctcatactgctcagtgacatggcccaggctttccttccagggccatgcttggcaaggttggctgagggcaccctccttctctgcacccttggcacgagggcagggctggctctcccaatgcctccatcccatccccatggtgctttggcctcctcaaagcatccaccatggtggatggactgaagtgtgtatattttcttgatctattttttaataa

SEQ ID NO: 7687 - DNA, 1865 bp, Homo sapiens
gccttgcacatggagatgcttagctgagggggtggctttgttagactatttgcaggtcgtgagatagagcctgagatgggggactgggcccctgcctgggggattgggtcgtgacctgtgtggagccccacactgagctgcagtgggtggggagggtggtttacaggggtgctctgtgcagcccctctgattttcccctgggagtcccaggtccaggggaaggaggacagtggcccaggccacacagctcactgggcggctctcactcccccagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggtctactctctggtggtcatccttcccaagaccccgctgaaggagcgcatctccctgccttctcggaggagcttctacgtgtatgcgggcatcctggcactgctcaacctactgcaggggctggggagtgtgctgctgtgcttcgacatcatcgaggggctctgctgtgtagatgccacaaccttcctgtacttcagcttcttcgctccgctcatctacgtggctttcctccggggcttcttcggctcggagcccaagatcctcttctcctacaaatgccaagtggacgagacagaggagccagatgtacacctaccccagccctacgctgtggcccggcgggagggcctggaggctgcaggggctgctggggcctcagctgccagctactcgagcacgcagttcgactctgccggcggggtggcctacctggatgacatcgcttccatgccctgccacactggcagcatcaacagcacagacagcgagcgctggaaggccatcaatgcctgagggcagctgccagggcctgtggaggacaggccagagaggaggccagcaggcccagagtccccaggggaggaggaccaggtcaagggacgttctgtgggcagtagccctgtgtggccctgttcccaccatgagtctggaggccccacctccctggggctcccaatcccctttgccatctctgctctcactggggaccctcctccccttcccacctgctctcatactgctcagtgacatggcccaggctttccttccagggccatgcttggcaaggttggctgagggcaccctccttctctgcacccttggcacgagggcagggctggctctcccaatgcctccatcccatccccatggtgctttggcctcctcaaagcatccaccatggtggatggactgaagtgtgtatattttcttgatctattttttaataaaaaggaaaaggagcagaa

SEQ ID NO: 7688 - DNA, 713 bp, Homo sapiens
ggagcggaggtagaagctgaggctccaggggacccgacgacacttgctggctgcgtgacctcggtcacaccagggccattttgctgacaagacaacagaggccgggcgcggtggctcacgcctgtaatcccagcactttgggaagccgaggtgggcggatcacaagctcaggagttcgagaccagcctgactaacatgcgagaagtgagtcctgaggtccggcccacactgaaggagaggagatcctagcagggctggggattatcaggagccctcccaaaggccactgaagagagcagtcaagatggtggatggggtcagctggctgcccagaggtcatctgataaggactaggagctgttagtggccctggcgatagcagatctgggctggccggtgtgtctggagtcagacactacattgaagtgtgttgacaggtcagtaggcatccagcgctggggcagctgcttcaggacatcgccgaggacaagtctcctccccattctggttccaccatctgtagcctgtggctttcatcctcaagggctccatgcgaccgctgcacatccagggctggctgctggcgggatggacaccctggaggaggtgacttgggccaatgggagcacagcgctacccccacccctggcaccaaacatcagtgtgcctcatcgctgcctgctgctgctctacgaagacattggcacctccag

SEQ ID NO: 7689 - DNA, 1007 bp, Homo sapiens
gaaaaagacggtcttgctttcccggtcgccgctgtcgggaagggctgcagggtgtccgcgagacccgcggcccggcgagctgaccccgcctcgcctttcctgcctagccctcattccacggagccggtcgcgcccggtccttgcgcgacgcttcccggcccaggccgcctggtctggcgctggaggccggagtcccgcggcctgtgctggatccgcgcacacccagtggcggcggatgggcggccggggcggccggggcggccggtcctgagcgcggcccgggctgtcaggtggagaagccgaggcctggagaggggcacctggcaagttgttgactgggggcctgggctctggagacagacagcctggattgctggcctgggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctg

SEQ ID NO: 7690 - DNA, 1903 bp, Homo sapiens
gcccaggccgggaggtggagcgcggctgccgccagctggtccactgacaactgctgccagctggaaggcgcgtagggcgagaggtggcgcgtcctcagctttccagtcttcgattccgcccgctttccgagtgagaaacgcaggcctctctcttccgtgaagcagcgtcttgtctctgcacctcctctgtgctgtctctttaagagccctcattccacggagccggtcgcgcccggtccttgcgcgacgcttcccggcccaggccgcctggtctggcgctggaggccggagtcccgcggcctgtgctggatccgcgcacacccagtggcggcggatgggcggccggggcggccggggcggccggtcctgagcgcggcccgggctgtcagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggtctactctctggtggtcatccttcccaagaccccgctgaaggagcgcatctccctgccttctcggaggagcttctacgtgtatgcgggcatcctggcactgctcaacctactgcaggggctggggagtgtgctgctgtgcttcgacatcatcgaggggctctgctgtgtagatgccacaaccttcctgtacttcagcttcttcgctccgctcatctacgtggctttcctccggggcttcttcggctcggagcccaagatcctcttctcctacaaatgccaagtggacgagacagaggagccagatgtacacctaccccagccctacgctgtggcccggcgggagggcctggaggctgcaggggctgctggggcctcagctgccagctactcgagcacgcagttcgactctgccggcggggtggcctacctggatgacatcgcttccatgccctgccacactggcagcatcaacagcacagacagcgagcgctggaaggccatcaatgcctgagggcagctgccagggcctgtggaggacaggccagagaggaggccagcaggcccagagtccccaggggaggaggaccaggtcaagggacgttctgtgggcagtagccctgtgtggccctgttcccaccatgagtctggaggccccacctccctggggctcccaatcccctttgccatctctgctctcactggggaccctcctccccttcccacctgctctcatactgctcagtgacatggcccaggctttccttccagggccatgcttggcaaggttggctgagggcaccctccttctctgcacccttggcacgagggcagggctggctctcccaatgcctccatcccatccccatggtgctttggcctcctcaaa

SEQ ID NO: 7691 - DNA, 841 bp, Homo sapiens
ggccgcggcccaggccgggaggtggagcgcggctgccgccagctggtccactgacaactgctgccagctggaaggcgcgtagggcgagaggtggcgcgtcctcagctttccagtcttcgattccgcccgctttccgagtgagaaacgcaggcctctctcttccgtgaagcagcgtcttgtctctgcacctcctctgtgctgtctctttaagagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccaggggaccctggagatcctgtaccctgatgcccatctctcagctgaggactttaatatctatggccatgggggccgccagttctggctggtcagctcctgcttcttcttcctggt

SEQ ID NO: 7692 - DNA, 767 bp, Homo sapiens
cggcccggcgctgtgcgcgtgcgctcgcctgcgctgtggtgggagctggagcggaggtcagtaggcatccagcgctggggcagctgcttcaggacatcgccgaggacaagtctcctccccattctggttccaccatctgtagcctgtggctttcatcctcaagggctccatgcgaccgctgcacatccaggacaggagcaaggagaagaatgggacccaatctcattccagcccagcggtgctgtcgcaagggctggctgctggcgggatggacaccctggaggaggtgacttgggccaatgggagcacagcgctacccccacccctggcaccaaacatcagtgtgcctcatcgctgcctgctgctgctctacgaagacattggcacctccagggtccggtactgggacctcttgctgctcatccccaatgtgctcttcctcatcttcctgctctggaagcttccatctgctcgggcgaagatccgcatcacctccagccccatttttatcaccttctacatcctggtgtttgtggtggcgctggtgggcattgcccgggccgtggtatccatgacggtgagcacctcgaacgctgcaactgttgctgataagatcctgtgggagatcacccgcttcttcctgctggccatcgagctgagtgtgatcatcctgggcctggcctttggccacctggagagtaagtccagcatcaagcgggtgctggccatcaccacagtgctgtccctggcctactctgtcacccagg

SEQ ID NO: 7693 - DNA, 2499 bp, Homo sapiens
ggagcttgcagtgagccgagatcgcgccaccgccctccagcctgggcgacagagcaagactctgtctcaaaaaaaaaaaaaaaaagagcaaattttttttccaaggtgatagggagagtccgtggctgatgtctgcactgaccagacgcccctagggggccagcgagggcgggtcccaggtgcagcggatgcagaggagagaggcccgggcgcggcgcgggggatggtgcgatcccgggcccgagggcatcagacggcggctgattagctccggtttgcatcacccggaccgggggattagctccggtttgcatcacccggaccgggggattagctccggtttgcatcacccggaccgggggccgggcgcgcacgagactcgcagcggaagtggaggcggctccgcgcgcgtccgctgctaggacccgggcagggctggagctgggctgggatcccgagctcggcagcagcgcagcgggccggcccacctgctggtgccctggaggctctgagccccggcggcgcccgggcccacgcggaacgacggggcgagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtgtaccccgtccaggaagccctggccgtgctggagccctatgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgctttgtcttcgctgaccgtgagaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagccccaacccgatcccatctctgggaggctgcccaggtggtccctgatggactggggctggacgaagccagggaagaggagggagacagagaagtggttctgtatggctaggaccaccctactacacgctcagctgccaacagtggattgagtttgggggtagctccaagccttctcctgcctctgaactgagccaaaccttcagtgccttccagaagggagaaaggcagaagcctgtgtggagtgtgctgtgtacacatctgctttgttccacacacatgcagttcctgcttgggtgcttatcaggtgccaagccctgttctcggtgctgggagtacagcagtgagcaaaggagacaatattccctgctcacagagatgacaaactggcatccttgagctgacaacacttttccatgaccataggtcactgtctacactgggtacactttgtaccagtgtcggcctccactgatgctggtgctcaggcacctctgtccaaggacaatccctttcacaaacaaaccagctgcctttgtatcttgtaccttttcagagaaagggaggtatccctgtgccaaaggctccaggcctctcccctgcaactcaggacccaagcccagctcactctgggaactgtgttcccagcatctctgtcctcttgattaagagattctccttccaggcctaagcctgggatttgggccagagataagaatccaaactatgaggctagttcttgtctaactcaagactgttctggaatgagggtccaggcctgtcaaccatggggcttctgacctgagcaccaaggttgagggacaggattaggcagggtctgtcctgtggccacctggaaagtcccaggtgggactcttctggggacacttggggtccacaatcccaggtccatactctaggttttggataccatgagtatgtatgtttacctgtgcctaataaaggagaattatgaaataa

SEQ ID NO: 7694 - DNA, 1533 bp, Homo sapiens
cttacacaccttttcacagaccccgccgtcggggcgcggccaggtcagatcccttttgatccgggcctgggctgagtgctccccccgggcttcaggtgacgcggccccgcggagcgtggggtcgcccgagttgggctggggaagccagggacggaggtgtccggccgtcacccctagaggagggcgtgcgggggtctgttttgcggcacaaagcatgtgcacagccaggtatcatcctgcgtgactcagaacagccttgagatgtaaggagtgtcatcccagcctcgaacctggggagctttctaagactcccaaggatggtacttatgcatcttgctgtgaagaataacaggatgagtgctaataatgaccatttcctgacacctacctggcaacagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtgtaccccgtccaggaagccctggccgtgctggagccctatgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgctttgtcttcgctgaccgtgagaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagccccaacccgatcccatctctgggaggctgcccaggtggtccctgatggactggggctggacgaagccagggaagaggagggagacagagaagtggttctgtatggctaggaccaccctactacacgctcagctgccaacagtggattgagtttgggggtagctccaa

SEQ ID NO: 7695 - DNA, 1070 bp, Homo sapiens
ggaagcctctgggcgtctgcgtgttgccgcgtgttacacgcacgcacgccccttacacaccttttcacagaccccgccgtcggggcgcggccaggtcagatcccttttgatccgggcctgggctgagtgctccccccgggcttcaggtgacgcggccccgcggagcgtggggtcgcccgagttgggctggggaagccagggacggaggtgtccggccgtcacccctagaggagggcgtgcgggggtctgttttgcatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtgtaccccgtccaggaagccctggccgtgctggagccctatgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgctttgtcttcgctgaccgtgagaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaa

SEQ ID NO: 7696 - DNA, 3007 bp, Homo sapiens
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtgtggatggccagggtacctggggactcaggctgctgccagttctgctcaccaccatccgtgcttggcacagaagtagctgcatagaaagagcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 7697 - DNA, 3546 bp, Homo sapiens
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtggtgagtatagacctggcccatgggggcagctgcaccgtgggcgtggtgagcgaggatgtgcagcggaagggggagcttcggctgcggccagaggagggggtgtgggctgtgaggctggcttggggcttcgtctcggctctgggctccttccccacacggctgaccctgaaggagcagccccggcaggtgagggtgtctcttgactatgaggtgggctgggtgaccttcaccaacgctgtcacccgagagcccatctacaccttcactgcctccttcactaggaaggtcattcccttctttgggctctggggccgagggtccagtttctccctgagctcctgagaaggagcagttacctactctcctctaagtacaggactcatatcaacccaagtaccatgtggacttgatccctggctgaatcacctggatgacttggaatagaaatgactgctttagaagatgggatggggccgggtggtaagggatagaagagaggactctcaatctactgatcaagtcctttccccaatgcccagtggatggccagggtacctggggactcaggctgctgccagttctgctcaccaccatccgtgcttggcacagaagtagctgcatagaaagagcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaa

SEQ ID NO: 7698 - DNA, 1522 bp, Homo sapiens
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaatctgcctaatcacctggttatccccacagctcacatttctctagaccctcagacttcccaccccaagctcctcttgtccgaggaccaccagcgagctcagttctcctacaaatggcagaactcaccagacaacccccagcgttttgaccgggccacctgtgttctggcccacactggcatcacaggggggagacacacgtgggtggtgagtatagacctggcccatgggggcagctgcaccgtgggcgtggtgagcgaggatgtgcagcggaagggggagcttcggctgcggccagaggagggggtgtgggctgtgaggctggcttggggcttcgtctcggctctgggctccttccccacacggctgaccctgaaggagcagccccggcaggtgagggtgtctcttgactatgaggtgggctgggtgaccttcaccaacgctgtcacccgagagcccatctacaccttcactgcctccttcactaggaaggtcattcccttctttgggctctggggccgagggtccagtttctccctgagctcctga

SEQ ID NO: 7699 - DNA, 2907 bp, Homo sapiens
gatttatggaaagcacctggtgcgtgttctgccctctgaggaccctgccctttcccaaaaggggtatcttaagaaggaaaatatggctgctctttgccggacagcagagtcccagtaggatttccattttccaaacctggtatcatctcctagttggaagaagtggtaagcccacgaacacaaatgcaggagggagaggtgccaagaagcagcggtacacagcaggcacagagacacgtggtcttcagcagagcctatggggttcagatgattcacataagaatagaagtttcagggctggacctggggaggcagcctgagcctgagccggctgtcctgagcctgagtactctagctgccttgtcgtcatcgcatctggctgccatccagcgccagcacacagtaatgagtggccgagcttcctctgggagggaggaaacagttaaaatcttgcagcagctgcaatcatctaggcgtggttctcttgtctgacttgggctgcacagatcctgggccaagggacagaagaaagacagcctaggagcagagcctcccagatggctgagttggatctaatggctccagggccactgcccagggccactgctcagcccccagcccctctcagcccagactctgggtcacccagcccagattctgggtcagccagcccagtggaagaagaggacgtgggctcctcggagaagcttggcagggagacggaggaacaggacagcgactctgcagagcagggggatcctgctggtgaggggaaagaggtcctgtgtgacttctgccttgatgacaccagaagagtgaaggcagtgaagtcctgtctaacctgcatggtgaattactgtgaagagcacttgcagccgcatcaggtgaacatcaaactgcaaagccacctgctgaccgagccagtgaaggaccacaactggcgatactgccctgcccaccacagcccactgtctgccttctgctgccctgatcagcagtgcatctgccaggactgttgccaggagcacagtggccacaccatagtctccctggatgcagcccgcagggacaaggaggctgaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaagtttgcctgcaaattttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcagaaataactgctgatggtagctggcttttgaaatcctatggggtctctgaatgaaaacattctccagctgctctcttttgctccatatggtgctgttctctatgtgtttgcagtaattcttttttttttttttgagacggagtctcgcactgttgcccaggctggagagcagtggcgcgatcttggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgtatttcct

SEQ ID NO: 7700 - DNA, 3206 bp, Homo sapiens
ctttctctggaggatctccgcgcgtggcgagtctgtgtcctccctgtcccccagagcagacaccctctctgtgtctggaccggggaggagcagacgctggacaggtttctggtagaatgctggcaatttccaggaagatacgtggagaacggaaaggttgctacacccaaatagtgaagcaaaggctatgattatggaggattggacctgcaaactccagaacagagcaaccttgtaaaatgtgtgtgggcagcacagagaacttgggcaagttaacagtttcctcatctgtgaatactgatttatggaaagcacctggtgcgtgttctgccctctgaggaccctgccctttcccaaaaggggtatcttaagaaggaaaatatggctgctctttgccggacagcagagtcccagtaggatttccattttccaaacctggtatcatctcctagttggaagaagtggtaagcccacgaacacaaatgcaggagggagaggtgccaagaagcagcggtacacagcaggcacagagacacgtggtcttcagcagagcctatggggttcagatgattcacataagaatagaagtttcagggctggacctggggaggcagcctgagcctgagccggctgtcctgagcctgagtactctagctgccttgtcgtcatcgcatctggctgccatccagcgccagcacacagtaatgagtggccgagcttcctctgggagggaggaaacagttaaaatcttgcagcagctgcaatcatctaggcgtggttctcttgtctgacttgggctgcacagatcctgggccaagggacagaagaaagacagcctaggagcagagcctcccagatggctgagttggatctaatggctccagggccactgcccagggccactgctcagcccccagcccctctcagcccagactctgggtcacccagcccagattctgggtcagccagcccagtggaagaagaggacgtgggctcctcggagaagcttggcagggagacggaggaacaggacagcgactctgcagagcagggggatcctgctggtgaggggaaagaggtcctgtgtgacttctgccttgatgacaccagaagagtgaaggcagtgaagtcctgtctaacctgcatggtgaattactgtgaagagcacttgcagccgcatcaggtgaacatcaaactgcaaagccacctgctgaccgagccagtgaaggaccacaactggcgatactgccctgcccaccacagcccactgtctgccttctgctgccctgatcagcagtgcatctgccaggactgttgccaggagcacagtggccacaccatagtctccctggatgcagcccgcagggacaaggaggctgaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaagtttgcctgcaaattttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcagaaataactgctgatggtagctggcttttgaaatcctatggggtctctgaatgaaaacattctccagctgctctcttttgctccatatggtgctgttctctatgtgtttgcagtaattcttttttttttttttgagacggagtctcgcactgttgcccaggctggagagcagtggcgcgatcttggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgtatttcct

SEQ ID NO: 7701 - DNA, 3374 bp, Homo sapiens
cggtcttgcgcgctcaggccgggcaacgtccgtgcgttctttttgggtcctgaaccccggaagagaaactgcgttgtacccttttacgtgaggcggtgacggcggttcggaagtcgtctggcctccccgcggccgctcgcagcttgctggcctctcccgcgcctcacgtcggactccgtctccgcggcagggaagcagcatggaagctgaggacatccaggaggagttgacctgccccatctgcctggactatttccaggacccggtgtccatcgagtgcggccacaacttctgccgcggctgcctgcaccgcaactgggcgccgggcggcggcccgttcccctgccccgaatgtcggcacccatcggcgcccgccgcgctgcgacccaactgggccctggccaggctgactgagaagacgcagcgccggcgcctgggccccgtgcccccgggcctgtgcggccgccactgggagccgctgcggctcttctgcgaggacgaccagcggccagtgtgcctggtgtgcagggagtcccaggagcaccagactcacgccatggcacccatcgacgaggccttcgagagctaccgggagaaacttcttaagtctcagcgtaatctcgtggccaagatgaagaaagtcatgcatttacaggatgtagaagtgaagaacgccacacagtggaaggataagataaagagtcagcgaatgagaatcagcacggagttttcaaagctgcacaacttcctggttgaagaagaggacctgtttcttcagagattgaacaaagaagaagaagagacgaagaagaagctgaatgagaacacgttaaaactcaatcaaactatcgcttcattgaagaagctcatcttagaggtgggggagaagagccaggctcccaccctggagctgcttcagaatccaaaagaagtgttgaccaggagtgagatccaggatgtgaactattctcttgaagctgtaaaggtgaagacagtgtgccagataccattgatgaaggaaatgctaaagcgattccaagtggctgtaaacctagctgaagacacagctcatcccaaactcgtcttctcccaggaagggagatacgtgaaaaatacagcatcagccagttcttggccagtgttttcttcagcatggaactactttgctggatggaggaatcctcagaagactgcttttgtagagagatttcagcacttaccctgtgttctgggaaaaaacgttttcacctcagggaaacattactgggaagttgagagtagagatagtctggaggttgctgttggggtgtgtcgggaggacgtcatgggaattactgatcgttcaaaaatgtccccagatgtgggcatctgggcgatttattggagtgctgctggctattggcccttgataggcttccctggaactcccacccagcaagagccagctctccaccgagtgggggtttacctggatcgtgggactgggaatgtctccttctacagcgctgtggacggagtgcacctgcacaccttttcttgttcttctgtctcacgcctccggccatttttttggttgagtccattagcatctttagtcattccaccagtgactgataggaaatgaggcttttcttcccctgaccaaaactccttccctgtagtccagctgagggacacacatccctgggccctcttctgcccttcatgtctctatcctggatggtccatcttctgggtctccctaacggtaccgtttggtatctgccctttgtgtgcttcacaagaggcagtcccatgggaggtgggtctggccaatggagatgggacaggaaattttccaagacgcttttgggaaatctttttgtagcttttaaagagatgtgcggggaagacatatggatgttagcagccatattggaactgagaacacaggaatggtggaaaggtagaagaaacagagtttttgttgccgttgtgaaattgttgaaatttccttcatgccaagcttcttgttatatgagataattacgcccttattgtataagacaattttagttgtatttggttacttgcagcctgaagtaccgtaactgcactaaagggacgtagtgtgaacatcccgcagtataggcttaagtcacttttgtgaaatttgacaaaggcatagaatctttttctatccagtcaggcattgcctattctttccagtaactactgattcccccacttttctgtcttagaaaattgtgggaatcccccctcactctgcctatgttgcactctctctcttcccaaccataactctgccctcagctattaactgtgctgtgtatttatcaagttggtatgttgtatgtacagtgttattcatgtcatcatgagaatgttgaacgcttgttaaatatcttttgctagcctcttcatatgctgttgcatatgactctcatcacaactcagtgagatggaaagtcaaatcctatttgtacaaatgagaaaactgaactctttagagtaactagctcagtattggccagctggtaaatggcagtgttgggattaaaatccagttcttatctactctccctttattcagaagcatttattggatgttgatctttgtttcaggttttgattttgttacttttttatactgtgtatattttcctcagtctacccttctgctctagattgtctggactcaggagattgtggcagttactggatagttatttttaagataatgattgcttttctctgtttatataagtcatgtgtacttattgtagaaagtttgtaagatgcaaaaagtataaaaattaaagttatgcactactaacatttcaatatattttctcccagattttcagtaaagactttcaggcagtgatttaacgaggattttattttaacttatattttagtttaaggggaacacgtgcaggtttgttctatagatcaattacatgtcacaggggtttggtgtacatattatttcattacccaggtaataagcatagtacccaatagatacttttttgataccccaccctcctccaccctctaccctcaagtagtccctggtgtctgttgttcccttttttgtgtccatgggtactcaatgtttagctctcccttatacgtgagaacatgtgatgtttggttttctgttcatgtgttggtttgcttagggtaatggcctccagctccatccatgttgctgcaaagacatgatctcattctttttttatggctgcatagtattccatggtgtatatgtactatgttttctttatccagtctactgttgatgggcatttaggttgattccatgtctttgctattgtgaatagtgctgcaatgaatatatacatgca

SEQ ID NO: 7702 - DNA, 1942 bp, Homo sapiens
cggaagtcgtctggcctccccgcggccgctcgcagcttgctggcctctcccgcgcctcacgtcggactccgtctccgcggcagggaagcagcatggaagctgaggacatccaggaggagttgacctgccccatctgcctggactatttccaggacccggtgtccatcgagtgcggccacaacttctgccgcggctgcctgcaccgcaactgggcgccgggcggcggcccgttcccctgccccgaatgtcggcacccatcggcgcccgccgcgctgcgacccaactgggccctggccaggctgactgagaagacgcagcgccggcgcctgggccccgtgcccccgggcctgtgcggccgccactgggagccgctgcggctcttctgcgaggacgaccagcggccagtgtgcctggtgtgcagggagtcccaggagcaccagactcacgccatggcacccatcgacgaggccttcgagagctaccgggagaaacttcttaagtctcagcgtaatctcgtggccaagatgaagaaagtcatgcatttacaggatgtagaagtgaagaacgccacacagtggaaggataagataaagagtcagcgaatgagaatcagcacggagttttcaaagctgcacaacttcctggttgaagaagaggacctgtttcttcagagattgaacaaagaagaagaagagacgaagaagaagctgaatgagaacacgttaaaactcaatcaaactatcgcttcattgaagaagctcatcttagaggtgggggagaagagccaggctcccaccctggagctgcttcagaatccaaaagaagtgttgaccaggagtgagatccaggatgtgaactattctcttgaagctgtaaaggtgaagacagtgtgccagataccattgatgaaggaaatgctaaagcgattccaagcaactaaaataaaaacacaaaaacaaaacaggcacaatatgtgaaacaaccgttttcaaagcaccagacgtcaggcagtgaaggacggtgattcctgagaaatgtgaaacaaatgaggtcagcctatgattgccctaccctctgcctgagggagtttccagaccatgtaaggctgaggtaactgaggtagagccagggagacttgctgagttgaggaatagacctgggagttcacggagaacaaagtagtgagagttcgcaaagtactgggcagtatcctggagcggagagagccggacacagagagaaccctcgccatctatggaggagcttcctagttgtttggcagagttctgatcagcacatgcctgtgaaaatctactcaaggctggagatagaagcttctaaaacgattagagggaacggttcctggtgctcacacagggccaggaacagtgccagttcctatcagccacaccagaaaactcgtagttcacgggcactgagtagcgtactcaggaaaatcttgcctcattagcagaaaatatttagcccttgactgggtgctgctccacacccaccttacaaatcatgaaagcaagacccaaaggggtcaaactctttccaactaacttaactgcatcccaggataaagccctagaaaattggtagaaataaacaaaaaaagagcacctaacaatataaattcacaatgtctggcatccagtcaaatatgcatgcaaaaagataggaaagcagtgacccataatggaggaaaataatcaactgaaactgacctagaattgacacagatgttagaataagcatggaaggactttaaaacatttattatgagtgtattctgtaaagaggtacatagagaccagatcaaagttttaaagatgaaaaatgtgattaaggcgaagaatgcactggatgggattaatagttgattaaatattacaaaagaaaaaattggtgaacttgaagacagagcaatggaaactac

SEQ ID NO: 7703 - DNA, 3383 bp, Homo sapiens
tgcgttgtacccttttacgtgaggcggtgacggcggttcggaagtcgtctggcctccccgcggccgctcgcagcttgctggcctctcccgcgcctcacgtcggactccgtctccgcggcagggaagcagcatggaagctgaggacatccaggaggagttgacctgccccatctgcctggactatttccaggacccggtgtccatcgagtgcggccacaacttctgccgcggctgcctgcaccgcaactgggcgccgggcggcggcccgttcccctgccccgaatgtcggcacccatcggcgcccgccgcgctgcgacccaactgggccctggccaggctgactgagaagacgcagcgccggcgcctgggccccgtgcccccgggcctgtgcggccgccactgggagccgctgcggctcttctgcgaggacgaccagcggccagtgtgcctggtgtgcagggagtcccaggagcaccagactcacgccatggcacccatcgacgaggccttcgagagctaccggacaggtaactttgacatccacgtggatgaatggaagagaagactaattaggctgctcttgtaccattttaagcaggaggagaaacttcttaagtctcagcgtaatctcgtggccaagatgaagaaagtcatgcatttacaggatgtagaagtgaagaacgccacacagtggaaggataagataaagagtcagcgaatgagaatcagcacggagttttcaaagctgcacaacttcctggttgaagaagaggacctgtttcttcagagattgaacaaagaagaagaagagacgaagaagaagctgaatgagaacacgttaaaactcaatcaaactatcgcttcattgaagaagctcatcttagaggtgggggagaagagccaggctcccaccctggagctgcttcagaatccaaaagaagtgttgaccaggagtgagatccaggatgtgaactattctcttgaagctgtaaaggtgaagacagtgtgccagataccattgatgaaggaaatgctaaagcgattccaagtggctgtaaacctagctgaagacacagctcatcccaaactcgtcttctcccaggaagggagatacgtgaaaaatacagcatcagccagttcttggccagtgttttcttcagcatggaactactttgctggatggaggaatcctcagaagactgcttttgtagagagatttcagcacttaccctgtgttctgggaaaaaacgttttcacctcagggaaacattactgggaagttgagagtagagatagtctggaggttgctgttggggtgtgtcgggaggacgtcatgggaattactgatcgttcaaaaatgtccccagatgtgggcatctgggcgatttattggagtgctgctggctattggcccttgataggcttccctggaactcccacccagcaagagccagctctccaccgagtgggggtttacctggatcgtgggactgggaatgtctccttctacagcgctgtggacggagtgcacctgcacaccttttcttgttcttctgtctcacgcctccggccatttttttggttgagtccattagcatctttagtcattccaccagtgactgataggaaatgaggcttttcttcccctgaccaaaactccttccctgtagtccagctgagggacacacatccctgggccctcttctgcccttcatgtctctatcctggatggtccatcttctgggtctccctaacggtaccgtttggtatctgccctttgtgtgcttcacaagaggcagtcccatgggaggtgggtctggccaatggagatgggacaggaaattttccaagacgcttttgggaaatctttttgtagcttttaaagagatgtgcggggaagacatatggatgttagcagccatattggaactgagaacacaggaatggtggaaaggtagaagaaacagagtttttgttgccgttgtgaaattgttgaaatttccttcatgccaagcttcttgttatatgagataattacgcccttattgtataagacaattttagttgtatttggttacttgcagcctgaagtaccgtaactgcactaaagggacgtagtgtgaacatcccgcagtataggcttaagtcacttttgtgaaatttgacaaaggcatagaatctttttctatccagtcaggcattgcctattctttccagtaactactgattcccccacttttctgtcttagaaaattgtgggaatcccccctcactctgcctatgttgcactctctctcttcccaaccataactctgccctcagctattaactgtgctgtgtatttatcaagttggtatgttgtatgtacagtgttattcatgtcatcatgagaatgttgaacgcttgttaaatatcttttgctagcctcttcatatgctgttgcatatgactctcatcacaactcagtgagatggaaagtcaaatcctatttgtacaaatgagaaaactgaactctttagagtaactagctcagtattggccagctggtaaatggcagtgttgggattaaaatccagttcttatctactctccctttattcagaagcatttattggatgttgatctttgtttcaggttttgattttgttacttttttatactgtgtatattttcctcagtctacccttctgctctagattgtctggactcaggagattgtggcagttactggatagttatttttaagataatgattgcttttctctgtttatataagtcatgtgtacttattgtagaaagtttgtaagatgcaaaaagtataaaaattaaagttatgcactactaacatttcaatatattttctcccagattttcagtaaagactttcaggcagtgatttaacgaggattttattttaacttatattttagtttaaggggaacacgtgcaggtttgttctatagatcaattacatgtcacaggggtttggtgtacatattatttcattacccaggtaataagcatagtacccaatagatacttttttgataccccaccctcctccaccctctaccctcaagtagtccctggtgtctgttgttcccttttttgtgtccatgggtactcaatgtttagctctcccttatacgtgagaacatgtgatgtttggttttctgttcatgtgttggtttgcttagggtaatggcctccagctccatccatgttgctgcaaagacatgatctcattctttttttatggctgcatagtattccatggtgtatatgtactatgttttctttatccagtctactgttgatgggcatttaggttgattccatgtctttgctattgtgaatagtgctgcaatgaatatatacatgca

SEQ ID NO: 7704 - DNA, 2013 bp, Homo sapiens
ccttttacgtgaggcggtgacggcggttcggaagtcgtctggcctccccgcggccgctcgcagcttgctggcctctcccgcgcctcacgtcggactccgtctccgcggcagggaagcagcatggaagctgaggacatccaggaggagttgacctgccccatctgcctggactatttccaggacccggtgtccatcgagtgcggccacaactgggagccgctgcggctcttctgcgaggacgaccagcggccagtgtgcctggtgtgcagggagtcccaggagcaccagactcacgccatggcacccatcgacgaggccttcgagagctaccggatccttttagcttttagcttgaagaccttccctgatcatcctttccagagtagccccaccccctcccattactgatggtgtaactccagtggtctccagcagaattgatatgcagagaaacttcttaagtctcagcgtaatctcgtggccaagatgaagaaagtcatgcatttacaggatgtagaagtgaagaacgccacacagtggaaggataagataaagagtcagcgaatgagaatcagcacggagttttcaaagctgcacaacttcctggttgaagaagaggacctgtttcttcagagattgaacaaagaagaagaagagacgaagaagaagctgaatgagaacacgttaaaactcaatcaaactatcgcttcattgaagaagctcatcttagaggtgggggagaagagccaggctcccaccctggagctgcttcagaatccaaaagaagtgttgaccaggagtgagatccaggatgtgaactattctcttgaagctgtaaaggtgaagacagtgtgccagataccattgatgaaggaaatgctaaagcgattccaagtggctgtaaacctagctgaagacacagctcatcccaaactcgtcttctcccaggaagggagatacgtgaaaaatacagcatcagccagttcttggccagtgttttcttcagcatggaactactttgctggatggaggaatcctcagaagactgcttttgtagagagatttcagcacttaccctgtgttctgggaaaaaacgttttcacctcagggaaacattactgggaagttgagagtagagatagtctggaggttgctgttggggtgtgtcgggaggacgtcatgggaattactgatcgttcaaaaatgtccccagatgtgggcatctgggcgatttattggagtgctgctggctattggcccttgataggcttccctggaactcccacccagcaagagccagctctccaccgagtgggggtttacctggatcgtgggactgggaatgtctccttctacagcgctgtggacggagtgcacctgcacaccttttcttgttcttctgtctcacgcctccggccatttttttggttgagtccattagcatctttagtcattccaccagtgactgataggaaatgaggcttttcttcccctgaccaaaactccttccctgtagtccagctgagggacacacatccctgggccctcttctgcccttcatgtctctatcctggatggtccatcttctgggtctccctaacggtaccgtttggtatctgccctttgtgtgcttcacaagaggcagtcccatgggaggtgggtctggccaatggagatgggacaggaaattttccaagacgcttttgggaaatctttttgtagcttttaaagagatgtgcggggaagacatatggatgttagcagccatattggaactgagaacacaggaatggtggaaaggtagaagaaacagagtttttgttgccgttgtgaaattgttgaaatttccttcatgccaagcttcttgttatatgagataattacgcccttattgtataagacaattttagttgtatttggttacttgcagcctgaagtaccgtaactgcactaaagggacgtagtgtgaacatcccgcagtataggcttaagtcacttttgtgaaatttgaca

SEQ ID NO: 7705 - DNA, 3867 bp, Homo sapiens
agcccttcggggcagaggagggcggggactcggggcggctctcagcatccgcctggagctcgtggcgctgtgtttccgtgctgtggagttgcctggtccgcttcctccccgcgaataagaataaaagattctggaggagttggagaagagtgtattcagcccccaaaccacgagatcaacaaagaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaattagtttgtggtcattgccttaccataggtcaacatcatggtcatcctatagatgaccttcaaagtgcctatttgaaagaaaaggacactcctcaaaaactgcttgaacagttgactgacacacactggacagatcttacccatcttattgaaaagctgaaagaacaaaaatctcattctgagaaaatgatccaaggcgataaggaagctgttctccagtattttaaggagcttaatgatacattagaacagaaaaaaaaaagtttcctaacggctctctgtgatgttggcaatctaattaatcaagaatatactccacaaattgaaagaatgaaggaaatacgagagcagcagcttgaattaatggcactgacaatatctttacaagaagagtctccacttaaatttcttgaaaaagttgatgatgtacgccagcatgtacagatcttgaaacaaagaccacttcctgaggttcaacccgttgaaatttatcctcgagtaagcaaaatattgaaagaagaatggagcagaacagaaattggacaaattaagaacgttctcattcccaaaatgaaaatttctccaaaaaggatgtcatgttcctggcctggtaaggatgaaaaggaagttgaatttttaaaaattttaaacattgttgtagttacattaatttcagtaatactgatgtcgatactctttttcaaccaacacatcataacctttttaagtgaaatcactttaatatggttttctgaagcctctctatctgtttaccaaagtttatctaacagtctgcataaggtaaagaatatactgtgtcacattttctatttgttgaaggaatttgtgtggaaaatagtttcccattgaaaatgtcaacctgaattgtttaaatgggcttattctgtacattgctaaacaaaaaatggggtagcatggataaagagcaaactaagctttattagtgctgcaactaatataaacaaatgtttatatttgttgcttcttttggttagcaatgatatgtcaaagttatatctgaaatagtcaaatctttgggaaacagaatctagtaacaatttgaaaagtaatacactatcccatttttattggctttatgatggttgacataatgttgctgtgacatttaaacattcttgtaccaatattgtcttttaccattattatatactgcagttaattggctttacagttctttatatatatagcaaaatcctgaaagaacatatacctttattttgatgtggcttgaagcttttgaatgggtgaataaggatgatagaaaggtttcaaaatcaagcaacaaagtcttaaagtgataaggcatggcttaaagatcttttgatcaaacatacctgtgtttgagatagatttaagagccctaaatgcttatcaccattcactccaaataaaactattgcttttggataactgttagagtaaagtggctttttaaaagaaatttttgagactgggtctcaccttgttgcccaggctggagtgtagttgtctggtcatgactcactgcagtttcgaccacccaggctcaatcgatcctcccgcctctgcctctggagcagctgggacaaggcacacacccccatgcctggctaattaaaaaaattgttttttgtagaaacgaggttttgccatattgcccaggttggtctcaaacttctgggctcaagagatctgcccaccttggcctcccaaagtgctgggattacagacgttagccacactgtgcctgggggccagcattttctaatacttgtcatattctatagtttgtgcaaatttaagattgtttttttttctgctcgtcagtcaaatcagttcttggattaaaaactcattcttattagaacagaatcatgttggtaacttggtctgcaacaggttttgatggcatcatgtggactttattcatcttaactcatttaaattttctaccacattcccttaagctaatgcaaaagtaccaacaacttaatcttttttttttttttttttttttttttttgagacggagtcttgctctgtcgcccaggctggagtgcagtggcgtgatctcggctcattgcaagccccgcctcccgggttcacaccattctcctgcctcagcctcccgagtagctgggactacaggcatctgctaccacgcccagctaattttctgtatttttagtagagatggggtttcactgtgttagccaggatggtctctatctcctgacctcatgatccactcgcctcagcctcccaaaatgctgggattataggcgtgagccgccacgcccggcccaacaacttaatcttttattagctttgcttaagagggccaattaaatcaaagccctttagttccctttaacagggactggagttatgatgcatgtgttacgacttttggcccactgtccatgcaactctaagtgcaggttgatttgctttccagaaatcccaaaggggctgctcttggatcaccgaagagccttacctatatcaaatcaaaaagacattctgggtcagattagactatgctcctggccctacagattgcacataaactatcataaatacagctttttcagggaactagttctaaaactcttacctgctgagaataagtcttaacactaagatgactgtattatatcaatttattattagaatcagacttatacctagcacaattaactattgtgtgggcaaagaacatttaaagggcatagtagaggtaaggagagacacatactcagctagagataaaaatactaagttgcactgattacttaaaatactagtcacaccataaaagtgccctgtagtttcaaaaacacgtaagcaatgaaatgttagccattatgtgttaaactacttaatctcatttctgtgatgtgaatatttttaaccccctttttgtagatgagggaactgacaagtgacttgtccaaggccatatagctgtgagaaaacccatgcattctcttttcagagttcatgctatcactcaactttaaagtaggccaagattaatgttggtaagggtttgtaatctgtaagaatgctaaaaacgtaagtatatatatcattttagatttgacattttgtatcttgccagtttttaggagaacttttcattttgttaagtatgcatgaatatagttgagtatatgagtaactggttcttatgctgctgttttgtatttttaccagcaggaagattgcaaaagttgatgtatgtaaatcttgaaatatttctaagttttatgtataacaaaatatgtattttaataaacttcttttgatatttta

SEQ ID NO: 7706 - DNA, 576 bp, Homo sapiens
gcgctgtgtttccgtgctgtggagttgcctggtccgcttcctccccgcgaataagaataaaagattctggaggagttggagaagagtgtattcagcccccaaaccacgagatcaacaaattaggtccacaaagatgtgagccccagtttgggtggtggcaccacttgaattttcccatacttaaagctgactcactagaagtcttgggacaagtcatcgaattctataatgaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaat

SEQ ID NO: 7707 - DNA, 548 bp, Homo sapiens
gctgtgtttccgtgctgtggagttgcctggtccgcttcctccccgcggtgagtctaaggacctttacggatgcggagaaggaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaattagtttgtggtcattgccttaccataggtcaacatcatggtcatcctatagatgaccttcaaagtgcctatttgaaagaaaaggacactcctcaaaaactgcttgaacagttgactgacaca

SEQ ID NO: 7708 - DNA, 860 bp, Homo sapiens
ctccccgcggtgagtctaaggacctttacggatgcggagaaggtggttctgagtcctttttcttttcctgtagcacagtctggtgtgcctagtgtgttgggcggggagtcctgggggcgcgacgatggagggagtggcttgggacctgcactcattccctcttgtcccatactggagtttggggagccactttcccgtccctccactgtggagctgcgttcctgtgagggaggaggccctctgtggtggcgaggaataagaataaaagattctggaggagttggagaagagtgtattcagcccccaaaccacgagatcaacaaagaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaattagtttgtggtcattgccttaccataggtcaacatcatggtcatcctatagatgaccttcaaagtgcctatttgaaagaaaaggacactcctcaaaaactgcttgaacagttgactgacacacactggacagatcttacccatcttattgaaaagctgaaagaacaaaaatctcattctgagaaaatgat

SEQ ID NO: 7709 - DNA, 577 bp, Homo sapiens
gggggcgcgacgatggagggagtggcttgggacctgcactcattccctcttgtcccatactggagtttggggagccactttcccgtccctccactgtggagctgcgttcctgtgagggaggaggccctctgtggtggcgagggtgagctgagcggacgccgccgagtcgaataagaataaaagattctggaggagttggagaagagtgtattcagcccccaaaccacgagatcaacaaagaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattaga

SEQ ID NO: 7710 - DNA, 4615 bp, Homo sapiens
aactgtgttggtgtttgtggcttttctgaaaacacgatgaagcatcgtgaagataaatatcaaagacagtgaactaacaaccatttttatgacatgagacaataaattgaaaacattaaagataacattattttaattttagaataagaataaaagattctggaggagttggagaagagtgtattcagcccccaaaccacgagatcaacaaagaaatgcacaattttgaggaagagttaacttgtcccatatgttatagtatttttgaagatcctcgtgtactgccatgctctcatacattttgtagaaattgtttggaaaacattcttcaggcatctggtaacttttatatatggagacctttacgaattccactcaagtgccctaattgcagaagtattactgaaattgctccaactggcattgaatctttacctgttaattttgcactaagggctattattgaaaagtaccagcaagaagaccatccagatattgtcacctgccctgaacattacaggcaaccattaaatgtttactgtctattagataaaaaattagtttgtggtcattgccttaccataggtcaacatcatggtcatcctatagatgaccttcaaagtgcctatttgaaagaaaaggacactcctcaaaaactgcttgaacagttgactgacacacactggacagatcttacccatcttattgaaaagctgaaagaacaaaaatctcattctgagaaaatgatccaaggcgataaggaagctgttctccagtattttaaggagcttaatgatacattagaacagaaaaaaaaaagtttcctaacggctctctgtgatgttggcaatctaattaatcaagaatatactccacaaattgaaagaatgaaggaaatacgagagcagcagcttgaattaatggcactgacaatatctttacaagaagagtctccacttaaatttcttgaaaaagttgatgatgtacgccagcatgtacagatcttgaaacaaagaccacttcctgaggttcaacccgttgaaatttatcctcgagtaagcaaaatattgaaagaagaatggagcagaacagaaattggacaaattaagaacgttctcattcccaaaatgaaaatttctccaaaaaggatgtcatgttcctggcctgatgagggaactgacaagtgacttgtccaaggccatatagctgtgagaaaacccatgcattctcttttcagagttcatgctatcactcaactttaaagtaggccaagattaatgttggtaagggtttgtaatctgtaagaatgctaaaaacgtaagtatatatatcattttagatttgacattttgtatcttgccagtttttaggagaacttttcattttgttaagtatgcatgaatatagttgagtatatgagtaactggttcttatgctgctgttttgtatttttaccagcaggaagattgcaaaagttgatgtatgtaaatcttgaaatatttctaagttttatgtataacaaaatatgtattttaataaacttcttttgatattttatttgcactgtcttaatgagacttccatactcaggagtggtagctatgggattttcacatgggttctgggtacttctaattctttgaaacttagtactgcaggctgggtgcagtggctcatgcctatagtccagcactttgggaggctgaggcaggcagatcacttgaggccaggagtttgagaccagcttggccaacatggcaaaaccctgtctaccaaaaacacaaaaattagctgggcactgtggtgtgcacctgtagtcccagctactcatgtggctgaggcacttgaatcgcttgaacccgtgaggcagggttgcagtgagccaagatcttgccacagcactccaccctgggtgatgcagtgagactttcaaaaaaaaaaaaaaaatctgagctctactgcattggttattaaaatataataaaagtattaaattctattttcgcaccaaatgaaaacacttgattatcattatagcactttaaacttacttttcccttatatattcttgatttagaacaaattaccgtacttgaatttccgatcttgctttctttaaatctttatttaaaagtccatgctaataatgtgtttacatttttacagttacattatgatagaaactgttggattttttaaatatctaaaacaatggcccactgaagaaaggaacaattaactctttaattaattccttaggataaatacccagaaatttaacagctagggcagacttctaatacaataccgaaagtccttccaaaaaccaagtggttgccaacttatgtcccttagcattataacattcttgagccaatagtgtaaaaatacgctgacaattttataggcaaacattactcaaggtatcttactttccacttattactaaagtaattaacccctaaatagatgctcctcaacagtgggactacatcctggtaaacctatcataagttgaaactatcaagttgaaatgcatttagtacccggataaacctatcataaagttgaaaatttgtaaattgaaccagtgtaaatcagaggccatcttacttcatactcatgaagcaactatagtgggatatttttcaacttacgagatagcctaggcttgttgaaacactgtcctaatttactggctctctggtaattaagtcataaatggtcaaacatcaaattctagaaaagcatatatttaaattctcatcactataattcagaatgactggtttacaaaaatatgttcatagtatttgggtaataactgtggtgattgtctcaactggcaagctaagtggaatgccttaaagaatctatccaagattagttggcaggcatttccagtgttggtaaatcaaaggcccacgaaggtatgctgagccttgatagcacaaccttgcttaggactttgcctcaactaacatactttttagtttggcaagttacctgaccctccaggtaactcatttttctccatagtctgctacttacaagattgtcatatttttgtaatctagaagcaattatagagaatattttattagactttacaaatgacaactgcataaaacagaaaccagtttcatgatctagtttagggagtatgtattttatacaactcataatcctttacaaatagaaaaaaatcagtaatacactgaatcaacttgaagaatcttcagcataaagttcaacaaagtcccttagatgcaatttcttttggatttacagcaacactttttgttatgttgtatgtcttgtaaattccaataagtctatccgaaatctcaaacatattatttcgaagagaaattattatgaactgtgcattttttgtttgttcctaaagagaaacaaagaaaagtcaaacattaagtaataacaggtaaatcacacaaacatgtaacctcaaatattttttggacaataaacattacattgataacatgtaaaggaatgatggcaggaataattcataaaacagtatttgagtgtgaaaggaatttggttattttgacttctagtggaaaagatctaggaagatgacctaggattctagctgtgattctgctactaatttgcatttttaatttatattttactcctccaaaatggaaatatttggttcaaataaaaaataatttggtctccactgataccagaggagatggagatggagttattagacaataaagaaaaagctcaattgtaagaaataaagaattccatgtgtaatgtttaggatacccctaaaagtttctggaatgaaaatcccaaaatgattacttacatatatataaaatgcaacaatggacacatttttaaaatcaagggctgcatcaatctcatccatgaagtaaaggggagtgggcttgtagtggtgaagagcaaatactaaagccaatgaactaagtgttttctctcctcccgaaaggttgaagatctttttccaacttttcttaggtggtcgaacactgaaatgattaagaaaatcatagtcaaattacctgtaaagctaaagttaagactttgtgatttgctttccataattgagttctactatcttttttaggaatctgtaacttgcttttcacaaatatgaattctcttttctgttattttataaaaacgttattggaggatgcatacataggagcacataccaaagttttaagatttaaagagcaagctaagtattatacttcttgctattctttctccttatcaaatacaatttctcaatcctcatgttaaaaatgccttgaaaatttaagaaaagatgaactagacaaatattttgtaaatactggctgtctgcccctgtaaactgcaagcataaatagcatgcaagcaaattagtatttactagtaaatgaaacaagttgtacatcttgccttcacatcctacctccaagaaatactgagtttggagaatatgtagaaaaaggtaacagtgggattataaactcagcataattacacacctgaacatgattccttcagagaaaggatccaagctgtctacaagctcgagttcggcgtcccctcccaaagt

SEQ ID NO: 7711 - DNA, 3421 bp, Homo sapiens
aggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcagaaaactccctactatgccaaactgtccgcggggcggggaatggaggaggcaggcggggctggagacgggacccgacggtgactgcgcaaggtcgtgtacggcccagcgtgggcctgtgccctaactcctcccactcccttactttctgtccttcccgggccctgcagaccggccaagtttagtggtagcctttcctagtgtctcctctttgttaacccttcctacagacacagtgggcagaacttgcctaaagaagaagggaatggaagggctagtggagtcttgttggggagacaaggacctgactgcctgtgggctgcattcgggacacgacacagcagtcaacccatttgcttgtttggtttagcaaggaatagtgtctggagccggtccagctgaaggaagggtgagcagagagtgcaagcaggacccttgtcggtgggtgaacattttgctccaaaagggatccttggccctgcgcaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggctggctgatgttgtgacaccactctggaggttgagctatgaagaacagctcaagcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatagagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgagctgaaattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgt

SEQ ID NO: 7712 - DNA, 2291 bp, Homo sapiens
aggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcagaaaactccctactatgccaaactgtccgcggggcggggaatggaggaggcaggcggggctggagacgggacccgacggtgactgcgcaaggtcgtgtacggcccagcgtgggcctgtgccctaactcctcccactcccttactttctgtccttcccgggccctgcagaccggccaagtttagtggtagcctttcctagtgtctcctctttgttaacccttcctacagacacagtgggcagaacttgcctaaagaagaagggaatggaagggctagtggagtcttgttggggagacaaggacctgactgcctgtgggctgcattcgggacacgacacagcagtcaacccatttgcttgtttggtttagcaaggaatagtgtctggagccggtccagctgaaggaagggtgagcagagagtgcaagcaggacccttgtcggtgggtgaacattttgctccaaaagggatccttggccctgcgcaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgaacggagtctcatcttgctggagtgcagtggcatggtctcggctcactacagcctccacctcccaggttcaagcgattctcctgcctcagcctcctga

SEQ ID NO: 7713 - DNA, 2921 bp, Homo sapiens
gctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcagaaaactccctactatgccaaactgtccgcggggcggggaatggaggaggcaggcggggctggagacgggacccgacggtgactgcgcaaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatagagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgagctgaaattgtgccactgcactccagcctgggtgacagagtgagacaccatctcaaaaaaaaaaaaaaaaa

SEQ ID NO: 7714 - DNA, 3327 bp, Homo sapiens
ggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcagaaaactccctactatgccaaactgtccgcggggcggggaatggaggaggcaggcggggctggagacgggacccgacggtgactgcgcaaggtcgtgtacggcccagcgtgggcctgtgccctaactcctcccactcccttactttctgtccttcccgggccctgcagaccggccaagtttagtggtagcctttcctagtgtctcctctttgttaacccttcctacagacacagtgggcagaacttgcctaaagaagaagggaatggaagggctagtggagtcttgttggggagacaaggacctgactgcctgtgggctgcattcgggacacgacacagcagtcaacccatttgcttgtttggtttagcaaggaatagtgtctggagccggtccagctgaaggaagggtgagcagagagtgcaagcaggacccttgtcggtgggtgaacattttgctccaaaagggatccttggccctgcgcaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatagagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgagctgaaattgtgccactgcactccagcctgggtgacagagtgagacaccatctcaaaaaaaaaaaaaaaaa

SEQ ID NO: 7715 - DNA, 3078 bp, Homo sapiens
aggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcagaaaactccctactatgccaaactgtccgcggggcggggaatggaggaggcaggcggggctggagacgggacccgacggtgactgcgcaagcaaggaatagtgtctggagccggtccagctgaaggaagggtgagcagagagtgcaagcaggacccttgtcggtgggtgaacattttgctccaaaagggatccttggccctgcgcaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggctggctgatgttgtgacaccactctggaggttgagctatgaagaacagctcaagcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatagagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgagctgaaattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactga

SEQ ID NO: 7716 - DNA, 3106 bp, Homo sapiens
aggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgccgcagcaaaccaggccatccgctggccttttagtttgccgcctcaggtttgtaagaggatttattggttacgaaggaaggtggatttcagtgtgttctttggatggcaggccttaagagaagagtcccactgcacagcctcagatacttcatctccatggtgggtctcttctccaaaccaggactgcttccctggtatgccagaaatccaccaggatggtcacagctctttctgggcacagtatgtaagggagatttcacccgtgtgatagccacgaaatgtcagaaaggacaaaaaagtcagaagaaaccaagccatcttggaccactagatggttcctggcaggaaaggctggctgatgttgtgacaccactctggaggttgagctatgaagaacagctcaaggtgaaatttgcagctcagaagaaaattttacaaagactagagtcttacatccaaatgctcaatggagtcagtgtgacaacggctgtacccaaatctgagaggctctcttgtcttctccatcctattataccctctcctgtcatcaatggttaccgaaataagtccaccttctctgtgaaccgaggtccagatggcaatccaaagactgtggggttctacctgggaacttggagagatgggaacgttgtctgtgtgcagtctaatcatctgaaaaacatccctgagaaacacagtcaagtggcgcagtactatgaagtattccttcgacagtctccattggagccctgccttgtatttcatgaaggtggatactggcgtgagctcacagtccgcaccaatagccaagggcacacaatggctatcatcactttccatccccagaaattaagtcaggaggagctccatgttcagaaggagattgtaaaggaatttttcatcagaggtcctggagcagcctgtggcttgacctcactttacttccaggaaagtaccatgacccgttgcagccatcagcagtctccctatcagcttctgtttggggaaccctacatctttgaagaacttctgagcttgaagatccgcatctctccagatgcctttttccagattaacacagctggtgcagagatgctgtatcggactgtgggggagctgactggagtgaactctgacaccatccttcttgacatctgctgtggaactggtgtgattggcctctctctggctcagcatacatctcgggtccttgggattgaattgttggagcaggcagtggaggatgcaagatggactgcagccttcaatggcatcaccaactctgaatttcatactggtcaagcagagaagattttgccagggctgctaaagtcaaaggaagatggacagtcaattgttgctgtggtgaacccagcccgtgccggactgcattacaaggtgattcaagccattcgaaacttcagggccatccacacgctagtttttgtttcctgcaagctccatggtgaatccactaggaatgtcattgagctgtgctgtcctccagaccctgctaagaagctcttaggcgagccctttgtcctgcagcaagctgtacctgtggatttgttccctcacaccccacattgtgagctggtgctcctctttactcgataagcagcctcctagaagacagcaggctatttgttaaggctgaagtttcagaaactttcaggtttggcatattgctacattgcagaccctgggagcattacagtggaaaccaatctttggtttgtgaataggaagaatctattaggcctctggtctgaggcagattttttttttgagatagagtctcactcttgcccaggctggagtgtcgtggcgtgatctcagctcactgcaacctccgcctcccgggttcaagtgattctcgtgcctcagcttccccagtagctaggattaaaggtgcgtgccaccatgcccggctaatttttgtatttttggtagagacagggtttcaccatgttggccaggctggtctcaaactcctgacctcaagtgatccacccgcctcggcctctcaaagtgctgggattataggcgtgagccaccacaccccgccgcggctgacttaaccttagatttcagattccctttcaatcatgcccgtttgcttgggtttgaccactccccactcctggatctggactgtttcttcctgttgctgtcagccttggttctagtttatagtcttgtctcctccgtttctgcttatggtgtggacaaatgaccttttttaagcagctggtaataattttacattgactggagcctgtgcatttgctcagagatgctacaatttttagatatttctaagacttctggattcttgaggtagttaaggattaaaaccagaaacagtcgaggttttttaaaagcagggtaagccatgaagtgaatacagggtgactgagtgatcatcagatgagattaattcttttgggttttcttggttttaaggcatctcgaatgccccttgaaaatgtagttttccctggtggtgggcacctgtaatcccagctactcgggaggctgaggcaggataattgcttgaacctgggaggtggaggttgcagtgagctgaaattgtgccactgcactccagcctgggtgacagagtgagacaccatctcaaaaaaaaaaaaaaaaagaaaatgtagttatccctaggagcaatagcaccaattaactctcacccgtggaggaagaattggttattggagagaccctaagggaaaggagattttcagagagactgaatacctataattgtgctgtgtagtgtggaggcaaaaagctccaaaatctagtataacataataaactggatattgaaaactgactgt

SEQ ID NO: 7717 - DNA, 1904 bp, Homo sapiens
acgtgatgtttgggtgcccgccccgcccgcctcgcccgccgtgagcgcccggagcggtccgcgagccaccgaggcccagctcagtgtggaggctgctggccctgccatctgtaagaagatgtcatacggatccatcgcccgtggaggtggcctggggagccgtggccctttcgggggaccttcgagacaaggctgtcagcccctagagtgcgctagatgttggaccgagtatggaatccgccatttcccctgcccgtcgccagagagcaagctgcagaaccgctgtgtggggaaggacggggaaggtgatctggggccagcaggcacgcctattgtcccaagggccaggaagcgagggcctggggttgcccctgaaggcagccggatgccggagcccacctcatcacccaccattggcccgaggaaggactcggctgctgggccccatggccggatggcggggcccagcactacccgggccaagaagaggaagcccaacttctgcccgcaggagaccgaggtgctggtgtccaaggtgagcaagcaccaccagctgctgtttggcacggggctgctgaaggccgagcccactcgcaggtaccgcgtgtggagccgcatcctgcaggccgtgaatgcgctgggctactgtcgccgcgacgttgtggacctgaagcacaagtggcgggacctacgagccgtcgtgcggcgcaagctgggcgacctccggaaggcggcccatggccccagccctggttccggcaagccccaggccctggctctcacgcccgtggagcaggtggtggccaagaccttctcttgccaggccctgccctccgagggcttcagtctggagccgcccagagccacccaggtcgatccgtgcaacctccaggagctgttccaggagatgtcggccaacgtcttccgaatcaactccagtgtgacctccttggagcggagccttcagtccttagggacaccgagtgacacgcaggagcttcgggacagcctgcacacggcacagcaggagaccaacaagaccattgcagccagcgccagctccgtgaagcagatggccgagctgctgcgcagctcctgcccgcaggagcgtctgcagcaggagcgtcctcagctggaccggctgaaaacccagctctcagatgccattcagtgctatggagtggtgcagaagaaaattgcagaaaagtccagagcgctgcttcccatggcgcagaggggcagtaaacagagtccccaggccccgtttgccgagctggctgatgatgagaaggtctttaacgggagtgacaacatgtggcagggccaggagcaggcgctgctcccggacatcactgaagaggacctggaggccatccggctgcgggaggaggccatcctgcagatggagagcaacttgctggatgtgaatcagatcatcaaggacttggcctccatggtgtcagagcaaggagaagctgttgatagtattgaagccagccttgaggctgcgtcctcgcatgcggaggcagcccgccagctcctggctggagccagccggcaccaactccagagacacaagatcaagtgctgcttcctatcagctggagtcactgccctgcttgtcatcatcatcatcatcgccacctctgtccgaaagtgatgctacccgtgcatcggccgctgaaccgtcagctggctgtggtgtgggctctccagccccgagcacccctcctggcccggagctgggagctgatggagtccgctgcgttgtcagctgatgccgtcacttggcctgcaatggacccgagagcttcacagctgcctgctgtcctcccctgcactgaccccactcgcccctgtgtcggccccagctgagcacccgaataaaccgctgtggcttatcc

SEQ ID NO: 7718 - DNA, 2100 bp, Homo sapiens
tgcccgccccgcccgcctcgcccgccgtgagcgcccggagcggtccgcgagccaccgaggcccagctcagtgtggaggctgctggccctgccatctgtaagaagatgtcatacggatccatcgcccgtggaggtggcctggggagccgtggccctttcgggggaccttcgagacaaggctgtcagcccctagccacccaggtcgatccgtgcaacctccaggagctgttccaggagatgtcggccaacgtcttccgaatcaactccagtgtgacctccttggagcggagccttcagtccttagggacaccgagtgacacgcaggagcttcgggacagcctgcacacggcacagcaggagaccaacaagaccattgcagccagcgccagctccgtgaagcagatggccgagctgctgcgcagctcctgcccggagcgtctgcagcaggagcgtcctcagctggaccggctgaaaacccagctctcagatgccattcagtgctatggagtggtgcagaagaaaattgcagaaaagtccagagcgctgcttcccatggcgcagaggggcagtaaacagcagagtccccaggccccgtttgccgagctggctgatgatgagaaggtctttaacgggagtgacaacatgtggcagggccaggagcaggcgctgctcccggacatcactgaagaggacctggaggccatccggctgcgggaggaggccatcctgcagatggagagcaacttgctggatgtgaatcagatcatcaaggacttggcctccatggtgtcagagcaaggagaagctgttgatagtattgaagccagccttgaggctgcgtcctcgcatgcggaggcagcccgccagctcctggctggagccagccggcaccaactgatgaggaggacgagacccccagctgcttgtggctgcccctgaggtccctggaagggcccagcctgcctgaaactgaccccctggacttacgaggagtcttccacgcacccacctcctcaccctccccacctgcttccccagcctccaccccaccagcaaccacactcatgggggccttccagccttccccgccctcttcggcgccagcacctcccttgccctccaggaggaccccagcggcagcatctgaaacgtccgcatttgagcagcagctgctggactcccaccggcagcagggcgccctgctgtcctcctgggcccagcagcagagcacactcatggcccagcaaaacctgctgctgcagcggctggccgagcagagccagcgtctggccgatggcgtggaggccctcaaccggaccctcgagaggctggtggaagcacgccctacccgggaagcctcaccctcactccaggacggtagtcctgccagtggagtggcccaggggcctgctggaggctcccaggacagccccaagggcacccactcggggctcgaggtcttctcagggatgatcttgaaggtggaggaggagatatagggctggtcgggggtgctggcagagccaaagggcaggagcagggcctccagtctttcccctgctgagtccaggcaggggagaggtggcagtgactgggtctccagggcaccgggacaactccagtccaggagaccggaaggatgagaggatgtgggctgtctacctgtgatgtcgcgtccttgccattgcctgtagagggtggtgacctgcagggaaaggctgcagagagccgacctgtgggactcagtggaccaggtctactcagggatgatgctgttggaggctccaaccccatgtggcagcagctgcgaagtctgcagcccagcgtccctggaagcaggggaggtggggaagatgcactgaggggccccctgctcactggaactctggaaagggtggctcagccaggctctaaaaaggtcccaagcgtgatctggtgtgactcctgaaagcccctgtccctttggtgggcatgcacacttggagggcagggctcctctgccctacgtggttctggcccaggggaaccacatcccatatgcctggaataatttctatccaattttctgttataaatacataaatatatatatatatatata

SEQ ID NO: 7719 - DNA, 1739 bp, Homo sapiens
ctcagtgtggaggctgctggccctgccatctgtaagaagatgtcatacggatccatcgcccgtggaggtggcctggggagccgtggccctttcgggggaccttcgagacaaggctgtcagcccctagagtgcgctagatgttggaccgagtatggaatccgccatttcccctgcccgtcgccagagagcaagctgcagaaccgctgtgtggggaaggacggggaaggtgatctggggccagcaggcacgcctattgtcccaagggccaggaagcgagggcctggggttgcccctgaaggcagccggatgccggagcccacctcatcacccaccattggcccgaggaaggactcggctgctgggccccatggccggatggcggggcccagcactacccgggccaagaagaggaagcccaacttctgcccgcaggagaccgaggtgctggtgtccaaggtgagcaagcaccaccagctgctgtttggcacggggctgctgaaggccgagcccactcgcaggtaccgcgtgtggagccgcatcctgcaggccgtgaatgcgctgggctactgtcgccgcgacgttgtggacctgaagcacaagtggcgggacctacgagccgtcgtgcggcgcaagctgggcgacctccggaaggcggcccatggccccagccctggttccggcaagccccaggccctggctctcacgcccgtggagcaggtggtggccaagaccttctcttgccaggccctgccctccgagggcttcagtctggagccgcccagagccacccaggtcgatccgtgcaacctccaggagctgttccaggagatgtcggccaacgtcttccgaatcaactccagtgtgacctccttggagcggagccttcagtccttagggacaccgagtgacacgcaggagcttcgggacagcctgcacacggcacagcaggagaccaacaagaccattgcagccagcgccagctccgtgaagcagatggccgagctgctgcgcagctcctgcccggagcgtctgcagcaggagcgtcctcagctggaccggctgaaaacccagctctcagatgccattcagtgctatggagtggtgcagaagaaaattgcagaaaagtccagagcgctgcttcccatggcgcagaggggcagtaaacagcagagtccccaggccccgtttgccgagctggctgatgatgagaaggtctttaacgggagtgacaacatgtggcagggccaggagcaggcgctgctcccggacatcactgaagaggacctggaggccatccggctgcgggaggaggccatcctgcagatggagagcaacttgctggatgtgaatcagatcatcaaggacttggcctccatggtgtcagagcaaggagaagctgttgatagtattgaagccagccttgaggctgcgtcctcgcatgcggaggcagcccgccagctcctggctggagccagccggcaccaactccagagacacaagatcaagtgctgcttcctatcagctggagtcactgccctgcttgtcatcatcatcatcatcgccacctctgtccgaaagtgatgctacccgtgcatcggccgctgaaccgtcagctggctgtggtgtgggctctccagccccgagcacccctcctggcccggagctgggagctgatggagtccgctgcgttgtcagctgatgccgtcacttggcctgcaatggacccgagagcttcacag

SEQ ID NO: 7720 - DNA, 589 bp, Homo sapiens
gaccctgagccgcagccccgcgagagcgccgcatttcggggaccggcccgcgggcacatgagcccctcggcgggtcctcgcgcgctgttcagaccccagctcagtgtggaggctgctggccctgccatctgtaagaagatgtcatacggatccatcgcccgtggaggtggcctggggagccgtggccctttcgggggaccttcgagacaaggctgtcagcccctagagtgcgctagatgttggaccgagtatggaatccgccatttcccctgcccgtcgccagagagcaagctgcagaaccgctgtgtggggaaggacggggaaggtgatctggggccagcaggcacgcctattgtcccaagggccaggaagcgagggcctggggttgcccctgaaggcagccggatgccggagcccacctcatcacccaccattggcccgaggaaggactcggctgctgggccccatggccggatggcggggcccagcactacccgggccaagaagaggaagcccaacttctgcccgcaggagaccgaggtgctggtgtccaaggtgagcaagcaccaccagctgctgtttggcacgg

SEQ ID NO: 7721 - DNA, 1960 bp, Homo sapiens
cggcggccattggctggtgcgggagggggcgcgcacgccggcggcgggaggggccgtcacgtgatgtttgggtgcccgccccgcccgcctcgcccgccgtgagcgcccggagcggtccgcgagccaccgaggcccagctcagtgtggaggctgctggccctgccatctgtaagaagatgtcatacggatccatcgcccgtggaggtggcctggggagccgtggccctttcgggggaccttcgagacaaggctgtcagcccctagagtgcgctagatgttggaccgagtatggaatccgccatttcccctgcccgtcgccagagagcaagctgcagaaccgctgtgtggggaaggacggggaaggtgatctggggccagcaggcacgcctattgtcccaagggccaggaagcgagggcctggggttgcccctgaaggcagccggatgccggagcccacctcatcacccaccattggcccgaggaaggactcggctgctgggccccatggccggatggcggggcccagcactacccgggccaagaagaggaagcccaacttctgcccgcaggagaccgaggtgctggtgtccaaggtgagcaagcaccaccagctgctgtttggcacggggctgctgaaggccgagcccactcgcaggtaccgcgtgtggagccgcatcctgcaggccgtgaatgcgctgggctactgtcgccgcgacgttgtggacctgaagcacaagtggcgggacctacgagccgtcgtgcggcgcaagctgggcgacctccggaaggcggcccatggccccagccctggttccggcaagccccaggccctggctctcacgcccgtggagcaggtggtggccaagaccttctcttgccaggccctgccctccgagggcttcagtctggagccgcccagagccacccaggtcgatccgtgcaacctccaggagctgttccaggagatgtcggccaacgtcttccgaatcaactccagtgtgacctccttggagcggagccttcagtccttagggacaccgagtgacacgcaggagcttcgggacagcctgcacacggcacagcaggagaccaacaagaccattgcagccagcgccagctccgtgaagcagatggccgagctgctgcgcagctcctgcccggagcgtctgcagcaggagcgtcctcagctggaccggctgaaaacccagctctcagatgccattcagtgctatggagtggtgcagaagaaaattgcagaaaagtccagagcgctgcttcccatggcgcagaggggcagtaaacagagtccccaggccccgtttgccgagctggctgatgatgagaaggtctttaacgggagtgacaacatgtggcagggccaggagcaggcgctgctcccggacatcactgaagaggacctggaggccatccggctgcgggaggaggccatcctgcagatggagagcaacttgctggatgtgaatcagatcatcaaggacttggcctccatggtgtcagagcaaggagaagctgttgatagtattgaagccagccttgaggctgcgtcctcgcatgcggaggcagcccgccagctcctggctggagccagccggcaccaactccagagacacaagatcaagtgctgcttcctatcagctggagtcactgccctgcttgtcatcatcatcatcatcgccacctctgtccgaaagtgatgctacccgtgcatcggccgctgaaccgtcagctggctgtggtgtgggctctccagccccgagcacccctcctggcccggagctgggagctgatggagtccgctgcgttgtcagctgatgccgtcacttggcctgcaatggacccgagagcttcacagctgcctgctgtcctcccctgcactgaccccactcgcccctgtgtcggccccagctgagcacccgaataaaccgctgtggcttatcca

SEQ ID NO: 7722 - DNA, 3093 bp, Homo sapiens
aagcaaacttccgcctgcggagacccgctcccttcctcgcccccacagaaacgccccccgccaccaccccctcccccggcgtaggccttcacgctgtcgcctcgacccgtttcctcgaatccccagggaagggtgggcccctggcgcccctatggcccgccgcccccttaccaccgcggtcggagcccgggtctcactctcctgccgctgtttcgggccacaccgtgtgtccgtgcctccgcaaaggaatagaagagtgggtcctcgctctctgcggcgcaccgcttgtcccttgacttcctgtccatctacaaagcctatttcatgttttccagaaagaaaacgttttccgtgtctcttgagtcctcatcgccatatgcggggcgggaccgatctatgcaaaagatcgcaagagaaaactgatggagcatcgcccatcatgaggctgctctcccgatggtcactgagttgtgttgtggcactgtctttgtacaaagacaccaatttttgcgaacggtgccactcatgattcaacgctctcatgcctcggtcccagctgctggagcgcagattttcctccaagggttagaagatagaaaactcctcggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagttccccagagatctgtgggcagaatcatagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtgatttggcataggaattggtgcatggaggagaggagtgtatgataaaggatccatgcagtccttcctttattacacatatagtctggcttgctgtggaccaaattaatattctcctcccatcagactacaaaaaaattggactaccacgctacaagtgtgtctcccccattccacctccggatccctccccaaccctccagtgtttgaatactgctgtgttacttccaggccgttcaacgtcaggctcagtcccctctaccagtcatgattcacattactactaggctgtatcctttttgaggctgggaaacagtcaggctttcgtcattggaagtgattctgcagacttctgactcaccttatcaggtgactctggttaaggaaagcttttgagtggtgaactcaaagactccagttgaatcaggaggcaaaggcaaaaattagcataattatatttaaaagcctcaggaagtgggaagagaatactgcctcccagcctcaattgctgatatgttattggagacaggcttttgaaactgctccagctatttctctgtaacctttagttaaaatataagtagaaaggagacaggaggctcaggaaattttctaaattgctagtataatatctatatgtatacacacatatacacccgtggagagagaggaagagtatacagtcctgtttgaatcatttggaggatttttttgctgaataaagttctcaagaaaa

SEQ ID NO: 7723 - DNA, 2751 bp, Homo sapiens
ggtgtgagtgggaggcggcggcgctggtggctgcagctggggtgaggcgcgaggcggcgcactcgacggctgactggagcagcggtaaaggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagttccccagagatctgtgggcagaatcatagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtgtgagtgcagctatcatctatctgtagcaacaggaaagtaatgagggcgacagtggggcacttgctttgattccctctttcccatgccctgtcttaatatacttctctgcagctgctttcctgcagcttaacttgctctcagattgagcactttcaagctttttgtgtatttctgtctttggcaggatttggcataggaattggtgcatggaggagaggagtgtatgataaaggatccatgcagtccttcctttattacacatatagtctggcttgctgtggaccaaattaatattctcctcccatcagactacaaaaaaattggactaccacgctacaagtgtgtctcccccattccacctccggatccctccccaaccctccagtgtttgaatactgctgtgttacttccaggccgttcaacgtcaggctcagtcccctctaccagtcatgattcacattactactaggctgtatcctttttgaggctgggaaacagtcaggctttcgtcattggaagtgattctgcagacttctgactcaccttatcaggtgactctggttaaggaaagcttttgagtggtgaactcaaagactccagttgaatcaggaggcaaaggcaaaaattagcataattatatttaaaagcctcaggaagtgggaagagaatactgcctcccagcctcaattgctgatatgttattggagacaggcttttgaaactgctccagctatttctctgtaacctttagttaaaatataagtagaaaggagacaggaggctcaggaaattttctaaattgctagtataatatctatatgtatacacacatatacacccgtggagagagaggaagagtatacagtcctgtttgaatcatttggaggatttttttgctgaataaagttctcaagaaaatt

SEQ ID NO: 7724 - DNA, 2824 bp, Homo sapiens
cggctgaagcgccgccggcggggctcactgtggtggtgtgagtgggaggcggcggcgctggtggctgcagctggggtgaggcgcgaggcggcgcactcgacggctgactggagcagcggtaaaggcgaggatggagaccgaaggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagttccccagagatctgtgggcagaatcatagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtgtgagtgcagctatcatctatctgtagcaacaggaaagtaatgagggcgacagtggggcacttgctttgattccctctttcccatgccctgtcttaatatacttctctgcagctgctttcctgcagcttaacttgctctcagattgagcactttcaagctttttgtgtatttctgtctttggcaggatttggcataggaattggtgcatggaggagaggagtgtatgataaaggatccatgcagtccttcctttattacacatatagtctggcttgctgtggaccaaattaatattctcctcccatcagactacaaaaaaattggactaccacgctacaagtgtgtctcccccattccacctccggatccctccccaaccctccagtgtttgaatactgctgtgttacttccaggccgttcaacgtcaggctcagtcccctctaccagtcatgattcacattactactaggctgtatcctttttgaggctgggaaacagtcaggctttcgtcattggaagtgattctgcagacttctgactcaccttatcaggtgactctggttaaggaaagcttttgagtggtgaactcaaagactccagttgaatcaggaggcaaaggcaaaaattagcataattatatttaaaagcctcaggaagtgggaagagaatactgcctcccagcctcaattgctgatatgttattggagacaggcttttgaaactgctccagctatttctctgtaacctttagttaaaatataagtagaaaggagacaggaggctcaggaaattttctaaattgctagtataatatctatatgtatacacacatatacacccgtggagagagaggaagagtatacagtcctgtttgaatcatttggaggatttttttgctgaataaagttctcaagaaaattttctaaaa

SEQ ID NO: 7725 - DNA, 2651 bp, Homo sapiens
gggaggcggcggcgctggtggctgcagctggggtgaggcgcgaggcggcgcactcgacggctgactggagcagcggtaaaggcgaggatggagaccgaaggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtgtgagtgcagctatcatctatctgtagcaacaggaaagtaatgagggcgacagtggggcacttgctttgattccctctttcccatgccctgtcttaatatacttctctgcagctgctttcctgcagcttaacttgctctcagattgagcactttcaagctttttgtgtatttctgtctttggcaggatttggcataggaattggtgcatggaggagaggagtgtatgataaaggatccatgcagtccttcctttattacacatatagtctggcttgctgtggaccaaattaatattctcctcccatcagactacaaaaaaattggactaccacgctacaagtgtgtctcccccattccacctccggatccctccccaaccctccagtgtttgaatactgctgtgttacttccaggccgttcaacgtcaggctcagtcccctctaccagtcatgattcacattactactaggctgtatcctttttgaggctgggaaacagtcaggctttcgtcattggaagtgattctgcagacttctgactcaccttatcaggtgactctggttaaggaaagcttttgagtggtgaactcaaagactccagttgaatcaggaggcaaaggcaaaaattagcataattatatttaaaagcctcaggaagtgggaagagaatactgcctcccagcctcaattgctgatatgttattggagacaggcttttgaaactgctccagctatttctctgtaacctttagttaaaatataagtagaaaggagacaggaggctcaggaaattttctaaattgctagtataatatctatatgtatacacacatatacacccgtggagagagaggaagagtatacagtcctgtttgaatcatttggaggatttttttgctgaataaagttctcaagaaaattttctaaaaccaaa

SEQ ID NO: 7726 - DNA, 2318 bp, Homo sapiens
cggctgaagcgccgccggcggggctcactgtggtggtgtgagtgggaggcggcggcgctggtggctgcagctggggtgaggcgcgaggcggcgcactcgacggctgactggagcagcggtaaaggcgaggatggagaccgaaggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagttccccagagatctgtgggcagaatcatagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtatgttgcctgcaatgaactcgctgaagcatgctcagccctggaactggtgctaccagagttccgtagggaacctttactctttagaggttccctgatataaatcattcataagacttcctaccctggaaaatgagtaatgtctcattcttacctgcagtttgttactatgtataaaagtctttttctttaatatgcctttaagtcttacctgtttacagcccattctgatgggttctttgtcattctgttagtataacccagtacttttcctgctgcctggaatgccctcttctatgttacctattctgtccgttgagatcccccaacttgggccaaagccaagagatctatgtgccttctctggttttctccacatctatagcacctcaactgaaatatatggataaaaacagcctaacaaa

SEQ ID NO: 7727 - DNA, 1807 bp, Homo sapiens
gcactcgacggctgactggagcagcggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtgatttggcataggaattggtgcatggaggagaggagtgtatgataaaggatccatgcagtccttcctttattacacatatagtctggcttgctgtggaccaaattaatattctcctcccatcagactac

SEQ ID NO: 7728 - DNA, 2768 bp, Homo sapiens
gcggggctcactgtggtggtgtgagtgggaggcggcggcgctggtggctgcagctggggtgaggcgcgaggcggcgcactcgacggctgactggagcagcggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagttccccagagatctgtgggcagaatcatagggagaggcggcgagacaattcgttctatctgtaaggcatctggagccaaaattacctgtgacaaagaatcagaagggacattactactatcaagacttataaaaatctcaggaacacagaaggaagtggcagcagccaagcatttgatactggagaaagtttcagaagatgaagaacttcggaagagaattgctcattctgcagaaaccagggtcccacgcaaacagccaatcagtgtgagaagagaagacatgacagagccaggtggagctggagagccagcattatggaaaaacaccagttctagcatggagccgactgcacccctggtgactcctccacccaaaggaggaggcgacatggctgtggtagtgtcaaaggaaggttcctgggagaaacctagtgatgacagctttcagaagtctgaagcccaggccatcccagagatgcccatgtttgaaatccccagtcctgacttcagttttcatgctgatgagtacctagaagtctacgtttctgcttctgagcaccctaaccacttctggatccagatcgttggctcccgcagcctgcaattggataagcttgtcaatgagatgacccagcactatgagaatagtgtgcctgaagacttgactgtgcatgtaggagacattgtagcagcacctttacctacaaatggttcctggtatcgagcccgggtcctcggcaccttggagaatgggaacttggacctctattttgttgactttggagataatggagattgcccactgaaggacctcagggctctcaggagtgacttcctaagccttccatttcaagcaatagaatgtagtctggcacggattgctccctcaggtgaccagtgggaagaggaagctttggatgagtttgatagactcactcattgtgctgactggaagcctctggtagccaagatctctagctatgtccagactgggatctcaacttggccaaagatctacttatatgatactagcaatgggaagaaacttgatattgggctagaattagtacacaaaggatacgcaattgagcttcctgaagacatagaagaaaacagagctgtcccagacatgttgaaggacatggccacagaaacagatgcctctctcagcacgttgctcactgagaccaaaaagagctctggagagataacacataccctgtcctgcctcagcttatcagaagctgcttccatgtctggtgatgataaccttgaagatgactacttactctgaagtctgggcttcagtttgctcagccatctgctttgctgtgtgagtgcagctatcatctatctgtagcaacaggaaagtaatgagggcgacagtggggcacttgctttgattccctctttcccatgccctgtcttaatatacttctctgcagctgctttcctgcagcttaacttgctctcagattgagcactttcaagctttttgtgtatttctgtctttggcaggatttggcataggaattggtgcatggaggagaggagtgtatgataaaggatccatgcagtccttcctttattacacatatagtctggcttgctgtggaccaaattaatattctcctcccatcagactacaaaaaaattggactaccacgctacaagtgtgtctcccccattccacctccggatccctccccaaccctccagtgtttgaatactgctgtgttacttccaggccgttcaacgtcaggctcagtcccctctaccagtcatgattcacattactactaggctgtatcctttttgaggctgggaaacagtcaggctttcgtcattggaagtgattctgcagacttctgactcaccttatcaggtgactctggttaaggaaagcttttgagtggtgaactcaaagactccagttgaatcaggaggcaaaggcaaaaattagcataattatatttaaaagcctcaggaagtgggaagagaatactgcctcccagcctcaattgctgatatgttattggagacaggcttttgaaactgctccagctatttctctgtaacctttagttaaaatataagtagaaaggagacaggaggctcaggaaattttctaaattgctagtataatatctatatgtatacacacatatacacccgtggagagagaggaagagtatacagtcctgtttgaatcatttggaggatttttttgctgaataaagttctcaag

SEQ ID NO: 7729 - DNA, 568 bp, Homo sapiens
attaacaattgatggcacaggatgagaagcccaaacttggaaggaccctccagggaaataagaggaaaccaagagaaagagggcacagaaaccaaggaaagagttttgtggagggagtggccaccttcctgctaccgcagagagatgggatataagtcaaagagtacagcagaaaatgtctactgaacggacttcttggacaagcctgtccaccattcagaaaatagccctgggccttgggatcccagccagtgcaacagttgcctatatcctataccgcaggtatagggaaagcagagaagagcggctgacatttgttggggaagatgacattgagatagagatgcgggttccccaggaggctgtgaaactcatcattggccggcaaggagccaatattaaacagctgcggaaacagacaggtgctcggattgatgtggacacagaggatgtaggcgatgagcgagtgctgcttatcagtggttttcctgttcaggtgtgcaaggccaaagcagcaatccatcagatcctgacagagaataccccagtgtctgagcagctttcagtt

SEQ ID NO: 7730 - DNA, 3276 bp, Homo sapiens
gcagttcagcgagatgaaagggataaagcagaacccgctggcactaggaaaagcttccaacacacagtccacaacacagcttgggaaccaaaaaagctacagatccagccactcagcccaagcatgggagaactaccagcattgcctcattgcaaaaaagaggaggaaaacaacgtgatccatgtttaacaaaagagtctgtggactaggaggtgggagggtaactacctgctgaaagtgaactttctttgatatccatgcatatatataaactcagccctgcctttgatgttcagcaactgattcactgatcagattacaggcatttcatctccctgctcgtctgcctttgatctgcatggttaattttattttcctggatttgaagtttcgtctgggcttgtgctgacatacatttttgggaaggtagaagcatttggcacagaagtgctgccaggagaaactaagttgctgaacggaactctccaacaataaatacatttgataagaaagatggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaaggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggtgctgtcatccacccagccactcagacgtccctccaggaagcttaaagaacctgcttctttctgcagtagaagcgtgtgctggaacccaaagagtactcctttgttaggcttatggactgagcagtctggaccttgcatggcttctggggcaaaaataaatctgaaccaaactgacggcatttgaagcctttcagccagttgcttctgagccagaccagctgtaagctgaaacctcaatgaataacaagaaaagactccaggccgactcatgatactctgcatctttcctacatgagaagcttctctgccacaaaagtgacttcaaagacggatgggttgagctggcagcctatgagattgtggacatataacaagaaacagaaatgccctcatgcttattttcatggtgattgtggttttacaagactgaagacccagagtatactttttctttccagaaataatttcataccgcctatgaaatatcagataaattaccttagcttttatgtagaatgggttcaaaagtgagtgtttctatttgagaaggacactttttcatcatctaaactgattcgcataggtggttagaatggccctcatattgcctgcctaaatcttgggtttattagatgaagtttactgaatcagaggaatcagacagaggaggatagctctttccagaatccacacttctgacctcagcctcggtctcatgaacacccgctgatctcaggagaacacctgggctagggaatgtggtcgagaaagggcagcccattgcccagaattaacacatattgtagagacttgtatgcaaaggttggcatatttatatgaaaattagttgctatagaaacatttgttgcatctgtccctctgcctgagcttagaaggttatagaaaaagggtatttataaacataaatgaccttttacttgcattgtatcttatactaaaggctttagaaattacaacatatcaggttcccctactactgaagtagccttccgtgagaacacaccacatgttaggactagaagaaaatgcacaatttgtaggggtttggatgaagcagctgtaactgccctagtgtagtttgaccaggacattgtcgtgctccttccaattgtgtaagattagttagcacatcatctcctactttagccatccggtgttggatttaagaggacggtgcttctttctattaaagtgctccatcccctaccatctacacattagcattgtctctagagctaagacagaaattaaccccgttcagtcacaaagcagggaatggttcatttactcttaatctttatgccctggagaagacctacttgaacagggcatattttttagacttctgaacatcagtatgttcgagggtactatgatattttggtttggaattgccctgcccaagtcactgtcttttaacttttaaactgaatattaaaatgtatctgtctttcctagtatgtttttatcttctcatgtattatccatggttttctctgtttgtgacagattagtaaaatttaatgagccctc

SEQ ID NO: 7731 - DNA, 1625 bp, Homo sapiens
gttgccgggctacgggagagcgcggagccctgcgctgggaggtgcacggtgtgcacgctggactggacccccatgcaaccccgcgccctgcgccttaaccaggactgctccgcgcgcccctgagcctcgggctccggcccggacctgcagcctcccaggtggctgggaagaactctccaacaataaatacatttgataagaaagatggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaaggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggtgctgtcatccacccagccactcagacgtccctccaggtaaggcagcgactgggttccctgtgaacacagcactgacttacagtagatcagaactctgttcccagcataagatttgggggaacctgatgagttttttttttgcatctttaataatttcttgtatgttgtagagtatgttttaaaataaatttcaagtatttttttaaaaaact

SEQ ID NO: 7732 - DNA, 4151 bp, Homo sapiens
cgcggagccctgcgctgggaggtgcacggtgtgcacgctggactggacccccatgcaaccccgcgccctgcgccttaaccaggactgctccgcgcgcccctgagcctcgggctccggcccggacctgcagcctcccaggtggctgggaagaactctccaacaataaatacatttgataagaaagatggctttaaaagtgctactagaacaagagaaaacgtttttcactcttttagtattactaggctatttgtcatgtaaagtgacttgtgaatcaggagactgtagacagcaagaattcagggatcggtctggaaactgtgttccctgcaaccagtgtgggccaggcatggagttgtctaaggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggtgctgtcatccacccagccactcagacgtccctccaggaagcttaaagaacctgcttctttctgcagtagaagcgtgtgctggaacccaaagagtactcctttgttaggcttatggactgagcagtctggaccttgcatggcttctggggcaaaaataaatctgaaccaaactgacggcatttgaagcctttcagccagttgcttctgagccagaccagctgtaagctgaaacctcaatgaataacaagaaaagactccaggccgactcatgatactctgcatctttcctacatgagaagcttctctgccacaaaagtgacttcaaagacggatgggttgagctggcagcctatgagattgtggacatataacaagaaacagaaatgccctcatgcttattttcatggtgattgtggttttacaagactgaagacccagagtatactttttctttccagaaataatttcataccgcctatgaaatatcagataaattaccttagcttttatgtagaatgggttcaaaagtgagtgtttctatttgagaaggacactttttcatcatctaaactgattcgcataggtggttagaatggccctcatattgcctgcctaaatcttgggtttattagatgaagtttactgaatcagaggaatcagacagaggaggatagctctttccagaatccacacttctgacctcagcctcggtctcatgaacacccgctgatctcaggagaacacctgggctagggaatgtggtcgagaaagggcagcccattgcccagaattaacacatattgtagagacttgtatgcaaaggttggcatatttatatgaaaattagttgctatagaaacatttgttgcatctgtccctctgcctgagcttagaaggttatagaaaaagggtatttataaacataaatgaccttttacttgcattgtatcttatactaaaggctttagaaattacaacatatcaggttcccctactactgaagtagccttccgtgagaacacaccacatgttaggactagaagaaaatgcacaatttgtaggggtttggatgaagcagctgtaactgccctagtgtagtttgaccaggacattgtcgtgctccttccaattgtgtaagattagttagcacatcatctcctactttagccatccggtgttggatttaagaggacggtgcttctttctattaaagtgctccatcccctaccatctacacattagcattgtctctagagctaagacagaaattaaccccgttcagtcacaaagcagggaatggttcatttactcttaatctttatgccctggagaagacctacttgaacagggcatattttttagacttctgaacatcagtatgttcgagggtactatgatattttggtttggaattgccctgcccaagtcactgtcttttaacttttaaactgaatattaaaatgtatctgtctttcctagtatgtttttatcttctcatgtattatccatggttttctctgtttgtgacagattagtaaaatttaatgagccctctttcttgtggccgtttctccatagttttaggttttgatatgtgtttactagcttgcctgtgtctggtacatctcatgacctcaattccctcacctgaaataggaaatgagaatgtttcattgtagccccaagcggtcatgtcaacctagtgcctagtcataattaattgacttttcctgtattacttctttttttaagtataaaccaatgatcctttggtagtcaagaactcttaggaacattgccttttggacatgtaaaatatttaggatttgaccacacaatggctatgaaaatgcaagtagtttcctcgcgtgacctcaccatgattcacatacgtgccactgtttgaaatctggtctgtttgcatttctgttatgacagagagatgatgtttgcatttctgttatgacagagagatgatgaaagtaggcagggctgtgttcctttgtgtagcctgtatatattttccatatgtagagccctgattaacttcaaggacaaacactggctggagaaagccagactgatgggaatgagactttggccaaaaatcccaaaacatcattttcaatcagtagagaagtgcttagggttgaaaattgatttcatttgctactgaatttggtaaatcctgggtaacttttatcaagatgaagacattttaccctacctactctagaaatatacaacaatgttatattttacactccttggaaacatttgaggaaaaaaatgcaatttgcacttcactttgttggaatatcccatagcactcaataaactcagctgctagagtgccgatgtcaggagggctgtgtcgggtaatgcgtgtggctgaatgggcataaccactgtggcttcttgtgctgcagaagctcgttgacaagactgaggaggatttcaagagcaaccaagtaaagtcatgaattttctaattttgtgtatatggaatatatttttaaatagagatttttctactttagataatgtgttaatattgctattacctaggttaagcactattgtctgtgctagtaagaaaaagaaaggaaaaccatcattgctttatagtagcttatatcaatttagatttcatcattactattttgcatactggaatttataaatgtgtaaattatcattttcttagttttgtaataccttttttatttgtgaataaaattatcacctggtattctta

SEQ ID NO: 7733 - DNA, 1378 bp, Homo sapiens
agcaactgattcactgatcagattacaggcatttcatctccctgctcgtctgcctttgatctgcatggttaattttattttcctggatttgaagtttcgtctgggcttgtgctgacatacatttttgggaaggtagaagcatttggcacagaagtgctgccaggagaaactaagttgctgaacgggaatgtggcttcggctatggggaggatgcacagtgtgtgacgtgccggctgcacaggttcaaggaggactggggcttccagaaatgcaagccctgtctggactgcgcagtggtgaaccgctttcagaaggcaaattgttcagccaccagtgatgccatctgcggggactgcttgccaggattttataggaagacgaaacttgtcggctttcaagacatggagtgtgtgccttgtggagaccctcctcctccttacgaaccgcactgtgccagcaaggtcaacctcgtgaagatcgcgtccacggcctccagcccacgggacacggcgctggctgccgttatctgcagcgctctggccaccgtcctgctggccctgctcatcctctgtgtcatctattgtaagagacagtttatggagaagaaacccagctggtctctgcggtcacaggacattcagtacaacggctctgagctgtcgtgttttgacagacctcagctccacgaatatgcccacagagcctgctgccagtgccgccgtgactcagtgcagacctgcgggccggtgcgcttgctcccatccatgtgctgtgaggaggcctgcagccccaacccggcgactcttggttgtggggtgcattctgcagccagtcttcaggcaagaaacgcaggcccagccggggagatggtgccgactttcttcggatccctcacgcagtccatctgtggcgagttttcagatgcctggcctctgatgcagaatcccatgggtggtgacaacatctctttttgtgactcttatcctgaactcactggagaagacattcattctctcaatccagaacttgaaagctcaacgtctttggattcaaatagcagtcaagatttggttggtggggctgttccagtccagtctcattctgaaaactttacagcagctactgatttatctagatataacaacacactggtagaatcagcatcaactcaggatgcactaactatgagaagccagctagatcaggagagtggtgctgtcatccacccagccactcagacgtccctccaggaagcttaaagaacctgcttctttctgcagtagaagcgtgtgctggaacccaaagagtactcctttgttaggcttatggactgagcagtctggaccttgcatggcttctggggcaaaaataaatctga

SEQ ID NO: 7734 - DNA, 3648 bp, Homo sapiens
caggcggcccccgggagagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcggtaagccccggccgcgcagggcgccgcgcgcagtccagccggcccggccctgccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccgcccatcttgcagggcagctgtgattagagaagccagggccaccccggagccagcctctgaggcttcacctcaccccgtttacactgctgtctcctctgcatagatttggctgactgaggacgcgacagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaggctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatca

SEQ ID NO: 7735 - DNA, 2956 bp, Homo sapiens
actgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaggctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaac

SEQ ID NO: 7736 - DNA, 3381 bp, Homo sapiens
agtccagccggcccggccctgccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggcccgaagtgggaatgatggctccatttcacagatgaggaaaccgagactcagagcacaaggccacacagcaggaagagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaggctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatca

SEQ ID NO: 7737 - DNA, 2647 bp, Homo sapiens
aagccccggccgcgcagggcgccgcgcgcagtccagccggcccggccctgccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggccccccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaggctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccaccactgcctccc

SEQ ID NO: 7738 - DNA, 556 bp, Homo sapiens
gtgcactccttctttctctctccaccagcacgtctgcgaggaagtgggaatgatggctccatttcacagatgaggaaaccgagactcagagcacaaggccacacagcaggaagagggcagctgtgattagagaagccagggccaccccggagccagcctctgaggcttcacctcaccccgtttacactgctgtctcctctgcatagatttggctgactgaggacgcgacagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgacc

SEQ ID NO: 7739 - DNA, 533 bp, Homo sapiens
agagcctcgcgggggagccgggagcctggtttccccgccaacccccatcccgcccgccccggcggccaccctgggggcgaggcagcccggcgcgtgggaggggacggcgcgccattggcttgtgcgcggaaccgagaggagggaccagcgcgggccgccagactcgggcagctgtgattagagaagccagggccaccccggagccagcctctgaggcttcacctcaccccgtttacactgctgtctcctctgcatagatttggctgactgaggacgcgacagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttct

SEQ ID NO: 7740 - DNA, 658 bp, Homo sapiens
gatgtgaggcgtccgagcccggagcctccgcctggcatcagctccacgtagcccagcgccggcacgcgcgaggcccatttggctgactgaggacgcgacaggtactcagcttctttctgcatctcagttgcccagcacaggggctggcacgcacccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtcc

SEQ ID NO: 7741 - DNA, 602 bp, Homo sapiens
cgcgggccgccagactcggtaagccccggccgcgcagggcgccgcgcgcagtccagccggcccggccctgccctgccctgccctgtcctgccctgccctgccctgccctgccctgcactgcccggcccggcacgggcggcgcgatgtgaggcgtccgagcccggagcctccgcctggcatcagctccacgtagcccagcgccggcacgcgcgaggcccggcagctgtgattagagaagccagggccaccccggagccagcctctgaggcttcacctcaccccgtttacactgctgtctcctctgcatagatttggctgactgaggacgcgacagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatg

SEQ ID NO: 7742 - DNA, 642 bp, Homo sapiens
agagtcgaaaaggacaggaattcttcatgttctgcccatgtgaatgaccgtcgagacaggaaaaacctcccagtgacttctgagcggtgatggaggccatcagagggcctgatccccttgcccacagcagcagcttcagacccccgggggaggagcccaggaatgcctccttcttgccacctgctctgccctgacctctcgccctcttcagcacaggcagctgtgattagagaagccagggccaccccggagccagcctctgaggcttcacctcaccccgtttacactgctgtctcctctgcatagatttggctgactgaggacgcgacagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatg

SEQ ID NO: 7743 - DNA, 571 bp, Homo sapiens
attgttcccggcaggaggagtgcgcggcgcaaacttgcgagttcccccagtctttgcccccgcagggccgcggacggaggtggtggcggagttcccgctgcccacaagtctggcccgaccttctggggtgggggcctgggggcaggggccctgggccggagaacccggggccgcctaacggctcggagctcaccgccgggggacaccggcgctgaggcctgggtctcagaaagtggggcagctgtgattagagaagccagggccaccccggagccagcctctgaggcttcacctcaccccgtttacactgctgtctcctctgcatagatttggctgactgaggacgcgacagcccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcag

SEQ ID NO: 7744 - DNA, 3703 bp, Homo sapiens
agtctttgcccccgcagggccgcggacggaggtggtggcggagttcccgctgcccacaagtctggcccgaccttctggggtgggggcctgggggcaggggccctgggccggagaacccggggccgcctaacggctcggagctcaccgccgggggacaccggcgctgaggcctgggtctcagaaagtgggaagtgggaatgatggctccatttcacagatgaggaaaccgagactcagagcacaaggccacacagcaggaagagagaaatgaaaacttacggtcccacagaaacgcgggtttgtagcagctctattcataatcatcaacaactggaaacaacccacatggccttcagtgaccgaatggataaacaagctgttacacgtaccccagggaatactgctctccaataaaaaggagcggactcttgatacacacagtgacttggaggaatctcaaaggcattctgctcaatgacaggagccagcctcaaaagatttggctgactgaggacgcgacaggtactcagcttctttctgcatctcagttgcccagcacaggggctggcacgcacccttctgcagaggccgggctggaggagaagatggcggccaagcagcccccgcctctgatgaagaagcacagccagacggacctcgtgagccgcctgaagacccgcaagatcctcggcgtgggcggggaggatgacgacggggaggtgcatcgctccaagatcagccaggtcttaggcaatgaaatcaagtttaccattcgggagcctttggggctcagggtctggcagttcgtctctgctgtgctcttctccggcattgccatcatggcgcttgccttccctgaccagctctatgatgcggtctttgatggagcccaggtgaccagcaagacccccatccgcctctacggcggtgccctcctcagcatctccctgatcatgtggaacgctctctacacggctgagaaggtcatcattcgatggaccctgctcaccgaagcttgctatttcggggtccagttcttggtggtcactgccacgctagctgagacgggcctcatgtccctggggatcctgctgctcctggtcagccgcctcctttttgtcgtcatcagcatttactactattaccaagtcggccgaagacccaagaaggcctagttgcccgctgggcctggggccctgcccatgcctgggccagagtggcgctggggcctcggcttccctttggctcctggaaggcaggagggtcccctgccctgccccagtcctgccccagggaggcagggggtggggggccttcctttcctcctgggcaccccgtgtgctgtgatctcctgggctttcaggcttgacatgctggtctggggagagacagggcctctgctgccctgttcttcaccctcacagtgatacctcctttccttgggtctcttggcctccagaccccctcaatagacactgactaaagtcaggctggagtcatgagggtagtgggctaagtcgagggtccagcctcttctgccaggaagcccttcttgcttttgagagaggctgtgaccaccccccatccttctccctacactcccagccaacctagtgcccaagcagctaaacttggcttccttctaatcctggaaaaccctgtacccctcctcctcaatctggccctctccacatgcacaccctgaaaacacacacagacacacaacacacacacatacacacccctgaacacacacacagacacacatacacccatgatgtgagcaaacacacacacgtgcgccttcatagcccagccaagggcatgcaggcagggtgtgctgcctgagatggcacctccctttcagccattcttcaagaatgggccacacacagctagaagtcctctcccagctagaagtcctgtccccactctcctggcctgacaagatgagctctcctgggaccttgctctagggcactctgcctctaccctaggacactggaatgccctgggagccccctccctgcaaccagcctgagttcagccccacggacaaagggacacacagcccccaatggagaccattgtaagtggtggggctgggagaggaggaacagaaggaaagccatagcgctctcttgccccttggcatgtaccccaaggcctgatggccactgggctcagcctgtcccccactcctgcctgcttcccggtgagctgccccccacacgtgcagcccgggctgcctccagggtctggctgagtgggatcaggtggccctccaactcagcacaggaaataagtagaaacatttcagcaggccacctcccctcatcttccccgccctgtccagcgccctggcaaaggctgacaactggctgtcttggggccgaacagcccctgccctgcctctgagggcccaccagcctgtgctgcatacccaccgcccagcttctccctgagggcccaccagcctgtgctgcatacccaccgcccagcttctccctgagggcccaccagcctgtgctgtacaccccgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaa

SEQ ID NO: 7745 - DNA, 1450 bp, Homo sapiens
agcggctgggcggcgggccgggcccggggccgcttggaatggcgcctcctccgccttcgccccaactgcttctcctggcagccctcgcgaggctcctgggtcccagcgaggtgatggctggaccggcggaggaggcgggagcccattgtcccgagagcctgtggcctctgcctccgcaggtgtcaccaagagtgacctacacacgagtgagcccagggcaggctgaggatgtcaccttcctctaccacccctgtgcccatccctggctgaagctccagcttgccctcctggcctatgcttgtatggctaacccttccctcacccctgacttcagcctcacgcaggatcggcccctggtgctgactgcatgggggctggcgctggagatggcctgggtagagccagcctgggctgcccactggctgatgaggaggcggaggaggaagcagaggaagaagaaggcatggatctactgtgaaagcctttcagggcctgctccctccgagccaactcccggtagagggaggctgtgccgaagagggtgtgtgcaggccctggctctggcctttgctctgcggagctggcggccccctggcacagaggtgacatctcaagggcccaggcagccctcttctagtggtgccaagaggcggaggctgcgggctgcccttggtccccagcccactcgctcagccctgaggtttccctctgcttccccagggagcttgaaggccaagcagtccatggcgggaatccctggtagggagagtaatgccccatctgtgcccactgtctccctgctgccgggggcgcctggaggcaatgccagctccaggacagaggctcaggtgcccaacgggcaaggcagcccagggggctgtgtctgttcaagtcaggcttccccggcccctcgcgcagcagcgcctccacgggcagcccggggccccaccccacgcactgaagaggccgcctgggctgccatggccctgaccttcctgctggtgctgctcaccctggccacgctctgcacacggctgcacagaaacttccgacgcggggagagcatctactgggggcccacagcggacagccaggacacagtggctgctgtgctgaagcggaggctgctgcagccctcgcgccgggtcaagcgctcgcgccggagacccctcctcccgcccacgccggacagcggcccggaaggcgagagctcggagtgacggcctgggacctgccactgtggcgtgcggctcctccccgcgccgcgaggccgcgacctctgccacgtggaccgcgcgcggggcgctccctggtggcgatggcgcggcactggccgagcactgcgggggctttcctccttgttggttgctgagtgggcggccaaggggagaaaaggagccgcttctgcctcccttgccaaaactccgtttctaattaaattatttttagt

SEQ ID NO: 7746 - DNA, 414 bp, Homo sapiens
gccaagcagtccatggcgggaatccctggtagggagagtaatgccccatctgtgcccactgtctccctgctgccgggggcgcctggaggcaatgccagctccaggacagaggctcaggtgcccaacgggcaaggccccagggggctgtgtctgttcaagtcaggcttccccggcccctcgcgcagcagcccacgggcagcccggggccccaccccacgcactgaagaggccgcctgggctgccatggccctgaccttcctgctggtgctgctcaccctggccacgctctgcacacggctgcacagaaacttccgacgcggggagagcatctactgggggcccacagcggacagccaggacacaacccctcctcccgcccacgacagcggcccggaaggcgagagctcggagtga

SEQ ID NO: 7747 - DNA, 3486 bp, Homo sapiens
gggcgggcacggggccccggccgggaggtgagcgcagctgtcgttcagcttgtgggtagcactcgggccgagccatgcaggcggcgcgcgtggactacatcgctccctggtgggtcgtgtggctgcacagcgtcccgcacgtcggcctgcgcctgcagcccgtgaacagcaccttcagccccggcgacgagagttaccaggagtcgctgctgttcctggggctggtggccgccgtctgcctgggcctgaacctcatcttccttgtggcttacctggtctgtgcatgccactgccggcgggacgatgcggtgcagaccaagcagcaccactcctgctgcatcacctggacggccgtggtggccgggctcatctgctgtgctgcggtgggcgttggtttctatggaaacagcgagaccaacgatggggcgtaccagctgatgtactccttggacgatgccaaccacaccttctctgggatcgatgctctggtttccggaactacccagaagatgaaggtggacctagagcagcacctggcccggctcagtgagatctttgctgcccggggcgattacctgcagaccctgaagttcatacagcagatggcgggcagcgttgttgttcagctctcaggactgcccgtgtggagggaggtcaccatggagctgaccaagctatccgaccagactggctacgtggagtactacaggtggctctcctacctcctgctctttatcctggacctggtcatctgcctcattgcctgcctgggactggccaagcgctccaagtgtctcctggcctcgatgctgtgctgtggggcactgagcctgctcctcagttgggcatccctggccgctgatggctctgcggcagtggccaccagtgacttctgtgtggctcctgacaccttcatcctgaacgtcacggagggccagatcagcacagaggtgactcgctactacctgtattgcagccagagtggaagcagccccttccagcagaccctgaccaccttccagcgcgcacttaccaccatgcagatccaggtcgcggggctgctgcagtttgccgtgcccctcttctccactgcagaggaagacctgcttgcaatccagctcctgctgaactcctcagagtccagccttcaccagctgaccgccatggtggactgccgagggctgcacaaggattatctggacgctcttgctggcatctgctacgacggcctccagggcttgctgtaccttggcctcttctccttcctggccgccctcgccttctccaccatgatctgtgcagggccaagggcctggaagcacttcaccaccagaaacagagactacgatgacattgatgatgatgacccctttaacccccaagcctggcgcatggcggctcacagtcccccgaggggacagcttcacagcttctgcagctacagcagtggcctgggaagtcagaccagcctgcagcccccggcccagaccatctccaacgcccctgtctccgagtacatgaaccaagccatgctctttggtaggaacccacgctacgagaacgtgccactaatcgggagagcctcccctccgcctacgtactctcccagcatgagagccacctacctgtctgtggcggatgagcacctgaggcactacgggaatcagtttccagcctaacagactttcgggggttcctgcctcctttttccgttctggtttttaattagtgcaaatacaagctgcgtttctttaatagaaaccaaaggcatctggagcccgagaggcctcctgctgtggcagaggagcagctgggattcccgaccaaagccccagggggtgcagaagactcaccacgcgggccagcctctctcttttgccctgctctccacaccagaaatgcccccaggtgcttggctgcctcagaggtaccatccctgagctggctgcctggccctgctcacccctacgcctcgcccttgccaggaggggagtggcagtgaggagggggccaggtcaggcaccaccatcaagagagctgtgtgttctctctggtcccacaacgatgactctgcctcttgtcagcccagccaagagcccagacgacccctctgtcctcgttccctgtcctcgttccctgcaggtaacatgagaagggctgatcaggagatgctctttaagaagttcgcacccctgctgacaccagaacagcccaaatcagagttcccagggccagacaggctcttcctgggccacagaggggaggcatcaggaaagctctgcagtggggggctggtggctccggggctgggggatcacaggctggtgaaccccggtgggaacagaggtgaaagcctgccacattccgcctgtctccctaaccctccattgcctcgcctctattccagaatcaatgctgcagaatgtgttagctgcagataggcatggtctcaggtatgaacagacactttgaaacgactttaggtctttcttttctccagtgttttaaacatgttgattatccaaagaattgaaactcctagcacatccagtttttacaacagatttgcagctcattccttaccctggttaggtcactacttttgcagattttgctggcactgatctggagatctgcagatctggaggagacgggaaggagtcgattcttaaataaggatcagtgaggcatcctgtcccaagctactgtttggtggggatctgggttcatctcacccacagagggaggatctttaagaggagaaaaaagccaagagggaaagccagagttccctgttctaggggactagccaaatgcctacatcagctgtcccctccctgttgtctccaagtaagtttgccagaaaaggttttagcaaagtgctacaactgtgtctttataggaggataggcctctgccctgccccacccccaccacctgtccccacccagtgtcccaggccacaggagcttattggccaggagggaataatgtcccccaatactgcctgttgagggaccagagttggggtctttggtgcttccaacctcctgccaacctggagttcacaacaccagagccccacggcctcgcacactgaagcaggggcgtgcggtgactcggtgcttctgttttggaagaaccacctgtcatcaaaacatggacagcagggtgttctcagctcccagcgaagcctccacaacagaatggggccacagggcagccgggactccctgtctcacctacattaacccatgcatactgtatgccataaactcactttggtatatccgcgtcacatgcagagaggaactctgcgacgtcaaagtgttgcttcttaaagtttcattattggcaactagagggttgtttttaatgcatggaaactaaacagattcctcggggagttcctgaaggaaccaggtgggcaaacctttgcttatatacatgcggcctcacctggaagagaaataaaccacttgtact

SEQ ID NO: 7748 - DNA, 3661 bp, Homo sapiens
accgtaagtgctgtgatgcactaacctctaggtgctagaaccctgcacggcactgagtaagtactccataaatgtctatcaacttagcaagttagtgagtgatgctctattgtggacccctgaggcagtggctcctgaaggaggacggggccaccggcagagcagggcactcagaggggtcccctgcccggggagcatgtgccagaggagggggacatccctaaggaacaggccagaggacctgagctctccctggctgctctggaaggcggaggccccccagtttatccagtccctagagcaccccaggccagatctggggtgcgcctggcttggaggccatgtccttgctgccgcctctcctggggcctgcgtctgctcccaccctgccgcatgggccttagcaatcacttagccaggccgtgctgtggggccaggtcctccagctcataagtggcagccgcctctcagctccatgcccttcccaccccatgtcttggcaggtgagcacctgcacccaaggctcacagatgcttcagcaccaacctcattctttagaaagagtttgggggaggcttcatagattgaacacccgtccctgtagcacttgatcatagcaagacaaaatgtaaaacagcagatgaggccatggtgtaacgaactcccacacacacagcctgcagctgccctggggcccaggatgctggcccccaaaggtctgtcccagaagaggcattcgggaataagagtaacagcatgcgctctgccccagtcacttttctgagcactttacttgcattgggtgaatagcattatcatctccatgtcacagatgaggcaaccggggcacaggaagaataagtaacttgtccaaggcaacagagctaggaaggggcagagccaggtttgaacccaggaggctggctccagactgtcctttgccacctgggagggagctcaaggggctggggtgatgggctcccggctcctcccagggccccgctgtcctgatacctgattttcctccaccccgtccctctctccctcactcaggccaccagtgacttctgtgtggctcctgacaccttcatcctgaacgtcacggagggccagatcagcacagaggtgactcgctactacctgtattgcagccagagtggaagcagccccttccagcagaccctgaccaccttccagcgcgcacttaccaccatgcagatccaggtcgcggggctgctgcagtttgccgtgcccctcttctccactgcagaggaagacctgcttgcaatccagctcctgctgaactcctcagagtccagccttcaccagctgaccgccatggtggactgccgagggctgcacaaggattatctggacgctcttgctggcatctgctacgacggcctccagggcttgctgtaccttggcctcttctccttcctggccgccctcgccttctccaccatgatctgtgcagggccaagggcctggaagcacttcaccaccagaaacagagactacgatgacattgatgatgatgacccctttaacccccaagcctggcgcatggcggctcacagtcccccgaggggacagcttcacagcttctgcagctacagcagtggcctgggaagtcagaccagcctgcagcccccggcccagaccatctccaacgcccctgtctccgagtacatgaaccaagccatgctctttggtaggaacccacgctacgagaacgtgccactaatcgggagagcctcccctccgcctacgtactctcccagcatgagagccacctacctgtctgtggcggatgagcacctgaggcactacgggaatcagtttccagcctaacagactttcgggggttcctgcctcctttttccgttctggtttttaattagtgcaaatacaagctgcgtttctttaatagaaaccaaaggcatctggagcccgagaggcctcctgctgtggcagaggagcagctgggattcccgaccaaagccccagggggtgcagaagactcaccacgcgggccagcctctctcttttgccctgctctccacaccagaaatgcccccaggtgcttggctgcctcagaggtaccatccctgagctggctgcctggccctgctcacccctacgcctcgcccttgccaggaggggagtggcagtgaggagggggccaggtcaggcaccaccatcaagagagctgtgtgttctctctggtcccacaacgatgactctgcctcttgtcagcccagccaagagcccagacgacccctctgtcctcgttccctgtcctcgttccctgcaggtaacatgagaagggctgatcaggagatgctctttaagaagttcgcacccctgctgacaccagaacagcccaaatcagagttcccagggccagacaggctcttcctgggccacagaggggaggcatcaggaaagctctgcagtggggggctggtggctccggggctgggggatcacaggctggtgaaccccggtgggaacagaggtgaaagcctgccacattccgcctgtctccctaaccctccattgcctcgcctctattccagaatcaatgctgcagaatgtgttagctgcagataggcatggtctcaggtatgaacagacactttgaaacgactttaggtctttcttttctccagtgttttaaacatgttgattatccaaagaattgaaactcctagcacatccagtttttacaacagatttgcagctcattccttaccctggttaggtcactacttttgcagattttgctggcactgatctggagatctgcagatctggaggagacgggaaggagtcgattcttaaataaggatcagtgaggcatcctgtcccaagctactgtttggtggggatctgggttcatctcacccacagagggaggatctttaagaggagaaaaaagccaagagggaaagccagagttccctgttctaggggactagccaaatgcctacatcagctgtcccctccctgttgtctccaagtaagtttgccagaaaaggttttagcaaagtgctacaactgtgtctttataggaggataggcctctgccctgccccacccccaccacctgtccccacccagtgtcccaggccacaggagcttattggccaggagggaataatgtcccccaatactgcctgttgagggaccagagttggggtctttggtgcttccaacctcctgccaacctggagttcacaacaccagagccccacggcctcgcacactgaagcaggggcgtgcggtgactcggtgcttctgttttggaagaaccacctgtcatcaaaacatggacagcagggtgttctcagctcccagcgaagcctccacaacagaatggggccacagggcagccgggactccctgtctcacctacattaacccatgcatactgtatgccataaactcactttggtatatccgcgtcacatgcagagaggaactctgcgacgtcaaagtgttgcttcttaaagtttcattattggcaactagagggttgtttttaatgcatggaaactaaacagattcctcggggagttcctgaaggaaccaggtgggcaaacctttgcttatatacatgcggcctcacctggaagagaaataaaccacttgtact

SEQ ID NO: 7749 - DNA, 4840 bp, Homo sapiens
cggcgaacaaagaggcggcgggcgcgggcggccgagcggagccgagcgcagccgagccgggccgagccgggccgggccgggcccaggagcgcgcggatgatgcgggcggccaggcgggggtcgacgggtccctgaagcccgcgccccgggccagcaagggagccccgcgcaggccgcgcgcatccggaggcggccgggccccgccatggccggggtcagctacgcggcgccctggtgggtgagcctcctgcaccggctgccccacttcgacctgagctgggaggccactagcagccagttccggcccgaggacaccgactaccagcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcagcgccggcatcgcagtgggattctacggcaacggggagaccagtgatggcatccatagggccacctactcgctccgccacgccaaccgcacggtggccggggtccaggaccgcgtgtgggacacggcggtggggctgaaccacacggcggagcccagcctgcagaccctggagcggcagctggccgggcggcccgagcccctgcgagccgtacagaggctgcagggcctgctggagacgctgctgggctacacggccgccatccccttttggaggaacacggcggtgtcgctggaggtgctggcggagcaggtggatctctacgactggtacaggtggctgggctacctgggcctgctgctgctggacgtcatcatctgcctcctggtgctggttggcctcatccgcagctccaagggcatcctggtgggggtctgcctgctgggagtcctggccctggtcatcagctggggcgcgctgggcttggagctggctgtgtccgtgggctccagcgacttctgtgtggaccctgacgcctacgtgaccaaaatggtggaggagtactcggtgctgagtggggacatcctgcagtactacctggcctgctcgccccgcgccgccaaccccttccagcagaagctgtcgggcagccacaaggcactggtggagatgcaggatgtcgtggctgagcttctgaggaccgtcccctgggagcagccggccactaaggaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcatacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgccaggcctgccccagacgcgtctgcaggccgcttgccctcctgtcccctccccgcaggggcacagtggagacgcaggggctctgggcccgtaccgccaactcgggtcacacctgaacgctgctgccagccgatgccccagccctgcacgccacccactatcccggcacgctccctctgcagatggtcgccgcacctacaagccctggccgcacccaacctgtgttgttgccgcccggcccttccctccacagctctccttcctcccgcccggcacttctgtggaccccttcttagttcacaggcacggctggggccgctctgtgctggcgcctgctggccactgagggacagggacacgtgccacctgctcatctctgccctgaggtcaccccgtggtccctccacgtgcccatctctctgcagtgccctcctcgcctgtgcagcccgcccacccacaggctcacccctcctgccggctgccagaggccccctccagcagggcctctctccgttgccccagcttcactctctccctcagcacctgccctgctggaggccccagccctccgtggacagcaggggccacgtggagcccgggccgctcacccgccacccagtgctggccgccttcttggtgccaaacccccttcccccacccagagactgggcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctcccccaccccagtgtgatttaacatccaggaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagcaa

SEQ ID NO: 7750 - DNA, 4263 bp, Homo sapiens
tttgctctcagcacctagtacatgaggcctgatgggcagggtgtggcccagggccactggaggtcacaggcagtggctggagttcccctaatgggagcctttctcaagaactgacaccagtccccatgacccagacgctctgaatgccctctggggtgccaggctgctggcctcagctccccctcaagggcccctggcgccccactcccaggccccgggtccctgtgccctggcgcactcccaggtttgcctgcaggtggctgggctacctgggcctgctgctgctggacgtcatcatctgcctcctggtgctggttggcctcatccgcagctccaagggcatcctggtgggggtctgcctgctgggagtcctggccctggtcatcagctggggcgcgctgggcttggagctggctgtgtccgtgggctccagcgacttctgtgtggaccctgacgcctacgtgaccaaaatggtggaggagtactcggtgctgagtggggacatcctgcagtactacctggcctgctcgccccgcgccgccaaccccttccagcagaagctgtcgggcagccacaaggcactggtggagatgcaggatgtcgtggctgagcttctgaggaccgtcccctgggagcagccggccactaaggaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcatacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgccaggcctgccccagacgcgtctgcaggccgcttgccctcctgtcccctccccgcaggggcacagtggagacgcaggggctctgggcccgtaccgccaactcgggtcacacctgaacgctgctgccagccgatgccccagccctgcacgccacccactatcccggcacgctccctctgcagatggtcgccgcacctacaagccctggccgcacccaacctgtgttgttgccgcccggcccttccctccacagctctccttcctcccgcccggcacttctgtggaccccttcttagttcacaggcacggctggggccgctctgtgctggcgcctgctggccactgagggacagggacacgtgccacctgctcatctctgccctgaggtcaccccgtggtccctccacgtgcccatctctctgcagtgccctcctcgcctgtgcagcccgcccacccacaggctcacccctcctgccggctgccagaggccccctccagcagggcctctctccgttgccccagcttcactctctccctcagcacctgccctgctggaggccccagccctccgtggacagcaggggccacgtggagcccgggccgctcacccgccacccagtgctggccgccttcttggtgccaaacccccttcccccacccagagactgggcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctcccccaccccagtgtgatttaacatccaggaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagc

SEQ ID NO: 7751 - DNA, 4537 bp, Homo sapiens
atggccggggtcagctacgcggcgccctggtgggtgagcctcctgcaccggctgccccacttcgacctgagctgggaggccactagcagccagttccggcccgaggacaccgactaccagcaggccctgctgctcctgggggccgccgccctggcctgcctcgccctggacctcctcttcctgctcttctactccttctggctgtgctgccggcggcgcaagagcgaggagcacctggacgccgactgctgctgcacggcctggtgtgtcatcatcgccacgctggtgtgcagcgccggcatcgcagtgggattctacggcaacggggagaccagtgatggcatccatagggccacctactcgctccgccacgccaaccgcacggtggccggggtccaggaccgcgtgtgggacacggcggtggggctgaaccacacggcggagcccagcctgcagaccctggagcggcagctggccgggcggcccgagcccctgcgagccgtacagaggctgcagggcctgctggagacgctgctgggctacacggccgccatccccttttggaggaacacggcggtgtcgctggaggtgctggcggagcaggtggatctctacgactggtacagggtctgcctgctgggagtcctggccctggtcatcagctggggcgcgctgggcttggagctggctgtgtccgtgggctccagcgacttctgtgtggaccctgacgcctacgtgaccaaaatggtggaggagtactcggtgctgagtggggacatcctgcagtactacctggcctgctcgccccgcgccgccaaccccttccagcagaagctgtcgggcagccacaaggcactggtggagatgcaggatgtcgtggctgagcttctgaggaccgtcccctgggagcagccggccactaaggaccccctcctccgcgtccaggaggtgctgaatggcacggaggtgaacctgcagcacctcaccgccctggtggactgccgcagcctgcatctggactacgtgcaagcgctgaccggcttctgctatgacggcgtggagggcctcatctacctggccctcttctccttcgtcacagccctcatgttcagctccatcgtctgcagcgtcccgcacacctggcagcaaaagagaggccctgatgaggacggggaggaggaggccgctccagggccgcggcaggcgcacgacagcctctaccgcgtccacatgcccagcctgtacagctgtggcagcagctacggcagtgagaccagcatcccggccgcggcccacaccgtcagcaacgccccggtcactgagtacatgagccagaacgctaatttccagaacccccgctgtgagaacaccccactcattgggcgcgagtccccgccgccctcatacacctccagcatgagagccaaatacctcgccacgagccagcctcgccctgactccagcggcagccactagaccgcgcccggcagccacccaccccacgtgccaacttcccctccccgtgccagcactgccgcttccacctgggccacccaccggaccctcgcacgccgtgccaggcctgccccagacgcgtctgcaggccgcttgccctcctgtcccctccccgcaggggcacagtggagacgcaggggctctgggcccgtaccgccaactcgggtcacacctgaacgctgctgccagccgatgccccagccctgcacgccacccactatcccggcacgctccctctgcagatggtcgccgcacctacaagccctggccgcacccaacctgtgttgttgccgcccggcccttccctccacagctctccttcctcccgcccggcacttctgtggaccccttcttagttcacaggcacggctggggccgctctgtgctggcgcctgctggccactgagggacagggacacgtgccacctgctcatctctgccctgaggtcaccccgtggtccctccacgtgcccatctctctgcagtgccctcctcgcctgtgcagcccgcccacccacaggctcacccctcctgccggctgccagaggccccctccagcagggcctctctccgttgccccagcttcactctctccctcagcacctgccctgctggaggccccagccctccgtggacagcaggggccacgtggagcccgggccgctcacccgccacccagtgctggccgccttcttggtgccaaacccccttcccccacccagagactgggcagctgtgtctggttcgttctttgcactaaccacatttgtcatctctagggcaggctggggctgcgggctgagggggaccgctggcaccccccttccctcccttcttggttccatttccatccatgacaggtacagcatcccaggagcccggcctgaggggctggacccgagccggctgtgaacatccctcagcccctgctgtccccccttgggactaaccactaacctcacccccaaactccacgggtgcccctagctggcccagagccggcagtgtgagcccaagtccgggctggagccgaggccggagcagctgtctgggagtcaaggctgcagtagcgtttcttcatggggtgctccagggggtgccacagaccgacaggcagcccaagggcctggacacccctccccaggcaggtgctgccccaggaggactgtcctcgggaatgaacctcccgcgggctttggactgaggtccctgtggcctcggtctcctccccatgaagtgggagcgaggctccccaatggtgcttttggctttagtgtacgatgtttgctgtgcttcccgccgtggagggcagagccaccccacatcaggatcggacgtgctacccctcccggtcccggccctggcccagccagcccagccctcgaggctcgatgcctgtgccaaggccaggggcagccagagggcagctggatggccacgtgcaggggtcaaggctgggccctgcagtggggcgggccgccagccccagcagtttacagacgcatggctcttcctcccagagcagccggcagctacctggaccggaaatgtcctcatcccctccctggggccaggctctgccctggccttcctctgtgaacccctcctttctttgtgctggtgtctgggaccaaaaagggggaatatgggagggcagagtggggaggggagtccatgggcctggggccccaagccggggcgtctgagctccccaggcatgaccaaacctcagtggaggggcctctgcttcaggccccgcctggctgacattctgagcccccctcggaggccccgccacagccaacctgcccagtctttcctctgggcttgacccgccaggggagttctccaggcctagggccaggagagaggccctggcaccctggcgtgggtgcccgccaaacgccctgcgaccgctcagaagcacaaatgctgtccatggccgtgaggctgcctgccaggtgaatggacatagcgtgagaggcggtgaggccagggcttccagcctcgtgctgtctcgggactcctgaccgtggtgtgcgtgtgtgcccgtctgtgactttctactcaccaaggttgaagaaaggaaacggggaaaatcaaaaggggttcaaaccccacctcagtaggtggaggggagcgcctgccattggttgtatttttgttctgagttttcggtgccgtgttcctaactactccatcccatgacctcgccacacctactggggcatctggctggtgcctgctgccatggccagcccccactctcaccctgcacagggggtcttgcagcccccaggcccacagcctcgttgggaggacagggtggccctggggacaagagggaggagcccaggggcttacctcactgagagtgctccccagcaggcatccactaccccagggccccccacatgtcatggcaaggttggtagtgaatgggcctggttgggagcagcccctggcccattgcccacccacccatctcactatgcaattcgagttccaagcaacatttgctcctgccctggggccagctctgccccagccctgagaggggtggtgaggcagccccctggaccccagaaccccagacaagggggcaggcgggggaccagggcctctcctgtgggatctttgttttgtgtttaaccataatggttgtgtactgaaccacttcatatttgttatatataatatatatatatataatctccttaagactcagcctcctggtttacccccccggcctgggcatctgacctcccccaccccagtgtgatttaacatccaggaactgaggcctgaaccattttgcatttccccctcctccagcctctgtagggccatggctgtatgtactgtcgctgtgtttttttgtttttttagaactgggtttgggggctgatttttatttctttgggggctttttttcttggcaaatactaaaaatctcgtcaatgtaatttctgtggtttctattcagcttgggtttcatgttttaaaataaattttaaaaagc

SEQ ID NO: 7752 - DNA, 722 bp, Homo sapiens
ggaagtgacgtaagagcagccagacctggagggcttgggtaaaaatggctgaatatttagcttcgatattcgggactgagaaggacaaggttaactgctctttttactttaagatcggggtctgccggcacggggaccggtgctcccggcttcacaacaagccgacattcagccaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatc

SEQ ID NO: 7753 - DNA, 780 bp, Homo sapiens
ggaagtgacgtaagagcagccagacctggagggcttgggtaaaaatggctgaatatttagcttcgatattcgggactgagaaggacaaggttaactgctctttttactttaagatcggggtctgccggcacggggaccggtgctcccggcttcacaacaagccgacattcagccaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacggtgagctgtctcctgtcactgacttccgggagtcatgctgtcgccagtatgagatgggggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggcatc

SEQ ID NO: 7754 - DNA, 747 bp, Homo sapiens
gggcttgggtaaaaatggctgaatatttagcttcgatattcgggactgagaaggacaaggttaactgctctttttactttaagatcggggtctgccggcacggggaccggtgctcccggcttcacaacaagccgacattcagccaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacgggaatgtacccgaggtggcttctgcaacttcatgcatctgcggcccatttcccagaacctccagaggcagctctatgggcggggacccaggcgcaggtacctcaggaccagcctgctatgtctcctcatgtcctaaggcccctatatcctcagatgagcctaaccctaagccccagtaaccacgttcccaagaattttttttttttttttttttttgagatggagcctcactctgttgcccaggctggagtgcattggcaccatcttggttcatggcaacttccgcctcccgggttcaagcaattctctgcctcagcctcccaaatagctgggattacaggcacctgccaccatgcccggctaatttttgtgtttttagtagagatggggtttcaccatcttggccaggctggtctgaactcctaa

SEQ ID NO: 7755 - DNA, 864 bp, Homo sapiens
gggcttgggtaaaaatggctgaatatttagcttcgatattcgggactgagaaggacaaggttaactgctctttttactttaagatcggggtctgccggcacggggaccggtgctcccggcttcacaacaagccgacattcagccagaccatagtgctgctcaacctgtaccggaatccacagaacacagcccaaactgcagacggatcacactgtcatgtgagtgacgtggaggtgcaggagcactatgatagcttcttcgaggaggtgttcacagaactgcaggagaagtatggggagattgaagagatgaatgtgtgcgacaaccttggggaccacctcgtgggcaacgtctatgtcaagttccggagggaggaggatggagagcgggccgtggctgaactcagtaaccgctggttcaacgggcaggctgtgcacggtgagctgtctcctgtcactgacttccgggagtcatgctgtcgccagtatgagatgggggaatgtacccgaggtggcttctgcaacttcatgcatctgcggcccatttcccagaacctccagaggcagctctatgggcggggacccaggcgcaggtcacccccgaggttccatactggccaccatccccgagagaggaaccatcggtgttcccctgatcactggcatggccgcttctgaggccctggcccccttacccttcacccccaacagggacagatgttcctggcaggacctctcctcaaagcccccttcactctcctgccccatccttcccaggctcccgggctccataatgtaatctgttcagcatggagaccttcttctaccgcccctgtcttaataaagctgcgtgtttcacttcggc

SEQ ID NO: 7756 - DNA, 2525 bp, Homo sapiens
atgttcaccagcaccggctccagtgggctctgtgagtaccggcctccgccatcctggctgccccctacacgccaccctaggcacctctttgaggaggctggggcagcggggaccctcgggtttgccggaggtggtggggccgaccctccagacccgcgtccgaaccctgctagttcccggtcttgggggtcagcggaaaccgcccccatttcggcctggaggggcgaatggggacaaagccccgccgcccgccccgaccccacctggtatccccaggtgctctgcccaggagtctcttggggccgctgcaagtgggcaggtgccctggtgttctcgtgggccggccccaggccctttgcggagcgtgtgccgcgctgaaggaaggggccgtcccccttaccatgccccattcttttaggcttgggggaccgaactaactccccccgcccccacttgcaaagttcagcctccgctttagaagctgacctctcagtttcacttggatgtgtttcttcttcagtctccaagaagagtttttagacaaacacacactgatgagagtgctttcaagtggagggaagttaggaagtcgtggcgagggagcgcagctgtgctgctggatgttgctgttttcctggcgtgttagcggtggtcagcagacaaggcgcctctgtcgaagagccttctgctggtccccagtgccctctccctcctgctcgccctcctcctgcctcactgccagaagctctttgtgtatgaccttcacgcagtcaagaacgacttccagcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttctatctatattttttattgggcattttccctaggttggagagtcagcactcgttttgaatgtgtttaaaatgcattaaaatggaagatttctgcaggcagttgaatggcactccagatggggaattgctgtaaccctcttactgtaacatgtcatctcctgcgtcgtgatggggagagggtaatgttacttcacaaaggacatgtcagatccttcttcatggacttttttagttactgttttttctctcaaacttgttttcgaatctcctgggagtgagggagaaacagggagctgaatcctcccccaagctgttccaggccagaggactctgcagtaccttctcctacatctagtaacaaagaatggtgataaccatgcactggttcaaggttctggagttctccatgaaacttgggttaattttgctcagagtatccagagttagccactaggctgcgggtgaaatgggatggagaagaacaacagcaggcttcctggagccacatgggctgactagggcactctgtggctggcctggcatgggctcagcccaggaagaggagaaacgatcccttgcctgcccctccctgtggcagggctaactgcctggccctcctggctcgcagccagccagccccctggcagcaggttctcctcagggcttgggtcttcaacctgtggcgacaggaggcagggcagactgtggaggacaggatgcaggtcagggagagggaaggcaggggtggaccgccatgagcatgaaaagacccgaagcaagttgactcttgcaatgtgcaactgttatgttctgcaaaatgagcaacgatgtatcaaattgatgcaaatttagatgttgatacttacaataaagtttttaatgtgtttt

SEQ ID NO: 7757 - DNA, 1375 bp, Homo sapiens
ccgttcgtcagcggcgagtggcctcgcggcgccggattcgtcgctccgccaagagtgcgcctgcgcggtcgctggggctcgcacttcagcttcccctcccccggcgccctctggggctccgagcccggcgggaccatgttcaccagcaccggctccagtgggctctacaaggcgcctctgtcgaagagccttctgctggtccccagtgccctctccctcctgctcgccctcctcctgcctcactgccagaagctctttgtgtatgaccttcacgcagtcaagaacgacttccagatttggaggttgatatgtggaagaataatttgccttgatttgaaagatactttctgcagtagtctgcttatttataattttaggatatttgaaagaagatatggaagcagaaaatttgcatcctttttgctgggttcctgggttttgtcagccttatttgactttctcctcattgaagctatgcagtatttctttggcatcactgcagctagtaatttgccttctggattcctggcacctgtgtttgctctgtttgtaccattttactgctccataccaagagtccaagtggcacaaattctgggtccgttgtccatcacaaacaagacattgatttatatattgggactgcagcttttcacctctggttcctacatctggattgtagccataagtggacttatgtccggtctgtgctacgacagcaaaatgttccaggtgcatcaggtgctctgcatccccagctggatggcaaaattcttttcttggacacttgaacccatcttctcttcttcagaacccaccagcgaagccagaattgggatgggagccacgctggacatccagagacagcagagaatggagctgctggaccggcagctgatgttctctcagtttgcacaagggaggcgacagagacagcagcagggaggaatgatcaattggaatcgtctttttcctcctttacgtcagcgacaaaacgtaaactatcagggcggtcggcagtctgagccagcagcgccccctctagaagtttctgaggaacaggtcgcccggctcatggagatgggattttccagaggtgatgctttggaagccctgagagcttcaaacaatgacctcaatgtcgccaccaacttcctgctgcagcactgatagtcccaggccaacactgggaccggaccggcagccgagtgacagtgcgtggtccccaccatcagatcagcccggggaccgagcatctctggtgctgatgttcttgtgggaagagggaggttccaccgcacccctgccctcaaccgcaagactgttgccgttttagtgtggagataagtttgccattacattagcatgtattttc

SEQ ID NO: 7758 - DNA, 916 bp, Homo sapiens
gcggtggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttgagacctgcttctacattggttgctttgttaactctacctgatcttcacttgtcagtaatttgagaccacttcaaagccctctgcaaacaccccaaaggcagaatctgctattttgagttttccattaacttccaaagaattctggttttcaaaacaggagccagagttggagatattacagtcaactttggcttctaagccagtaattccattcttaaatacctcactgtcttggccatggggaagcactatggcctcagctgggggaaagaccctggcctaggggtcttagccactccccaccctagggtatagttcaggggtatccaatcctttggcttccctgggccatgttggaagaattgtcttgggccacacataaaatacagtaaccatagctgatgagctaaaacaaaaaacaatggtttgtgcaaaaatctcataatgttttaataaagttgaagaatttg

SEQ ID NO: 7759 - DNA, 448 bp, Homo sapiens
gcaggcgcggtggcgcgagttggactgtgaagaaacatggcggccgcgacgttgacttcgaaattgtactccctgctgttccgcaggcctccaccttcgccctcaccatcatcgtgggcgtcatgttcttcgagcgcgccttcgatcaaggcgcggacgctatctacgaccacatcaacgaggggaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgccc

SEQ ID NO: 7760 - DNA, 584 bp, Homo sapiens
ggcgcgagttggactgtgaagaaacatggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgagggggtgagggcctgtgccatccctgaccttggacccgcctgaggggtgacagtggagtagagaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttgagacctgcttctacattggttgctttgttaactctacctgatcttcacttgtcagtaatttgagaccacttcaaagccctctgc

SEQ ID NO: 7761 - DNA, 473 bp, Homo sapiens
atggcggccgcgacgttgacttcgaaattgtactccctgctgttccgcaggacctccaccttcgccctcaccatcatcgtgggcgtcatgttcttcgagcgcgccttcgatcaaggcgcggacgctatctacgaccacatcaacgagggggtgagggcctgtgccatccctccttggacccgcctgaggggtgacagtggagtagagaagctgtggaaacacatcaagcacaagtatgagaacaagtagttccttggaggcccccatccaggccagaaggaccaggtccacccagcagctgtttgcccagagctggagcctcagcttgaagatgatgctcaaggtactcttcatggaccaccattcgctgttggcaagaaacggctttacttacaaaacagactctttaccttctgctgtgtttgaagtatgtttagtcagcatgctcaggaaataaatgtgaattgcccttg

SEQ ID NO: 7762 - DNA, 1335 bp, Homo sapiens
cgcgccgcggccgcgcctgcgcagtgtagccgggtcagctggacagggtcatcctgagggtgcgactccgccgcgatggtgacccggttcctgggcccacgctaccgggagctggtcaagaactgggtcccgacggcctacacatggggcgctgtgggcgccgtggggctggtgtgggccaccgattggcggctgatcctggactgggtaccttacatcaatggcaagtttaagaaggataattaattacacaaacccttcacagactgctctggtgcctggtggtgctagctcctcccacctcagcacctgctgcatctggagcagcccaagcctcaggatggacaagaggaaacccacagctcagcttcaggcttcttatgtttctgaaaacagcttggatattttaatgcacgttgcattaaacctcactgaaacctgctccgtgcccggatgttgatcatgctggtggcttggttactgtgactgtagctggagtggcacaggtgacccaggcgtcctttcagctccagaatgttgcaagtctaggagagtgttccaatggctgacagaaactgcctatttgaaatggctcataagtagtatctgcagtgtgttcatccgttgctgccttaacaagtcacccacacgtagtggcttaaagcaacgaacattcactctctcacagtctgtgtcagtcggggatttgggagtgatgtatctgggtggttgtggcccagagtctctcatgaggttgcagttaagacatcagccaaggccacttcgtctgaggaaggctcaactggggctggagccacttccaagccagtgccctcacgtggctgtcggtgacagccacagttccttcccatgggggcccctacacgaagctgcttgagcatcctcacggcatggcctctgccttccccagagcaggtgaaccaagggagaggaaggagcaagccacagtgcttctatgagccaccctgagaagtctcacgtgatcacttccgccacagcctgtttatcaaaagcaagccccccaggcccagcccacgtgcagagggaggagaatgaggttctgtgttttgaagggaagaatatcagaattggtagacatttcaaactgtcacattagggatacaaaaatgaacaggctgggagtggtggctcagcctacaatcccaacactttgggaggctgaggaaggggcatcacttgaaccaggagttcagtactaacctgggcaacaaagaggcccctgtctctgataaaaagaaaaaaaatgaaaaaataaaaatgaacaggtataaaaagagaatatggtacaaagtc

SEQ ID NO: 7763 - DNA, 15861 bp, Homo sapiens
gaagatggcgacgagcggcggcgaagaggcggcggcagcggctccggcgccggggaccccggcaacgggggcggacacgaccccgggctgggaggtggctgtgcggcccctgctgtccgcgtcctactccgccttcgagatgaaggagttgccgcagctggtggcctcagtcatcgagagtgaatcagaaatcctgcaccatgagaagcagtacgagccattctactcatcttttgttgcactttccacacactatattacaacagtttgcagtctcattccccggaaccaacttcagtcagtggcagcagcctgtaaagttctaattgagttttctctcctgcgtctggagaatccagatgaggcttgtgctgtgtcccagaaacacttgattctcctaatcaagggcctgtgcactggctgtagccgactagatagaactgaaattatcacatttacagcaatgatgaaatccgccaagctgccccaaacagtgaagacactttcagacgtggaagatcagaaagagctggcctcaccagtaagccctgagttgaggcaaaaggaggtacagatgaattttttgaaccagctgacctcagtttttaaccctagaactgtagcatcacaacctatcagtacacagactctggtggaaggagaaaatgatgagcagtcatctacagatcaagcctcagctatcaaaaccaagaatgtgttcatagctcagaacgtggctagtcttcaagagcttggtggctcggagaagctactgcgtgtatgtttgaacctgccatatttcctacgctatatcaatcggttccaagatgcagttttagctaattccttcttcataatgcctgcaacagtagcagatgccactgctgttcgtaatggctttcattcattggtgattgatgtaactatggcattggataccctttctctacctgtgttggaacctctcaatccttctcgtctacaagatgtgacagtcctcagcctaagttgtctgtatgcaggtgtgagtgtggcaacgtgcatggccatcctccatgtgggtagtgcccagcaagtgcggacagggtccacgagctccaaagaagatgactatgaaagtgacgcagctacaattgtccagaaatgtctcgaaatctatgacatgattggacaagcaatcagcagttctcgccgggctggtggtgagcactatcagaatttccaattgctgggtgcttggtgcttgttaaacagccttttcctcatactgaacctcagtcctactgcgttggctgataaggggaaagagaaggacccactggctgccctccgagtcagagacatcctttctcgtactaaagagggagtgggctcccctaaactggggcctggaaaagggcatcagggatttggggtactctcagtaatattggcaaaccatgccatcaaactgctaacgtctctctttcaagacctacaagtggaggcccttcacaagggttgggagacagatggcccccctgcagccttgagcattatggcccagagcacctccatacagaggattcaacggctgattgactctgtcccactgatgaacctgctcttgacgttactttcaacttcctacagaaaggcatgtgtcctgcagcggcagaggaagggctccatgagcagcgatgccagcgcctccaccgactccaatacttactatgaggacgatttcagtagcacggaggaggacagcagccaagacgatgacagtgagcctattttggggcaatggtttgaggagactatttctcccagtaaagagaaagcagcacctccgcctcctcccccacctcctccactggaaagctctcctcgggttaaaagccccagtaagcaggcccctggtgagaagggcaacattctggcgagtcgcaaagatcctgagttgttcttaggtctggcttccaacattttgaacttcatcacctcttccatgctgaactctcggaacaattttatccgaaactatctgagtgtatctctttcagaacaccatatggccaccctagccagtatcatcaaggaggtggacaaagatggactcaagggttcatcagatgaagagtttgctgcagctctctatcacttcaaccactcactggtaacctctgaccttcagtcacctaacctgcagaacacactgttgcagcagctaggagtggctcctttttctgagggcccttggcccttgtacattcaccctcaaagcctctctgtgctttcacgcctcctgctcatctggcaacataaagccagtgctcaaggtgaccctgacgtcccagaatgccttaaagtttgggacaggtttttgtctacaatgaagcagaatgccctgcaaggtgtggtgcccagtgagacagaggatctgaatgtagaacacctgcagatgctcctcctcattttccacaatttcaccgagacaggccggcgggccatattgtcgctttttgtccagatcatccaggagttgagcgtcaacatggatgctcagatgcgcttcgtgccgcttatcttggctcgcctccttctcatctttgattatctgcttcatcagtactccaaagcccctgtgtatctatttgagcaggtacagcataacctgctaagtcctccctttgggtgggcaagtggatcccaggacagcaacagccgccgggcaaccactcctctctatcatggattcaaagaagtagaagaaaactggtctaagcatttctcatcagatgctgtcccacaccccagattctactgtgtcctgtccccagaagcctcagaggatgatttgaaccgacttgattctgtggcatgtgacgtccttttctccaagcttgtcaagtatgatgagctttatgctgcactgacagccctgcttgcagctgggtcccagcttgatacagttaggagaaaggaaaacaagaatgtaacagccttggaggcctgtgcccttcaatattacttcttgatactgtggaggatcctaggaattttaccaccatcaaagacttacattaaccagctatccatgaactcacctgagatgagcgaatgtgacatcttgcacactctgcgatggtcttctcggctccggatcagctcctatgtcaactggataaaggatcaccttatcaaacagggaatgaaggctgagcatgctagctcgcttctagaactggcatccaccactaagtgtagctcagtgaaatatgatgttgaaatagtagaggaatacttcgctcgacagatctcatccttctgtagtatcgactgtaccaccatcttgcagctgcatgaaattcccagtctgcagtccatctacacccttgatgccgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctgtgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgttgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaagcgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagatggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccatgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaaggaa

SEQ ID NO: 7764 - DNA, 4031 bp, Homo sapiens
cctgtgggaagctcagtcagcattctgaggagttatttgcatggtgataggctcttacataggaattgacaagcgcctgagagaagagcgaatctgcctagttgagattccaatcccctccatgtaggccagggtcttgcaaatagaaggtactcaaaatgtcattgctgagttcagggtttggtgagtagtaatgtagaaaggtctgtatagcctgggcaacatagtgagacttcatctcttaaaaaaaaatttaaaaaagttagccaggcgtggtggcgtgtacctgtggtcccagctgctggggaggctgaggcaggaggatggcttggggccagaagttcgagggtgcaatgaactgtgatccacgccactgcactccagcctgggtgacagagtgagaccctgtctcaaaaaaaaaaaaaaaaaaaggtctttagtttcaagggtttaagttaaataaggtgaaacaaatttaaagaaaatgtcttcctttttttaaaaaaacttctaaaagaggatattggttaaattgacagtttattatttctctggtttagtagtgactgttctttaaaaaaaatttaaaaaaactttattgagataatttatgtattaacctattttaaatgtacagttcaatgatttttagtaaatttaattgtgactcttgagtcaaattttactactttttagaattcctctgaaggatagatcaaagattaggaaacatctaaggtcagttagttgaaatttctttcctgtggcttcgtaaccctattgggatttctcctgtgtccttgagttctcactagggtggggctcactttgggctcactttggctcacattgagccatggctttgtcatgatttttttgtgaaactcagtgcttcctaagatgaaaatgtgttcatgctaagactggtttcttccttagcactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggtagtcccacgctgcaaagggcatttggataagggcttgggtcttgatcagaagactgcctcctaggtgagatcaccttaggtggggagcctgacagcttacctcttggggttgcaggatgactcaggaacagcagggggcatcagctccacttctgccagtgtgaatcgttacatcctgcagttggctcaggagtattgtggagactgcaagaactcttttgatgaactctccaaaatcatccaggtagagagcggggagcagcttttgggtgtgttttgtccaagtgttactggtgttgttttcacagcagtcctgctgctctctcatctagcagtccaggtcttggtgttgtccctgcccaatctagctgaaaaggcaggcagatggctgcaccaaacggcatctcccccaccgtgatttatggcgctggtcagaatgctgagttcatgctagataactgaacatactggtgatgggaaggtaacacagataagggttttttttagccattaacaacccatctcttagtagaggggttactggtcttaaaaaatttgatgccaagattctgttccctcttctgataacgccgtgtttgcaggctgtagggtaagggcataccaactgcaatcaaccagggtgggccttgtgtcagttgcaatgtcacagacctaatctccatgagatgggaggctggccatagacagaggtacctcatataaggagagcatccagtttaccttccccctcaaccccaaattgctggagtgccatctttgctacacgtgtattagcttctgacctttgtctttgttacatgggagttaagagcataagcctgccatctgagtctgagttctgactctgccacttatcttggtcaagccactttctccaagcttcagtttccttctctgtaaaatggagataaagcatctaaccagttgggttattgagaagattaagttatataatgcatgtaaagttttttctaaagcaaaactaattttctaattaacatcctcttcttattttaattgctaattcccattattgttgcctttttgttcttagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcggtcagtacctacaccatggttatgggcctagtggttcctactgacactggcagccatgccaggagcgttagagagtgcacagaatagtgcttctgaccacccagcaagttaggtagcttataacaaaggaaagatggaaagagacacagggtgtaggtgagcgagcttggggagcattgaaacccaggtttccttgtaaatggcatgattggcttgtgcttttttggttccagtacagtgtcttgaggaaactctccctgaggccttgtgagggaagggaagggagacacttgaactcgagaaagactcacatgaaagaagcagagcagtggggcctggagattaagagcttggactctggattggaaaggctcagtttcagtatctgataccttgtactatacgccttggacagattccttaatttctctgagtctgtgttttcctcatctgaaaaatactgacagtaggctgggcacagtggctcttgcccgtaatcccagcactttggcacctgaggctggcagatcacttgaggtcaggagttcaagaccagcctggccaacatggtaaaacctcgtctccattaaaaatacaaaaatagggccaggtgctgtggctcatgcctgtaatcccagcactttggcaggccaaggcgggtggatcacctgaggtcgggagttcaagaccagcctgaccaacatggagaaaccccatctccactgaaaatacaaaattagacaggtgtagtggtgcatgcctgtaatctcagctacttgggaggctgagacaggagaatcgcttgaacctgggaggcggagattgtggtgagtcgaaatcgtgccattgcactccagcctgggcaacaagcgagactccgtctc

SEQ ID NO: 7765 - DNA, 3475 bp, Homo sapiens
ttttatgacttcattgtatttattatgtagctgtagcaaactcttgggagcatttggactgtttacagtttttaagcaatcccttaccagcgctgtgactgttggcttcctggaaaggagttctgcaagggttcgattaagaagatgtaactacagagtgtctggtgctgcaagctcctgggacagtggtggaggtaactggtatccttggcagtgatatcacactgactgcacttgtcatcctgtttaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaagcgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagatggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccatgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattg

SEQ ID NO: 7766 - DNA, 1533 bp, Homo sapiens
cactgagtctggtgtggtcatcatcatcatcatcattgcaacttaggacgcatgaggacaagaagcagcgctcatctggaagaggctgttctaacgaaggcgggaggatcctagatcagaagaagacaaaccggaagagggagcctaggaaaggaaccacatgcacatttagtgcaaaccatgtaaacataacataacaagactatgtggagcaagggggagtcaggctgtggacccaccagggaatcttgattcatgtttttggccccatcactcactagcttgctgactttgggcaagtcacttcacttttctgggcctctggagttactagcacagttccatgttggggagattgtgaacgtccctgatatatggtgctcaggaaccagtagttgcttggaattgtattagagctggggtaggagctagacatggggccagggaagaagggaagatgccgcgaagaagggcctggaaggggacgaagggcgtggattatcagaggaagtgggagtagtcggcaaggatgggtggggagtgttgagtcatccaagcgttcagcaaatgtcacaagacaacgacaaattgagcaaattcttcctgctcttgctgccgggtcctgcttccaccctgcttttattttatcatgccgcttttcttctagaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaa

SEQ ID NO: 7767 - DNA, 15810 bp, Homo sapiens
gaagatggcgacgagcggcggcgaagaggcggcggcagcggctccggcgccggggaccccggcaacgggggcggacacgaccccgggctgggaggtggctgtgcggcccctgctgtccgcgtcctactccgccttcgagatgaaggagttgccgcagctggtggcctcagtcatcgagagtgaatcagaaatcctgcaccatgagaagcagtacgagccattctactcatcttttgttgcactttccacacactatattacaacagtttgcagtctcattccccggaaccaacttcagtcagtggcagcagcctgtaaagttctaattgagttttctctcctgcgtctggagaatccagatgaggcttgtgctgtgtcccagaaacacttgattctcctaatcaagggcctgtgcactggctgtagccgactagatagaactgaaattatcacatttacagcaatgatgaaatccgccaagctgccccaaacagtgaagacactttcagacgtggaagatcagaaagagctggcctcaccagtaagccctgagttgaggcaaaaggaggtacagatgaattttttgaaccagctgacctcagtttttaaccctagaactgtagcatcacaacctatcagtacacagactctggtggaaggagaaaatgatgagcagtcatctacagatcaagcctcagctatcaaaaccaagaatgtgttcatagctcagaacgtggctagtcttcaagagcttggtggctcggagaagctactgcgtgtatgtttgaacctgccatatttcctacgctatatcaatcggttccaagatgcagttttagctaattccttcttcataatgcctgcaacagtagcagatgccactgctgttcgtaatggctttcattcattggtgattgatgtaactatggcattggataccctttctctacctgtgttggaacctctcaatccttctcgtctacaagatgtgacagtcctcagcctaagttgtctgtatgcaggtgtgagtgtggcaacgtgcatggccatcctccatgtgggtagtgcccagcaagtgcggacagggtccacgagctccaaagaagatgactatgaaagtgacgcagctacaattgtccagaaatgtctcgaaatctatgacatgattggacaagcaatcagcagttctcgccgggctggtggtgagcactatcagaatttccaattgctgggtgcttggtgcttgttaaacagccttttcctcatactgaacctcagtcctactgcgttggctgataaggggaaagagaaggacccactggctgccctccgagtcagagacatcctttctcgtactaaagagggagtgggctcccctaaactggggcctggaaaagggcatcagggatttggggtactctcagtaatattggcaaaccatgccatcaaactgctaacgtctctctttcaagacctacaagtggaggcccttcacaagggttgggagacagatggcccccctgcagccttgagcattatggcccagagcacctccatacagaggattcaacggctgattgactctgtcccactgatgaacctgctcttgacgttactttcaacttcctacagaaaggcatgtgtcctgcagcggcagaggaagggctccatgagcagcgatgccagcgcctccaccgactccaatacttactatgaggacgatttcagtagcacggaggaggacagcagccaagacgatgacagtgagcctattttggggcaatggtttgaggagactatttctcccagtaaagagaaagcagcacctccgcctcctcccccacctcctccactggaaagctctcctcgggttaaaagccccagtaagcaggcccctggtgagaagggcaacattctggcgagtcgcaaagatcctgagttgttcttaggtctggcttccaacattttgaacttcatcacctcttccatgctgaactctcggaacaattttatccgaaactatctgagtgtatctctttcagaacaccatatggccaccctagccagtatcatcaaggaggtggacaaagatggactcaagggttcatcagatgaagagtttgctgcagctctctatcacttcaaccactcactggtaacctctgaccttcagtcacctaacctgcagaacacactgttgcagcagctaggagtggctcctttttctgagggcccttggcccttgtacattcaccctcaaagcctctctgtgctttcacgcctcctgctcatctggcaacataaagccagtgctcaaggtgaccctgacgtcccagaatgccttaaagtttgggacaggtttttgtctacaatgaagcagaatgccctgcaaggtgtggtgcccagtgagacagaggatctgaatgtagaacacctgcagatgctcctcctcattttccacaatttcaccgagacaggccggcgggccatattgtcgctttttgtccagatcatccaggagttgagcgtcaacatggatgctcagatgcgcttcgtgccgcttatcttggctcgcctccttctcatctttgattatctgcttcatcagtactccaaagcccctgtgtatctatttgagcaggtacagcataacctgctaagtcctccctttgggtgggcaagtggatcccaggacagcaacagccgccgggcaaccactcctctctatcatggattcaaagaagtagaagaaaactggtctaagcatttctcatcagatgctgtcccacaccccagattctactgtgtcctgtccccagaagcctcagaggatgatttgaaccgacttgattctgtggcatgtgacgtccttttctccaagcttgtcaagtatgatgagctttatgctgcactgacagccctgcttgcagctgggtcccagcttgatacagttaggagaaaggaaaacaagaatgtaacagccttggaggcctgtgcccttcaatattacttcttgatactgtggaggatcctaggaattttaccaccatcaaagacttacattaaccagctatccatgaactcacctgagatgagcgaatgtgacatcttgcacactctgcgatggtcttctcggctccggatcagctcctatgtcaactggataaaggatcaccttatcaaacagggaatgaaggctgagcatgctagctcgcttctagaactggcatccaccactaagtgtagctcagtgaaatatgatgttgaaatagtagaggaatacttcgctcgacagatctcatccttctgtagtatcgactgtaccaccatcttgcagctgcatgaaattcccagtctgcagtccatctacacccttgatgccgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagagttctgaaactgagtccctaaccaagctggaccggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctgtgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgttgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaagcgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagatggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccatgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaaggaa

SEQ ID NO: 7768 - DNA, 15906 bp, Homo sapiens
ggagggagccgcagtagtacgacggaagatggcgacgagcggcggcgaagaggcggcggcagcggctccggcgccggggaccccggcaacgggggcggacacgaccccgggctgggaggtggctgtgcggcccctgctgtccgcgtcctactccgccttcgagatgaaggagttgccgcagctggtggcctcagtcatcgagagtgaatcagaaatcctgcaccatgagaagcagtacgagccattctactcatcttttgttgcactttccacacactatattacaacagtttgcagtctcattccccggaaccaacttcagtcagtggcagcagcctgtaaagttctaattgagttttctctcctgcgtctggagaatccagatgaggcttgtgctgtgtcccagaaacacttgattctcctaatcaagggcctgtgcactggctgtagccgactagatagaactgaaattatcacatttacagcaatgatgaaatccgccaagctgccccaaacagtgaagacactttcagacgtggaagatcagaaagagctggcctcaccagtaagccctgagttgaggcaaaaggaggtacagatgaattttttgaaccagctgacctcagtttttaaccctagaactgtagcatcacaacctatcagtacacagactctggtggaaggagaaaatgatgagcagtcatctacagatcaagcctcagctatcaaaaccaagaatgtgttcatagctcagaacgtggctagtcttcaagagcttggtggctcggagaagctactgcgtgtatgtttgaacctgccatatttcctacgctatatcaatcggttccaagatgcagttttagctaattccttcttcataatgcctgcaacagtagcagatgccactgctgttcgtaatggctttcattcattggtgattgatgtaactatggcattggataccctttctctacctgtgttggaacctctcaatccttctcgtctacaagatgtgacagtcctcagcctaagttgtctgtatgcaggtgtgagtgtggcaacgtgcatggccatcctccatgtgggtagtgcccagcaagtgcggacagggtccacgagctccaaagaagatgactatgaaagtgacgcagctacaattgtccagaaatgtctcgaaatctatgacatgattggacaagcaatcagcagttctcgccgggctggtggtgagcactatcagaatttccaattgctgggtgcttggtgcttgttaaacagccttttcctcatactgaacctcagtcctactgcgttggctgataaggggaaagagaaggacccactggctgccctccgagtcagagacatcctttctcgtactaaagagggagtgggctcccctaaactggggcctggaaaagggcatcagggatttggggtactctcagtaatattggcaaaccatgccatcaaactgctaacgtctctctttcaagacctacaagtggaggcccttcacaagggttgggagacagatggcccccctgcagccttgagcattatggcccagagcacctccatacagaggattcaacggctgattgactctgtcccactgatgaacctgctcttgacgttactttcaacttcctacagaaaggcatgtgtcctgcagcggcagaggaagggctccatgagcagcgatgccagcgcctccaccgactccaatacttactatgaggacgatttcagtagcacggaggaggacagcagccaagacgatgacagtgagcctattttggggcaatggtttgaggagactatttctcccagtaaagagaaagcagcacctccgcctcctcccccacctcctccactggaaagctctcctcgggttaaaagccccagtaagcaggcccctggtgagaagggcaacattctggcgagtcgcaaagatcctgagttgttcttaggtctggcttccaacattttgaacttcatcacctcttccatgctgaactctcggaacaattttatccgaaactatctgagtgtatctctttcagaacaccatatggccaccctagccagtatcatcaaggaggtggacaaagatggactcaagggttcatcagatgaagagtttgctgcagctctctatcacttcaaccactcactggtaacctctgaccttcagtcacctaacctgcagaacacactgttgcagcagctaggagtggctcctttttctgagggcccttggcccttgtacattcaccctcaaagcctctctgtgctttcacgcctcctgctcatctggcaacataaagccagtgctcaaggtgaccctgacgtcccagaatgccttaaagtttgggacaggtttttgtctacaatgaagcagaatgccctgcaaggtgtggtgcccagtgagacagaggatctgaatgtagaacacctgcagatgctcctcctcattttccacaatttcaccgagacaggccggcgggccatattgtcgctttttgtccagatcatccaggagttgagcgtcaacatggatgctcagatgcgcttcgtgccgcttatcttggctcgcctccttctcatctttgattatctgcttcatcagtactccaaagcccctgtgtatctatttgagcaggtacagcataacctgctaagtcctccctttgggtgggcaagtggatcccaggacagcaacagccgccgggcaaccactcctctctatcatggattcaaagaagtagaagaaaactggtctaagcatttctcatcagatgctgtcccacaccccagattctactgtgtcctgtccccagaagcctcagaggatgatttgaaccgacttgattctgtggcatgtgacgtccttttctccaagcttgtcaagtatgatgagctttatgctgcactgacagccctgcttgcagctgggtcccagcttgatacagttaggagaaaggaaaacaagaatgtaacagccttggaggcctgtgcccttcaatattacttcttgatactgtggaggatcctaggaattttaccaccatcaaagacttacattaaccagctatccatgaactcacctgagatgagcgaatgtgacatcttgcacactctgcgatggtcttctcggctccggatcagctcctatgtcaactggataaaggatcaccttatcaaacagggaatgaaggctgagcatgctagctcgcttctagaactggcatccaccactaagtgtagctcagtgaaatatgatgttgaaatagtagaggaatacttcgctcgacagatctcatccttctgtagtatcgactgtaccaccatcttgcagctgcatgaaattcccagtctgcagtccatctacacccttgatgccgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctgtgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgttgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaagcgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagatggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccatgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaaggaa

SEQ ID NO: 7769 - DNA, 15945 bp, Homo sapiens
gaagatggcgacgagcggcggcgaagaggcggcggcagcggctccggcgccggggaccccggcaacgggggcggacacgaccccgggctgggaggtggctgtgcggcccctgctgtccgcgtcctactccgccttcgagatgaaggagttgccgcagctggtggcctcagtcatcgagagtgaatcagaaatcctgcaccatgagaagcagtacgagccattctactcatcttttgttgcactttccacacactatattacaacagtttgcagtctcattccccggaaccaacttcagtcagtggcagcagcctgtaaagttctaattgagttttctctcctgcgtctggagaatccagatgaggcttgtgctgtgtcccagaaacacttgattctcctaatcaagggcctgtgcactggctgtagccgactagatagaactgaaattatcacatttacagcaatgatgaaatccgccaagctgccccaaacagtgaagacactttcagacgtggaagatcagaaagagctggcctcaccagtaagccctgagttgaggcaaaaggaggtacagatgaattttttgaaccagctgacctcagtttttaaccctagaactgtagcatcacaacctatcagtacacagactctggtggaaggagaaaatgatgagcagtcatctacagatcaagcctcagctatcaaaaccaagaatgtgttcatagctcagaacgtggctagtcttcaagagcttggtggctcggagaagctactgcgtgtatgtttgaacctgccatatttcctacgctatatcaatcggttccaagatgcagttttagctaattccttcttcataatgcctgcaacagtagcagatgccactgctgttcgtaatggctttcattcattggtgattgatgtaactatggcattggataccctttctctacctgtgttggaacctctcaatccttctcgtctacaagatgtgacagtcctcagcctaagttgtctgtatgcaggtgtgagtgtggcaacgtgcatggccatcctccatgtgggtagtgcccagcaagtgcggacagggtccacgagctccaaagaagatgactatgaaagtgacgcagctacaattgtccagaaatgtctcgaaatctatgacatgattggacaagcaatcagcagttctcgccgggctggtggtgagcactatcagaatttccaattgctgggtgcttggtgcttgttaaacagccttttcctcatactgaacctcagtcctactgcgttggctgataaggggaaagagaaggacccactggctgccctccgagtcagagacatcctttctcgtactaaagagggagtgggctcccctaaactggggcctggaaaagggcatcagggatttggggtactctcagtaatattggcaaaccatgccatcaaactgctaacgtctctctttcaagacctacaagtggaggcccttcacaagggttgggagacagatggcccccctgcagccttgagcattatggcccagagcacctccatacagaggattcaacggctgattgactctgtcccactgatgaacctgctcttgacgttactttcaacttcctacagaaaggcatgtgtcctgcagcggcagaggaagggctccatgagcagcgatgccagcgcctccaccgactccaatacttactatgaggacgatttcagtagcacggaggaggacagcagccaagacgatgacagtgagcctattttggggcaatggtttgaggagactatttctcccagtaaagagaaagcagcacctccgcctcctcccccacctcctccactggaaagctctcctcgggttaaaagccccagtaagcaggcccctggtgagaagggcaacattctggcgagtcgcaaagatcctgagttgttcttaggtctggcttccaacattttgaacttcatcacctcttccatgctgaactctcggaacaattttatccgaaactatctgagtgtatctctttcagaacaccatatggccaccctagccagtatcatcaaggaggtggacaaagatggactcaagggttcatcagatgaagagtttgctgcagctctctatcacttcaaccactcactggtaacctctgaccttcagtcacctaacctgcagaacacactgttgcagcagctaggagtggctcctttttctgagggcccttggcccttgtacattcaccctcaaagcctctctgtgctttcacgcctcctgctcatctggcaacataaagccagtgctcaaggtgaccctgacgtcccagaatgccttaaagtttgggacaggtttttgtctacaatgaagcagaatgccctgcaaggtgtggtgcccagtgagacagaggatctgaatgtagaacacctgcagatgctcctcctcattttccacaatttcaccgagacaggccggcgggccatattgtcgctttttgtccagatcatccaggagttgagcgtcaacatggatgctcagatgcgcttcgtgccgcttatcttggctcgcctccttctcatctttgattatctgcttcatcagtactccaaagcccctgtgtatctatttgagcaggtacagcataacctgctaagtcctccctttgggtgggcaagtggatcccaggacagcaacagccgccgggcaaccactcctctctatcatggattcaaagaagtagaagaaaactggtctaagcatttctcatcagatgctgtcccacaccccagattctactgtgtcctgtccccagaagcctcagaggatgatttgaaccgacttgattctgtggcatgtgacgtccttttctccaagcttgtcaagtatgatgagctttatgctgcactgacagccctgcttgcagctgggtcccagcttgatacagttaggagaaaggaaaacaagaatgtaacagccttggaggcctgtgcccttcaatattacttcttgatactgtggaggatcctaggaattttaccaccatcaaagacttacattaaccagctatccatgaactcacctgagatgagcgaatgtgacatcttgcacactctgcgatggtcttctcggctccggatcagctcctatgtcaactggataaaggatcaccttatcaaacagggaatgaaggctgagcatgctagctcgcttctagaactggcatccaccactaagtgtagctcagtgaaatatgatgttgaaatagtagaggaatacttcgctcgacagatctcatccttctgtagtatcgactgtaccaccatcttgcagctgcatgaaattcccagtctgcagtccatctacacccttgatgccgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggcagcagcagcagtgccctgggcctgcagagcctgggactgtccggccaggcacccagctcttcctctctggacgcaggaaccctctctgacaccacagcatcagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctgtgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgttgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaagcgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagatggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccatgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaacaaacaaccccaactgtgggagggattgacactggcagcctggagccttgtgtctgtgagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattgaaaaggaa

SEQ ID NO: 7770 - DNA, 6175 bp, Homo sapiens
ctggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagagttctgaaactgagtccctaaccaagctggaccggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctgtgcggcagcaaggtgctcgctgcactggcagcctcttcgggatcctccagtgcttcttcctcctcagcccctgtggctgccagttctggacaagccacaacacagtccaagtcttccactaaaaagagcaagaaag

SEQ ID NO: 7771 - DNA, 5583 bp, Homo sapiens
aggtttttgtctacaatgaagcagaatgccctgcaaggtgtggtgcccagtgagacagaggatctgaatgtagaacacctgcagatgctcctcctcattttccacaatttcaccgagacaggccggcgggccatattgtcgctttttgtccagatcatccaggagttgagcgtcaacatggatgctcagatgcgcttcgtgccgcttatcttggctcgcctccttctcatctttgattatctgcttcatcagtactccaaagcccctgtgtatctatttgagcaggtacagcataacctgctaagtcctccctttgggtgggcaagtggatcccaggacagcaacagccgccgggcaaccactcctctctatcatggattcaaagaagtagaagaaaactggtctaagcatttctcatcagatgctgtcccacaccccagattctactgtgtcctgtccccagaagcctcagaggatgatttgaaccgacttgattctgtggcatgtgacgtccttttctccaagcttgtcaagtatgatgagctttatgctgcactgacagccctgcttgcagctgggtcccagcttgatacagttaggagaaaggaaaacaagaatgtaacagccttggaggcctgtgcccttcaatattacttcttgatactgtggaggatcctaggaattttaccaccatcaaagacttacattaaccagctatccatgaactcacctgagatgagcgaatgtgacatcttgcacactctgcgatggtcttctcggctccggatcagctcctatgtcaactggataaaggatcaccttatcaaacagggaatgaaggctgagcatgctagctcgcttctagaactggcatccaccactaagtgtagctcagtgaaatatgatgttgaaatagtagaggaatacttcgctcgacagatctcatccttctgtagtatcgactgtaccaccatcttgcagctgcatgaaattcccagtctgcagtccatctacacccttgatgccgcgatctcaaaggtccaggtctctttggatgagcatttttctaagatggctgctgagactgatcctcataagtcgtctgagattaccaagaacctacttccagccacgctgcaactcattgacacctatgcatcgttcaccagagcctatttgctgcaaaactttaatgaagagggaacaactgagaaaccttccaaggagaaactgcaaggctttgctgctgttttggctattggctctagcaggtgcaaggcaaatactctgggtccgacactggttcagaatttgccatcgtcagtgcagactgtgtgtgagtcctggaacaacatcaataccaatgaatttcccaatattggatcctggcgcaatgcctttgccaatgacaccatcccttcagagagttatattagtgcagtgcaggctgcacacctggggactctctgtagccaaagtctgcccctggctgcttccctgaagcataccctcctctcactggtcaggttgactggagatcttattgtttggtcagatgagatgaacccaccacaggtaattcggacactgctacctcttcttttggaatcaagcactgagagtgttgccgagatcagtagcaactccctggaacgcatcttgggccctgctgagtctgatgagttcttggctcgtgtttatgagaagctgatcactggttgttacaacattctggccaatcatgcagatcctaacagtggactggatgaatccatcctggaggaatgtctccagtacttggaaaagcagctggaaagtagccaggctcgtaaagctatggaggagtttttctctgacagtggagaacttgtacagatcatgatggcaacagccaatgagaacctctctgctaaattctgtaaccgagttttgaaattcttcaccaaactcttccagctgactgagaagagccctaacccgagcctgttgcatctctgtggctccctggcacaactggcctgtgtggaacctgtgcgcctgcaggcctggctcacccgcatgactacatcgcccccaaaagattctgatcagctggatgtaattcaggagaaccggcagctgctgcagttactgaccacatacattgttcgggaaaacagccaagttggggaaggtgtgtgtgctgttcttctgggcaccctgactcccatggcaacagagatgctggccaacggtgatgggactggcttccctgaacttatggttgtgatggccactctggccagtgcaggtcaaggtgctggtcaccttcagcttcataatgctgctgtggattggctgagcagatgcaagaaatacctgtcacagaagaatgtagttgaaaaactgaatgccaatgtaatgcatggaaagcatgtgatgatcttggagtgcacatgccatatcatgtcttacttggctgatgtcacgaatgccctgagccagagtaatggtcaaggcccaagtcatctctcagtggatggggaagagcgggccattgaagtagactcagactgggtggaggagttggcggtggaagaggaagattcccaggctgaggattcagatgaagattctctttgcaataaactctgcacttttacgatcacacagaaagaattcatgaaccagcattggtaccactgtcacacctgtaaaatggtggatggcgtgggtgtctgcacagtgtgtgctaaggtgtgccacaaggatcatgagatttcctatgccaagtatggatccttcttctgtgactgtggagccaaggaagatggcagctgtttggctctggtgaagagaactcctagcagtggcatgagctctaccatgaaggagtcggcatttcagagtgaacccaggatttcagagagtctagtgcgtcatgccagcacctcctcgccagctgacaaagccaaggttaccatcagtgatggaaaggttgctgacgaagagaagcccaagaagagcagcctctgccgcacagtagagggctgccgggaggaattacagaaccaggccaatttctccttcgctcctctcgtgttagacatgcttaatttccttatggatgccattcagaccaacttccagcaagcttcagccgtcgggagcagcagccgtgctcagcaagccctcagtgagctacacactgtggagaaggcagtggagatgacagaccagctgatggttcccaccttagggtcccaggaaggtgcctttgagaatgtgcggatgaattacagtggagaccagggccagaccatccggcagctgatcagtgctcatgtgctcaggcgggtggctatgtgtgtgctctcctctccccatgggcgccgccaacatttggctgtcagccatgagaagggcaagatcaccgttctgcagctctctgcactcctgaagcaagcagattccagcaaaaggaagttaactctgacccgcttggcttctgccccagttccttttactgtgttgagcctcacaggaaatccctgcaaggaagactacttggcggtttgtgggctaaaggactgtcatgtgctcacctttagtagctcaggctctgtttcggatcacttggttttgcaccctcagttggcaacggggaacttcatcatcaaagccgtgtggttacctggttcacagaccgagttagcaattgtcaccgcagactttgttaagatttatgacctgtgtgttgatgccttgagtccaaccttctattttctcctgccaagctcaaagataagagatgttaccttccttttcaatgaggagggaaagaacatcattgttataatgtcttcggctgggtacatctatactcagcttatggaagaggccagcagtgcccagcagggacccttctatgtcactaatgtgttggaaatcaatcatgaggacctgaagcaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaagttccaatggtggcagtaagacttctcctgctctttgccagtggtctgaggtgatgaaccaccctggcttggtgtgctgtgtccagcaaactacaggggtgccgctggtagttatggtgaaaccagacacttttcttatccaggagattaagactcttcctgctaaagcgaagatccaagacatggttgctattaggcacacggcctgcaatgagcagcagcggacaacaatgattctgctgtgtgaggatggcagcctgcgcatttacatggccaacgtggagaacacctcctactggctgcagccatccctgcagcccagcagtgtcatcagcatcatgaagcctgttcgaaagcgcaaaacagctacaatcacaacccgcacgtctagccaggtgactttccccattgacttttttgaacacaaccagcagctgacagatgtggagtttggtggtaacgacctcctacaggtctataatgcacaacagataaaacaccggctgaattccactggcatgtatgtggccaacaccaagcccggaggcttcaccattgagattagtaacaacaatagcactatggtgatgacaggcatgcggatccagattgggactcaagcaatagaacgggccccgtcatatatcgagatcttcggcagaactatgcagctcaacctgagtcgctcacgctggtttgacttccccttcaccagagaagaagccctgcaggctgataagaagctgaacctcttcagtgagtcaccaacccctggtgcagactctgtcctcattgtgactgcgaaattgggagccactggcctgtggctgtccaacattctgggatctctccactctgctgatttttctgtcctttcatcaggaaactttgagcttcatttgatgtattaaagaggcaaggtgacaggaaaggagtacaccggagcatggtagcagtaaagatagggctgcactgtgttgagtattcatttcaatagtgttgtgtccacctcactaatggggctacttctgtgtttaggccgagaggaggcagattgacatgaaattgcaaggctttcttaacgcacagaggaagacctcaggtcacacatggctgagagatggttggcaatggcttgctatgccactgaaaactaaactctcagaatacaaatccttgagccttactcaagactgcatttctctgtcatttattggccactgtctgatattctttcttctagatatagttgctgttagtgtgaatgatcatgatctgtactttgaacaaagaaagtgtgtagagacccctgggagtgaggggtaggggatacaatactctgaagcagaagaggacccttgcagtgatggttagggactcttctgagtaggagacgtaatcggcttttggtccatggaacttttaccacatgtattcagcatatatacacgattaaagtgctgcaaatatctcag

SEQ ID NO: 7772 - DNA, 2954 bp, Homo sapiens
gacttccccttcaccagagaagaagccctgcaggctgataagaagctgaacctcttcattggggcctcggtggatccagcaggtgtcaccatgatagatgctgtaaaaatttatggcaagactaaggagcagtttggctggcctgatgagcccccagaagaattcccttctgcctctgtcagcaacatctgcccttcaaatctgaaccagagcaacggcactggagatagcgactcagctgcccccactacgaccagtggaactgtcctggagaggctggttgtgagttctttagaagccctggaaagctgctttgccgttggcccaatcatcgagaaggagagaaacaagaatgctgctcaggagctggccactttgctgttgtccctgccagcacctgccagtgtccagcagcagtccaagagccttctggccagcctgcacaccagccgctcggcctaccacagccacaaggatcaggccttgctgagcaaagctgtgcagtgtctcaacacatctagcaaagagggcaaggatttggaccctgaggtgttccagaggctagtgatcacagctcgctccattgccatcatgcgccccaacaaccttgtccactttacggagtcaaagctgccccagatggaaacagactgtttttttcctagatgtgcctgctggagtctagggatagttggcatattgattggggccccacttgaaactccctccccagaaggaatggatgaagggaaggaaccgcagaagcagttggaaggagattgctgtagtttcatcacccagcttgtgaaccacttctggaaactccatgcatccaaacccaagaatgccttcttggcacctgcctgccttccaggactaactcatattgaagctactgtcaatgctctggtggacatcatccatggctactgtacctgtgagctggattgtattaacacagcatccaagatctacatgcagatgctcttgtgtcctgatcctgctgtgagcttctcttgtaaacaagctctaattcgagtcctaaggcccaggaacaaacggagacatgtgactttaccctcttcccctcgaagcaacactccaatgggagacaaggatgatgatgacgatgatgatgcagatgagaaaatgcagtcatcagggatcccgaatggtggtcacatccgtcaggaaagccaggaacagagtgaggtggaccatggagattttgagatggtgtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaagctccagcctcagacgacgagggcagtacagcagcgacagatggttctacccttcggacctctcctgctgaccacggtggtagtgtgggctcggagagcgggggcagtgcagtggactcagtggctggcgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctgtgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaa

SEQ ID NO: 7773 - DNA, 2507 bp, Homo sapiens
ttagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctgggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaagcgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagatggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccatgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattg

SEQ ID NO: 7774 - DNA, 2584 bp, Homo sapiens
accaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaagcgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagatggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccatgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaag

SEQ ID NO: 7775 - DNA, 4559 bp, Homo sapiens
agcttggcgctccgcctccctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagagggagcttgtgaagaccctcatgatctcttggctactcccactccagagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcggaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacattggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccaggcttcccggatttggcaggagctggaggctgaggaggagccggtgcctgaggggtctgggcccctgggtccctgggggccccaagactgggtgggccccctaccacgtggccctaccacaccagatgagggctgcctccggtactttgtcctgggcaccgtggcggctttggtggccctcgtgctcaacgtgttctatcctctggtatcccagagtcgctggagatgagctcgcctgcaggcagctgctgtgagctggcctacctgcctgccccaggccatgcctgcctttgttgtggggaacacctctgggctttgggcctcagcttatgcatctggtgggagagggtggggaggttgtggcccctgcaggggcagagtatcctagggtgtgtatccatctggctgtctgtccattcatcctgctgctctgacccttggcctcaggcttggccctgcccaagctacttcctgtacttaaaagtgttaataaaaccagactattcaggccc

SEQ ID NO: 7776 - DNA, 1903 bp, Homo sapiens
ggaaccggaacggagagcgggttgccagggcccgaagagggctggctgcggcggtctcgctcggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagaggagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctgaagaaacctctagggacccaggagctggtgccggggctgcggtgccaggagaatgggcaggaactgtctcccattgccctggagccaggccctgagccccaccgggctaagcaggaggcccggaaccagaagcgggcccagggccgtggtgaggtaggcgcaggggctggccccggggcccaggcagggcccagcgccaagagggctgtgcatctctgcagagggccagagggggacgggtccagggatgaccctggaccccggggtgatgccccacccttcgtggctgacccagccacccaggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggcctggaggccccggctgcacgaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgt

SEQ ID NO: 7777 - DNA, 4706 bp, Homo sapiens
cggagagcgggttgccagggcccgaagagggctggctgcggcggtctcgctcggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagagggagcttgtgaagaccctcatgatctcttggctactcccactccagagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctgaagaaacctctagggacccaggagctggtgccggggctgcggtgccaggagaatgggcaggaactgtctcccattgccctggagccaggccctgagccccaccgggctaagcaggaggcccggaaccagaagcgggcccagggccgtggtgaggtaggcgcaggggctggccccggggcccaggcagggcccagcgccaagagggctgtgcatctctgcagagggccagagggggacgggtccagggatgaccctggaccccggggtgatgccccacccttcgtggctgacccagccacccaggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcggaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacattggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccagggactaggccctggccaggcccccgaggtggcccccacgcggacagcccctgaacgcttcgccccccctgtggatcggccagcccccacctacagcaacatggaggaggtggattagcaggtccctggctgatgggggggactgggtttgggacacccacacagagggccagctccttgccgcttctccttctctaacccagaggacactggctctgtcaatgggaagctgaggggtatgatttgggtgtggagacctctcaggttgggacttcttgtcagcttggacccctgaccagtgggctttggcttctccagccgcctccagtgctgcgtgatttgattctgttgtaccttcaattcttctgacccgcattataaacattataattttattctaaaaattgtaattttttttgcattttggaagtgactgctgctgtttaaatatattttaaaaataaataataagtaagtaga

SEQ ID NO: 7778 - DNA, 4677 bp, Homo sapiens
accgacctgcgccggaaccggaacggagagcgggttgccagggcccgaagagggctggctgcggcggtctcgctcggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagagggagcttgtgaagaccctcatgatctcttggctactcccactccagagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctgaagaaacctctagggacccaggagctggtgccggggctgcggtgccaggagaatgggcaggaactgtctcccattgccctggagccaggccctgagccccaccgggctaagcaggaggcccggaaccagaagcgggcccagggccgtggtgaggtaggcgcaggggctggccccggggcccaggcagggcccagcgccaagagggctgtgcatctctgcagagggccagagggggacgggtccagggatgaccctggaccccggggtgatgccccacccttcgtggctgacccagccacccaggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcggaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacattggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccaggcttcccggatttggcaggagctggaggctgaggaggagccggtgcctgaggggtctgggcccctgggtccctgggggccccaagactgggtgggccccctaccacgtggccctaccacaccagatgagggctgcctccggtactttgtcctgggcaccgtggcggctttggtggccctcgtgctcaacgtgttctatcctctggtatcccagagtcgctggagatgagctcgcctgcaggcagctgctgtgagctggcctacctgcctgccccaggccatgcctgcctttgttgtggggaacacctctgggctttgggcctcagcttatgcatctggtgggagagggtggggaggttgtggcccctgcaggggcagagtatcctagggtgtgtatccatctggctgtctgtccattcatcctgctgctctga

SEQ ID NO: 7779 - DNA, 4719 bp, Homo sapiens
agcttggcgctccgcctccctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagagggagcttgtgaagaccctcatgatctcttggctactcccactccagagttgttgctcgattggaggcagagtgcagaagaggtgattgtcaagcttcgtgtgggagtaggtcccctgcagctggaggatgtagatgctgctttcacagatacagactgtgtggtgcggtttgcaggtggtcagcagtggggtggtgtcttctatgctgagataaaaagctcttgtgctaaagtgcaaacccgcaagggcagtctcctgcacctgacactgcccaaaaagaagaaacctctagggacccaggagctggtgccggggctgcggtgccaggagaatgggcaggaactgtctcccattgccctggagccaggccctgagccccaccgggctaagcaggaggcccggaaccagaagcgggcccagggccgtggtgaggtaggcgcaggggctggccccggggcccaggcagggcccagcgccaagagggctgtgcatctctgcagagggccagagggggacgggtccagggatgaccctggaccccggggtgatgccccacccttcgtggctgacccagccacccaggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatgagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccagggatggaaacttcctgaggctgcacccgggctgtgggccccacaccaccttccgttggcaggtgaagctcaggaatctgattgagccagagcagtgcaccttctgtttcacggcttctcgcatcgacatctgccttcgtaagaggcagagtcagcgctgggggggcctggaggccccggctgcacgagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcgcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatgaccgctcctttgaggctgagatcaactacaacaacccactagggactggtgggcgtctggccattggctttgccgtgctgcttcgggcgctgtggaagggcacccaccatgccttccagccttccaagttgaaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtggtagctgaggaagcatggcagcggcacaagatgaggaatgactctttcatcgtggacctatttcaggggcagtacaagtcgaagctggtgtgccctgtgtgtgccaaggtctccatcacttttgacccgtttctttatctgccggtgcccttgccacaaaagcaaaaggttctccctgtcttttattttgcccgagagccccacagcaagcccatcaagttcctggtgagcgtcagcaaggagaactccactgcgagcgaagtattggactccctctctcagagtgttcatgtgaagcctgagaacctgcgtttggcggaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacagcgcccccaggtgcccagcgtccccatctccaagtgtgcagcctgccagcggaagcaacagtcggaggatgaaaagctgaagcgctgtacccggtgctaccgtgtgggctactgcaaccagctctgccagaaaacccactggcctgaccacaagggcctctgccgacctgagaacattggctaccccttcctggtcagtgtacctgcctcacgcctcacttatgcccgcctcgctcagttgctagagggctatgcccggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaagctgctgtgcctgggtaccagcatccaagtgaagctatgaatgcccacacaccccagttcttcatctataaaattgattcatccaaccgagagcagcggctagaggacaaaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccagggactaggccctggccaggcccccgaggtggcccccacgcggacagcccctgaacgcttcgccccccctgtggatcggccagcccccacctacagcaacatggaggaggtggattagcaggtccctggctgatgggggggactgggtttgggacacccacacagagggccagctccttgccgcttctccttctctaacccagaggacactggctctgtcaatgggaagctgaggggtatgatttgggtgtggagacctctcaggttgggacttcttgtcagcttggacccctgaccagtgggctttggcttctccagccgcctccagtgctgcgtgatttgattctgttgtaccttcaattcttctgacccgcattataaacattataattttattct

SEQ ID NO: 7780 - DNA, 4243 bp, Homo sapiens
aatgcaaatcgggaaaagggggtgagctgggctggcttccgtcctggtagccaaggctaattctccctcgagttcttgggagatgggcatttggcgagaaggctggcgttagtgaagcgcgcccggcgtcacggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggattatttccattcaatacttggacctggaaacatcaaaaaagctgtcgaagaagctgaaagactctctgaaagccttaaattaagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaagagcaatggtgaaaagaatgaaaaatgtgagaccaaagagaaaggagcaatcacagcaaaggaactatacacaatgatgacggataaaaacatcagcttgattataatggatgctcgaagaatgcaggattatcaggattcctgtattttacattctctcagtgttcctgaagaagccatcagtccaggagtcactgctagttggattgaagcacacctgccagatgattctaaagacacatggaagaagagggggaatgtggagtatgtggtacttcttgactggtttagttctgccaaagatttacagattggaacaactctccggagtctgaaagatgcacttttcaagtgggaaagtaaaactgtcctgcgcaatgagcctttggttttagagggaggctatgaaaactggctcctttgttatccccagtatacaacaaatgctaaggtcactccacccccacgacgccagaatgaagaggtgtctatctcattggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacagattgatcgtactaaaaaaccagcagtcaaattgcctgaagagcatagaataaaatctgaaagtacaaaccatgagcagcaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaacttcgggaaaggcagcaagaggaacagaaagagaaactgaggaaggaagaacaagaacaaaaagccaaaaagaaacaagaagctgaagaaaatgaaattacagagaagcaacaaaaagcaaaagaagaaatggagaagaaagaaagtgaacaggccaagaaagaagataaagaaacctcagcaaagaggggcaaagaaataacaggagtaaaaagacaaagtaaaagtgaacatgaaacttctgatgccaagaaatctgtagaagatagggggaaaaggtgtccaaccccagaaatacagaaaaagtcaacaggagatgtgccccatacatctgtgacaggggattcaggttcaggcaagccatttaagattaaaggacaaccagaaagtggaattctaaggacaggaacttttagagaggatacagacgataccgaaagaaataaagctcaacgagaacctttgacaagagcacgaagtgaagaaatggggaggatcgtaccaggactgccttcaggctgggccaagtttcttgacccaatcactggaacctttcgttattatcattcacccaccaacactgttcatatgtacccaccggaaatggctccttcatctgcacctccttccacccctccaactcataaagccaagccacagattcctgctgagcgggatagggaaccttccaaactgaagcgctcctactcctccccagatataacccaggctattcaagaggaagagaagaggaagccaacagtaactccaacagttaatcgggaaaacaagccaacatgttatcctaaagctgagatctcaaggctttctgcttctcagattcggaacctcaatcctgtttttggaggttctggaccagctcttactggacttcgtaacttaggaaatacttgttatatgaactcaatattgcagtgcctatgtaacgctccacatttggctgattatttcaaccgaaactgttatcaggatgatattaacaggtcaaatttgttggggcataaaggtgaagtggcagaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggtctccatgaagatctaaataaagctgataatcggaagagatataaagaagaaaataatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctaccactagcatccacaagtaaatgtacattacaggattgccttagattattttccaaagaagaaaaactcacagataacaacagattttactgcagtcattgcagagctcgacgggattctctaaaaaagatagaaatctggaagttaccacctgtgcttttagtgcatctgaaacgtttttcctacgatggcaggtggaaacaaaaattacagacatctgtggacttcccgttagaaaatcttgacttgtcacagtatgttattggtccaaagaacaatttgaagaaatataatttgttttctgtttcaaatcactacggtgggctggatggaggccactacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatcttttttttttccttttcactgttatggccttttcacatttctaaatcccatcttgatatactatgaatactctagaatgatgtaaagcagataggaatgtatgtgtacatatttattgcatacttgcacatcaaatcgatgtacatagtttaacacgtggtccttttgtgaaacctagaactcagaggattgctttttttctttcagcctattttgagttaacttcagtgctttcttagggaaatgacagggcaaagcaatttttctgttggctttgggctgtatttgtgcactaaatctttattctaaaaaaaaaaatggaaactttaatttttttaaaacgagaatttcatttacagctacattaaaatcttaatgagaaaaataa

SEQ ID NO: 7781 - DNA, 2987 bp, Homo sapiens
cttactggacttcgtaacttaggaaatacttgttatatgaactcaatattgcagtgcctatgtaacgctccacatttggctgattatttcttaacaggtaaatacatgtcaaatttgttggggcataaaggtgaagtggcagaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggtctccatgaagatctaaataaattccaggctgataatcggaagagatataaagaagaaactgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctaccactagcatccacaagtaaatgtacattacaggattgccttagattattttccaaagaagaaaaactcacagataacaacagattttactgcagtcattgcagagctcgacgggattctctaaaaaagatagaaatctggaagttaccacctgtgcttttagtgcatctgaaacgtttttcctacgatggcaggtggaaacaaaaattacagacatctgtggacttcccgttagaaaatcttgacttgtcacagtatgttattggtccaaagaacaatttgaagaaatataatttgttttctgtttcaaatcactacggtgggctggatggaggccactacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatcttttttttttccttttcactgttatggccttttcacatttctaaatcccatcttgatatactatgaatactctagaatgatgtaaagcagataggaatgtatgtgtacatatttattgcatacttgcacatcaaatcgatgtacatagtttaacacgtggtccttttgtgaaacctagaactcagaggattgctttttttctttcagcctattttgagttaacttcagtgctttcttagggaaatgacagggcaaagcaatttttctgttggctttgggctgtatttgtgcactaaatctttattctaaaaaaaaaaatggaaactttaatttttttaaaacgagaatttcatttacagctacattaaaatcttaatgagaaaaataatttataaccctgtgggtgttctgtctttaatattgtattatcaaatataggacagtaaaaccatagattttatatacacacgtgctatataataacacccagagtcattctttcaagactagtattctcacatattgagaatattcattctaaatattaaagtaaaaatgccgggagtcaggcatgattgcaaagtgaactgcattataaactacatctttacagagtgatgtattaagagggttaaaggagcttataatttatttaaccgagggactcagttgctatatatatagtcagtaaaacactccatataaaaataagattctaaaagtgcttcagaaagagaccaccattagcaggctctcagggagaagatgaaaggatggggttcaaattgtgaagctgacaacttttcatgttttacaattagtctaagagaccacttcttggctaaattattatatcaaatatattcaaatcatattcttaaactcatcgagccatttgaacaaaaattatttttgtttagcttcatgagtatctttggaaaataatttgttgaatatatatgattatgagatattttctgataaacactgaattttgaaacctgaactcactatataattgcagtgttttgaaggcctgcatccattagcattgcattatattcacactgccttttttagtgaaccaagacccatcttctggacgacagatttatcttaagatgaaaggttgtataacatgcccacaaggcataaaaatgttaatgatgcaagtaagttctaagagtttaatgaccaagcaaaactctaccaccagatgctgactgcttgttttgcagtgttcaggaaacaccattttcctggctcttaacgcttttgtattggtatggaaaagggctggcagctatagaacaggagatccatagcattttgaacagaagtatctggaatctcactgactcgtgtgttatcaaagctatatcaggcctgggtgactgaattcttgcagaaagcagtgtagtggccaccatccaaatcaccaaaatggttctatgggagaaaggaatgtcaaacttagtattcacatatgaacactaactactggaacagaaatgatagggccaagagatgctttttaaattgtcccttattctaaattaaaaggaagtgataattttgttgttaaatcatgcatatagcctgactgctatattgcttctcatttcattgtaactacttatatgttgtgcccattgactatcatctgtgaataaagaaagacaatatttagc

SEQ ID NO: 7782 - DNA, 5690 bp, Homo sapiens
aatgcaaatcgggaaaagggggtgagctgggctggcttccgtcctggtagccaaggctaattctccctcgagttcttgggagatgggcatttggcgagaaggctggcgttagtgaagcgcgcccggcgtcacggtgagtgcgggtcttgggccctagcacctgttctctgggaagtcgtccgctgtgaacgatgaacgcctttccttccaccagctgctggttaccccggagacaagctctgtccgcggagaggagtgggacaactcctaaaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggattatttccattcaatacttggacctggaaacatcaaaaaagctgtcgaagaagctgaaagactctctgaaagccttaaattaagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaagagcaatggtgaaaagaatgaaaaatgtgagaccaaagagaaaggagcaatcacagcaaaggaactatacacaatgatgacggataaaaacatcagcttgattataatggatgctcgaagaatgcaggattatcaggattcctgtattttacattctctcagtgttcctgaagaagccatcagtccaggagtcactgctagttggattgaagcacacctgccagatgattctaaagacacatggaagaagagggggaatgtggagtatgtggtacttcttgactggtttagttctgccaaagatttacagattggaacaactctccggagtctgaaagatgcacttttcaagtgggaaagtaaaactgtcctgcgcaatgagcctttggttttagagggaggctatgaaaactggctcctttgttatccccagtatacaacaaatgctaaggtcactccacccccacgacgccagaatgaagaggtgtctatctcattggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacagattgatcgtactaaaaaaccagcagtcaaattgcctgaagagcatagaataaaatctgaaagtacaaaccatgagcagcaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaacttcgggaaaggcagcaagaggaacagaaagagaaactgaggaaggaagaacaagaacaaaaagccaaaaagaaacaagaagctgaagaaaatgaaattacagagaagcaacaaaaagcaaaagaagaaatggagaagaaagaaagtgaacaggccaagaaagaagataaagaaacctcagcaaagaggggcaaagaaataacaggagtaaaaagacaaagtaaaagtgaacatgaaacttctgatgccaagaaatctgtagaagatagggggaaaaggtgtccaaccccagaaatacagaaaaagtcaacaggagatgtgccccatacatctgtgacaggggattcaggttcaggcaagccatttaagattaaaggacaaccagaaagtggaattctaaggacaggaacttttagagaggatacagacgataccgaaagaaataaagctcaacgagaacctttgacaagagcacgaagtgaagaaatggggaggatcgtaccaggactgccttcaggctgggccaagtttcttgacccaatcactggaacctttcgttattatcattcacccaccaacactgttcatatgtacccaccggaaatggctccttcatctgcacctccttccacccctccaactcataaagccaagccacagattcctgctgagcgggatagggaaccttccaaactgaagcgctcctactcctccccagatataacccaggctattcaagaggaagagaagaggaagccaacagtaactccaacagttaatcgggaaaacaagccaacatgttatcctaaagctgagatctcaaggctttctgcttctcagattcggaacctcaatcctgtttttggaggttctggaccagctcttactggacttcgtaacttaggaaatacttgttatatgaactcaatattgcagtgcctatgtaacgctccacatttggctgattatttcaaccgaaactgttatcaggatgatattaacaggtcaaatttgttggggcataaaggtgaagtggcagaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggtctccatgaagatctaaataaagctgataatcggaagagatataaagaagaaaataatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctaccactagcatccacaagtaaatgtacattacaggattgccttagattattttccaaagaagaaaaactcacagataacaacagattttactgcagtcattgcagagctcgacgggattctctaaaaaagatagaaatctggaagttaccacctgtgcttttagtgcatctgaaacgtttttcctacgatggcaggtggaaacaaaaattacagacatctgtggacttcccgttagaaaatcttgacttgtcacagtatgttattggtccaaagaacaatttgaagaaatataatttgttttctgtttcaaatcactacggtgggctggatggaggccactacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatcttttttttttccttttcactgttatggccttttcacatttctaaatcccatcttgatatactatgaatactctagaatgatgtaaagcagataggaatgtatgtgtacatatttattgcatacttgcacatcaaatcgatgtacatagtttaacacgtggtccttttgtgaaacctagaactcagaggattgctttttttctttcagcctattttgagttaacttcagtgctttcttagggaaatgacagggcaaagcaatttttctgttggctttgggctgtatttgtgcactaaatctttattctaaaaaaaaaaatggaaactttaatttttttaaaacgagaatttcatttacagctacattaaaatcttaatgagaaaaataatttataaccctgtgggtgttctgtctttaatattgtattatcaaatataggacagtaaaaccatagattttatatacacacgtgctatataataacacccagagtcattctttcaagactagtattctcacatattgagaatattcattctaaatattaaagtaaaaatgccgggagtcaggcatgattgcaaagtgaactgcattataaactacatctttacagagtgatgtattaagagggttaaaggagcttataatttatttaaccgagggactcagttgctatatatatagtcagtaaaacactccatataaaaataagattctaaaagtgcttcagaaagagaccaccattagcaggctctcagggagaagatgaaaggatggggttcaaattgtgaagctgacaacttttcatgttttacaattagtctaagagaccacttcttggctaaattattatatcaaatatattcaaatcatattcttaaactcatcgagccatttgaacaaaaattatttttgtttagcttcatgagtatctttggaaaataatttgttgaatatatatgattatgagatattttctgataaacactgaattttgaaacctgaactcactatataattgcagtgttttgaaggcctgcatccattagcattgcattatattcacactgccttttttagtgaaccaagacccatcttctggacgacagatttatcttaagatgaaaggttgtataacatgcccacaaggcataaaaatgttaatgatgcaagtaagttctaagagtttaatgaccaagcaaaactctaccaccagatgctgactgcttgttttgcagtgttcaggaaacaccattttcctggctcttaacgcttttgtattggtatggaaaagggctggcagctatagaacaggagatccatagcattttgaacagaagtatctggaatctcactgactcgtgtgttatcaaagctatatcaggcctgggtgactgaattcttgcagaaagcagtgtagtggccaccatccaaatcaccaaaatggttctatgggagaaaggaatgtcaaacttagtattcacatatgaacactaactactggaacagaaatgatagggccaagagatgctttttaaattgtcccttattctaaattaaaaggaagtgataattttgttgttaaatcatgcatatagcctgactgctatattgcttctcatttcattgtaactacttatatgttgtgcccattgactatcatctgtgaataaagaaagacaatatttagcagca

SEQ ID NO: 7783 - DNA, 5848 bp, Homo sapiens
aatgcaaatcgggaaaagggggtgagctgggctggcttccgtcctggtagccaaggctaattctccctcgagttcttgggagatgggcatttggcgagaaggctggcgttagtgaagcgcgcccggcgtcacggtgagtgcgggtcttgggccctagcacctgttctctgggaagtcgtccgctgtgaacgatgaacgcctttccttccaccagctgctggttaccccggagacaagctctgtccgcggagaggagtgggacaactcctaaaggcaacaacaatactcaacataaatatctgttcttgaactcctgggctcaagcagtcctcccacctcagtctcccagagtgttgggattacagctgtgaggcaccacgcccagtcagtgcactgctttttgcatggagaaagtcttgctgctactttaaaaaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggattatttccattcaatacttggacctggaaacatcaaaaaagctgtcgaagaagctgaaagactctctgaaagccttaaattaagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaagagcaatggtgaaaagaatgaaaaatgtgagaccaaagagaaaggagcaatcacagcaaaggaactatacacaatgatgacggataaaaacatcagcttgattataatggatgctcgaagaatgcaggattatcaggattcctgtattttacattctctcagtgttcctgaagaagccatcagtccaggagtcactgctagttggattgaagcacacctgccagatgattctaaagacacatggaagaagagggggaatgtggagtatgtggtacttcttgactggtttagttctgccaaagatttacagattggaacaactctccggagtctgaaagatgcacttttcaagtgggaaagtaaaactgtcctgcgcaatgagcctttggttttagagggaggctatgaaaactggctcctttgttatccccagtatacaacaaatgctaaggtcactccacccccacgacgccagaatgaagaggtgtctatctcattggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacagattgatcgtactaaaaaaccagcagtcaaattgcctgaagagcatagaataaaatctgaaagtacaaaccatgagcagcaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaacttcgggaaaggcagcaagaggaacagaaagagaaactgaggaaggaagaacaagaacaaaaagccaaaaagaaacaagaagctgaagaaaatgaaattacagagaagcaacaaaaagcaaaagaagaaatggagaagaaagaaagtgaacaggccaagaaagaagataaagaaacctcagcaaagaggggcaaagaaataacaggagtaaaaagacaaagtaaaagtgaacatgaaacttctgatgccaagaaatctgtagaagatagggggaaaaggtgtccaaccccagaaatacagaaaaagtcaacaggagatgtgccccatacatctgtgacaggggattcaggttcaggcaagccatttaagattaaaggacaaccagaaagtggaattctaaggacaggaacttttagagaggatacagacgataccgaaagaaataaagctcaacgagaacctttgacaagagcacgaagtgaagaaatggggaggatcgtaccaggactgccttcaggctgggccaagtttcttgacccaatcactggaacctttcgttattatcattcacccaccaacactgttcatatgtacccaccggaaatggctccttcatctgcacctccttccacccctccaactcataaagccaagccacagattcctgctgagcgggatagggaaccttccaaactgaagcgctcctactcctccccagatataacccaggctattcaagaggaagagaagaggaagccaacagtaactccaacagttaatcgggaaaacaagccaacatgttatcctaaagctgagatctcaaggctttctgcttctcagattcggaacctcaatcctgtttttggaggttctggaccagctcttactggacttcgtaacttaggaaatacttgttatatgaactcaatattgcagtgcctatgtaacgctccacatttggctgattatttcaaccgaaactgttatcaggatgatattaacaggtcaaatttgttggggcataaaggtgaagtggcagaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggtctccatgaagatctaaataaagctgataatcggaagagatataaagaagaaaataatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctaccactagcatccacaagtaaatgtacattacaggattgccttagattattttccaaagaagaaaaactcacagataacaacagattttactgcagtcattgcagagctcgacgggattctctaaaaaagatagaaatctggaagttaccacctgtgcttttagtgcatctgaaacgtttttcctacgatggcaggtggaaacaaaaattacagacatctgtggacttcccgttagaaaatcttgacttgtcacagtatgttattggtccaaagaacaatttgaagaaatataatttgttttctgtttcaaatcactacggtgggctggatggaggccactacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatcttttttttttccttttcactgttatggccttttcacatttctaaatcccatcttgatatactatgaatactctagaatgatgtaaagcagataggaatgtatgtgtacatatttattgcatacttgcacatcaaatcgatgtacatagtttaacacgtggtccttttgtgaaacctagaactcagaggattgctttttttctttcagcctattttgagttaacttcagtgctttcttagggaaatgacagggcaaagcaatttttctgttggctttgggctgtatttgtgcactaaatctttattctaaaaaaaaaaatggaaactttaatttttttaaaacgagaatttcatttacagctacattaaaatcttaatgagaaaaataatttataaccctgtgggtgttctgtctttaatattgtattatcaaatataggacagtaaaaccatagattttatatacacacgtgctatataataacacccagagtcattctttcaagactagtattctcacatattgagaatattcattctaaatattaaagtaaaaatgccgggagtcaggcatgattgcaaagtgaactgcattataaactacatctttacagagtgatgtattaagagggttaaaggagcttataatttatttaaccgagggactcagttgctatatatatagtcagtaaaacactccatataaaaataagattctaaaagtgcttcagaaagagaccaccattagcaggctctcagggagaagatgaaaggatggggttcaaattgtgaagctgacaacttttcatgttttacaattagtctaagagaccacttcttggctaaattattatatcaaatatattcaaatcatattcttaaactcatcgagccatttgaacaaaaattatttttgtttagcttcatgagtatctttggaaaataatttgttgaatatatatgattatgagatattttctgataaacactgaattttgaaacctgaactcactatataattgcagtgttttgaaggcctgcatccattagcattgcattatattcacactgccttttttagtgaaccaagacccatcttctggacgacagatttatcttaagatgaaaggttgtataacatgcccacaaggcataaaaatgttaatgatgcaagtaagttctaagagtttaatgaccaagcaaaactctaccaccagatgctgactgcttgttttgcagtgttcaggaaacaccattttcctggctcttaacgcttttgtattggtatggaaaagggctggcagctatagaacaggagatccatagcattttgaacagaagtatctggaatctcactgactcgtgtgttatcaaagctatatcaggcctgggtgactgaattcttgcagaaagcagtgtagtggccaccatccaaatcaccaaaatggttctatgggagaaaggaatgtcaaacttagtattcacatatgaacactaactactggaacagaaatgatagggccaagagatgctttttaaattgtcccttattctaaattaaaaggaagtgataattttgttgttaaatcatgcatatagcctgactgctatattgcttctcatttcattgtaactacttatatgttgtgcccattgactatcatctgtgaataaagaaagacaatatttagc

SEQ ID NO: 7784 - DNA, 498 bp, Homo sapiens
gcatttatatagcagatgaagaatcaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggattatttccattcaatacttggacctggaaacatcaaaaaagctgtcgaagaagctgaaagactctctgaaagccttaaattaagatatgaagaagctgaagtccggaaaaaacttgaggaaaaagacaggcaggaggaagcacagcggctacaac

SEQ ID NO: 7785 - DNA, 652 bp, Homo sapiens
gcaatgcaaatcgggaaaagggggtgagctgggctggcttccgtcctggtagccaaggctaattctccctcgagttcttgggagatgggcatttggcgagaaggctggcgttagtgaagcgcgcccggcgtcacggcaacaacaatactcaacataaatatctgttcttgaactcctgggctcaagcagtcctcccacctcagtctcccagagtgttgggattacagctgtgaggcaccacgcccagtcagtgcactgctttttgcatggagaaagtcttgctgctactttaaaaaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggattatttccattcaatacttggacctggaaacatcaaaaa

SEQ ID NO: 7786 - DNA, 410 bp, Homo sapiens
ctcgagttcttgggagatgggcatttggcgagaaggctggcgttagtgaagcgcgcccggcgtcacgctgctggttaccccggagacaagctctgtccgcggagaggagtgggacaactcctaaaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagagttatgtgcacagtgccctgaagatctttaagacagcagaagaatgcagattagatcgtgatgaggaaagggcctatgtactatatatgaaatacgtgactgtttataatcttatc

SEQ ID NO: 7787 - DNA, 2455 bp, Homo sapiens
gttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtgagaaaagatatttcagtgagttgaaaggaaatgtgtttcggcttggtcaggggtccaccttctctggctcacagaggaggcccagcccaggcaggcggaggatacccagggtgaggcggagccccttggccaccagagtgctctctgcccccagtgttgaaaatcacatgtggccccaggacatcgctggcaggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcattttattagatgtggtcacttagaaatgcaaacttgctgccgaccgcgggctgctcctgcgttcttggagctcctggcgcgtttctcggagctcccggctcctcagcgggtgggaacctcggggcccaggggtggagctggcgtccgcgggtgctggtctggcctggccgtgtggtgatgaggcttagcggggccagtgacggccgtggctcaggatccataagtcggggtttggtctcagcatttacaaatgtgtttacagtcagaatgaaacacattccttctagaaagtgcttgggggtttttgctgccctggaagccaggagcctgctcactccaaccacaagtcgcccttgactgcggcggccgcgagcggggcgggggctgccggtgccctccgcaggccgggcctcctgggcgcccctcggtgctgcaggctggggggccttgggtacctgcagagccttttctctgaattccttatgtccggtgggccagaagcccgtcctcctatgctggtggaaggcggaggaccggagtccctgcagaaggccccgtgcactcgggggcctccctcacatcccgtgccccctgcgctggccttcacagtaggtaatggctccggcccgggtgttcgctgtccacggaacatggcagaggggcaccccggcccggaaagacgccagagccagcaggggctgtttcgggccgcgtggctccccgggtctcggccgtctcccctcttctgcgtctgttccgtgacttcgcctgggtgggatgtaccgcaggtgcatcgcgtcgaggtggggcacggccgccggcaagaaacccaccctgtccggaggcgggcgtgagacaagcccagcccgcacgcgctcatctttcttcgttttttgatcagtttattcagaattgctctataatttaccaattgtatgtatttaacctattcttgtggaaaaaaaaggtctttcattatatctttatttctgaattt

SEQ ID NO: 7788 - DNA, 4290 bp, Homo sapiens
ccgggcgcccggttcagcgccgccccggccggcgccggtgcctgccaggcactcagggaggcgggggcgcagtggaggaggcggcgccatcgcgaagcgagcgcctcgcccgcactcagccttgccaccccgcccgcagtccaggctggactgggcggcatttgccgaggctcctcggccaggccccgtccgcccgagccgcgctgagacccgggcagcggccgcgtggagaggaggtggcagcggcccgggaggccggagccaagccagcgacccaccatggagacccgctacaacctgaagagtccggctgttaaacgtttaatgaaagaagcggcagaattgaaagatccaacagatcattaccatgcgcagcctttagaggataacctttttgaatggcacttcacggttagagggcccccagactccgattttgatggaggagtttatcacgggcggatagtactgccaccagagtatcccatgaaaccaccaagcattattctcctaacggctaatggtcgatttgaagtgggcaagaaaatctgtttgagcatctcaggccatcatcctgaaacttggcagccttcgtggagtataaggacagcattattagccatcattgggtttatgccaacaaaaggagagggagccataggttctctagattacactcctgaggaaagaagagcacttgccaaaaaatcacaagatttctgttgtgaaggatgtggctctgccatgaaggatgtcctgttgcctttaaaatctggaagcgattcaagccaagctgaccaagaagccaaagaactggctaggcaaataagctttaaggcagaagtcaattcatctggaaagactatctctgagtcagacttaaaccactctttttcactaactgatttacaagatgatatacctacaacattccagggtgctacggccagtacatcgtacggactccagaattcctcagcagcatcctttcatcaacctacccaacctgtagctaagaatacctccatgagccctcgacagcgccgggcccagcagcagagtcagagaaggttgtctacttcaccagatgtaatccagggccaccagccaagagacaaccacactgatcatggtgggtcagctgtactgattgtcatcctgactttggcattggcagctcttatattccgacgaatatatctggcaaacgaatacatatttgactttgagttataatatggttttgtgacttatgagctgtgactcaactgcttcattaaacattctgcattgggtataatctaagaattgtttacaaaaagattattttgtatttacccttcattcctttttttgatccttgtaagtttagtataaatatatctagacattcagactgtgtctagcagttacgtcctgcttaaagggactagaagtcaaagttccttgtctcactatttgatctgctttgcagggaaataacttgttttttctcatgtttcatcttctttttatgtaaatttgtaatactttcctatattgccctttgaaatttttggataaaagatgatgttttaagttccaatgagtattactagttactcaataccacttattgagtactctgtttctacgtatgtagaatgtatagggatagaagagttgaaaagggaaagcaaaactcctcaagtagcttccttaaaatgtcattcataggagatgtactggaattgctcattctgtgactttatttgtgtcctaaacattcttcagtgaaaataattttatttcagtcaaacatttatgaggaaatgagatcacatctttgtcactggatgctacttgaagagggagtactttgtaaccactttgatatgctgttatcaccaccccctgccctctgctgccataatcacacaaatttaaaaagaaagaaaacagtcttccatagatttttaaggaagaaagggcccaagccaggagatcgcttggttttcttccagaagttaaatggggggatctgaagatttgaatgtttggtctgctttgaaatgtatgtcttttgggatgtattatatgcctagctttataatcagtataaattttaattattccaggaatatgcataatattgaaatatttcatgtcctattttaatagaaaacctcagggcccaagtaacagtgatagaagttagaaaaacctttacttagaattgtccacctagtcagagcccaagaaagaattttcagtggaaaaatcaatatataacttagtgctagctagcgccacagactctagtagataatattatcatcataatggctggtgaaaccatataatcacagaaaaacattgccttcagcatgttcagttcgcagcactgagggcactcttgagggtgttgttaatgaagatttaatttttaaatacaggtggttccaagctttcaaataggttatgctccaaaagtgttatttgtaagttaatttttttacaagtcaaacaatgttggaagtggtatttaggttctagatcggtccacgaaagttagcccatatgtatatcttgaatagtataggggagggtattcataaagtccttatgtggttttaactaagtgaaattatggacaagagaaataattgtaaaatcgtcttaaaggaaaatttaatttttactcctgtttatgggacattcgttctattaactgtcagacacaatttctgttttcatctgagagccagttttcctttatttctacatctaaaataagaacatattgtacactattatataatacagaattgtcttaaactttaataaattcgcattttaaaggtgtttacagattattttttatatctgtagctgaatttgttaaagtctaaaaagctcaaggactttatgaagatctcattatatgaggaaaatcataggttaccattttataactctattgccataagaaaatacactctaaaatcttgatttgaaacatattagaaaccttgattcagtgctcagtggtctcctagtaagaagtcaccgacggtagcgtcatatgagaagaaagaaatccccaccacctcaacctctgctgagattgtgtgctaggaacagccttccctccgtttcccctcagtcaaacttgagccagcctctggatcgatgtgatcttattgcatgtttccatggggtgtacctatactttaagccaatcctgctgcattcactgctaagttaaataaaaagccaagaagattttgcactgtgcagatcctttgctatctgacttgcatctcttcccccacctgtcagctagccacctgcttgtttgtgttgggatattttttagcacctgaagcaccatctgaaaggggcaccattttcttcttccctttgatctcacatatgctccctaaaaatccttaagttgtcaatctgatccccagtgtgaggttaatgagcaaaattggtctttggggccctttttgtccaagccccactgaaaggcctcttcagaaaactattatctttaaagccctactttaactccttaattccagcatacagctaaaactggatgtatattctggcaagtaaaggctgaggactcctctttaatcctcagatctagataactcatgacattttatttgaccaacatagcacatgatgagatatcaaggtaattaaaatagcatgcttgaaaaaaaaatacgtaatctgtttcacctgtaactgtttaagccaataaacttttcaaaatttatgtaatgtggggcttttatgtagcactttacgttttcatgctgcttattgttttattctactgaaaaaaatgaatttcaagattctcaacttttttaatttcaaaaattgtttattgttttgactataggaatacaaaatttcctattttgggagaataagaactctttttgtcatttttggctatgaataaactttctggtcttttgagaccacccatttttatagatcagaatcagaaaacaggtaaacctcactcacacatttggactcatttgaacaaaaatctaggccaaaatactgaaaagcctatgtgtttttttaattggaagtatatgtaaggttaatgcatttagtgaacgtgactaacaaagactaatgtgcacattaacagatgtactttttaaggttttatgggaggctgtgcattgctcaaaagctgttgggaacgccttctgaacagttgccttcagaactagtttgagctgctcaataaaaccagtgactttactcata

SEQ ID NO: 7789 - DNA, 1037 bp, Homo sapiens
accccgcccgcagtccaggctggactgggcggcatttgccgaggctcctcggccaggccccgtccgcccgagccgcgctgagacccgctacaacctgaagagtccggctgttaaacgtttaatgaaagaagcggcagaattgaaagatccaacagatcattaccatgcgcagcctttagaggataacctttttgaatggcacttcacggttagagggcccccagactccgattttgatggaggagtttatcacgggcggatagtactgccaccagagtatcccatgaaaccaccaagcattattctcctaacggctaatggtcgatttgaagtgggcaagaaaatctgtttgagcatctcaggccatcatcctgaaacttggcagccttcgtggagtataaggacagcattattagccatcattgggtttatgccaacaaaaggagagggagccataggttctctagattacactcctgaggaaagaagagcacttgccaaaaaatcacaagatttctgttgtgaaggatgtggctctgccatgaaggatgtcctgttgcctttaaaatctggaagcgattcaagccaagctgaccaagaagccaaagaactggctaggcaaataagctttaaggcagaagtcaattcatctggaaagactatctctgagtcagacttaaaccactctttttcactaactgatttacaagatgatatacctacaacattccagggtgctacggccagtacatcgtacggactccagaattcctcagcagcatcctttcatcaacctacccaacctgtagctaagaatacctccatgagccctcgacagcgccgggcccagcagcagagtcagagaaggttgtctacttcaccagatgtaatccagggccaccagccaagagacaaccacactgatcatggtgggtcagctgtactgattgtcatcctgactttggcattggcagctcttatattccgacgaatatatctggcaaacgaatacatatttgactttgagttataatatg

SEQ ID NO: 7790 - DNA, 973 bp, Homo sapiens
atgtggccccaggacatcgctggcaggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcat

SEQ ID NO: 7791 - DNA, 2387 bp, Homo sapiens
ggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggtaaggctccgcgccactgatcgccctgcgctgactgtcgctgccacgcaggcctctgccggcccctgctgggcgagcctggtgccccagtcatggcattggcaaggtgctcctgcaccctcccccggggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcattttattagatgtggtcacttagaaatgcaaacttgctgccgaccgcgggctgctcctgcgttcttggagctcctggcgcgtttctcggagctcccggctcctcagcgggtgggaacctcggggcccaggggtggagctggcgtccgcgggtgctggtctggcctggccgtgtggtgatgaggcttagcggggccagtgacggccgtggctcaggatccataagtcggggtttggtctcagcatttacaaatgtgtttacagtcagaatgaaacacattccttctagaaagtgcttgggggtttttgctgccctggaagccaggagcctgctcactccaaccacaagtcgcccttgactgcggcggccgcgagcggggcgggggctgccggtgccctccgcaggccgggcctcctgggcgcccctcggtgctgcaggctggggggccttgggtacctgcagagccttttctctgaattccttatgtccggtgggccagaagcccgtcctcctatgctggtggaaggcggaggaccggagtccctgcagaaggccccgtgcactcgggggcctccctcacatcccgtgccccctgcgctggccttcacagtaggtaatggctccggcccgggtgttcgctgtccacggaacatggcagaggggcaccccggcccggaaagacgccagagccagcaggggctgtttcgggccgcgtggctccccgggtctcggccgtctcccctcttctgcgtctgttccgtgacttcgcctgggtgggatgtaccgcaggtgcatcgcgtcgaggtggggcacggccgccggcaagaaacccaccctgtccggaggcgggcgtgagacaagcccagcccgcacgcgctcatctttcttcgttttttgatcagtttattcagaattgctctataatttaccaattgtatgtatttaacctattcttgtggaaaaaaaaggtctttcattatatctttatttctg

SEQ ID NO: 7792 - DNA, 1277 bp, Homo sapiens
aagctaggctggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcat

SEQ ID NO: 7793 - DNA, 1733 bp, Homo sapiens
cggaccgcgcaccggaagcagaagctaggctggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggtgtgggtgggccttgtgtgctggatttgtagcttatcttccgtgttgtctttggacctgttttagtaaacccgtttttcattttattagatgtggtcacttagaaatgcaaacttgctgccgaccgcgggctgctcctgcgttcttggagctcctggcgcgtttctcggagctcccggctcctcagcgggtgggaacctcggggcccaggggtggagctggcgtccgcgggtgctggtctggcctggccgtgtggtgatgaggcttagcggggccagtgacggccgtggctcaggatccataagtcggggtttggtctcagcatttacaaatgtgtttacagtcagaatgaaacacattccttctagaaagtgcttgggggtttttgctgccctggaagccaggagcctgctcactccaaccacaagtcgcccttgactgcggcggccgcgagcggggcgggggctgccggtgccctccgcaggccgggcctcctgggcgcccctcggtgctgcag

SEQ ID NO: 7794 - DNA, 1047 bp, Homo sapiens
tccggcctcgactacggcgagcctgagcgcggcggcggcccacgcgcagcgacagggagaggtgagcgcgctcgcaggcctgcgccgggtcctcgggcccgctcgtcccccctgccggagccggccacagcggcggcccggggctgctggggaccctgcgcgacgcttctccgttcgcgcccgccgcccgcggggccccggcccgagcctgcctgcgcggaacccgagatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcacc

SEQ ID NO: 7795 - DNA, 1057 bp, Homo sapiens
tggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagaggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcgccactgagggcaccgcgcaccagagcgtgacctcggcaggctggacacactgcccagcacaggcagacccaccaggctcctaggtttagcttttaaaaacctgaaaggggaagcaaaaaccaaaatgtgtgactgggctttggaggagactggagcctcagccctgtcctggccacgggccgctggggctggt

SEQ ID NO: 7796 - DNA, 1021 bp, Homo sapiens
atcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagatgagcagcaccagcagtaagagggctccgaccacggcaacccagaggctgaagcaggactaccttcgcattaagaaagacccggtgccttacatctgtgccgagcccctcccttcgaatattctcgagtggttcaagcgattctcctggctcagcctcctgagtagctgggattacaggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcacctcgtccagaacgggattcagctgctcaacgggcatgcgccgggggccgtcccaaacctcgcagggctccagcaggccaaccggcaccacggactcctgggtggcgccctggcgaacttgtttgtgatagttgggtttgcagcctttgcttacacggtcaagtacgtgctgaggagcatcgcgcaggagtgaggcccaggcgccgagacccaaggcg

SEQ ID NO: 7797 - DNA, 643 bp, Homo sapiens
ggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagaggtgagcgcgctcgcaggcctgcgccgggtcctcgggcccgctcgtcccccctgccggagccggccacagcggcggcccggggctgctggggaccctgcgcgacgcttctccgttcgcgcccgccgcccgcggggccccggcccgagcctgcctgcgcggaacccgagatgagcagcaccagcagtaagagggctccgaccacggcaacccagaggctgaagcaggactaccttcgcattaagaaagacccggtgccttacatctgtgccgagcccctcccttcgaatattctcgagtggttcaagcgattctcctggctcagcctcctgagtagctgggattacaggcactatgtcgtccgaggcccagagatgaccccttatgaaggtggctattatcatggaaaactaatttttcccagagaatttcctttcaaacctcccagtatctatatgatcactcccaacggga

SEQ ID NO: 7798 - DNA, 1056 bp, Homo sapiens
cgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagaggtgagcgcgctcgcaggcctgcgccgggtcctcgggcccgctcgtcccccctgccggagccggccacagcggcggcccggggctgctggggaccctgcgcgacgcttctccgttcgcgcccgccgcccgcggggccccggcccgagcctgcctgcgcggaacccgaggtcggttacggcgggctcccggagctccgggtcagggtcatgtcggggacttgaccactcggccgggtttcccgtcagctgggacacttgcagctgccccaggacgggcagcctcgatcctgatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtggctattatcatggaaaactaatttttcccagagaatttcctttcaaacctcccagtatctatatgatcactcccaacgggaggtttaagtgcaacaccaggctgtgtctttctatcacggatttccacccggacacgtggaacccggcctggtctgtctccaccatcctgactgggctcctgagcttcatggtggagaagggccccaccctgggcagtatagagacgtcggacttcacgaaaagacaactggcagtgcagagtttagcatttaatttgaaagataaagtcttttgtgaattatttcctgaagtcgtggaggagattaaacaaaaacagaaagcacaagacgaactcagtagcagaccccagactctccccttgccagacgtggttccagacggggagacgcac

SEQ ID NO: 7799 - DNA, 750 bp, Homo sapiens
cgggtcagggtcatgtcggggacttgaccactcggccgggtttcccgtcagctgggacacttgcagctgccccaggacgggcagcctcgatcctggttcgtcagtggatcacgggagtctgtgtcgggggagggctgccgtcgagcccgccgtcgcctcgcccctgaactgttagactccagactgccccgtaaaccccgagagaaacgagcgtgcccgggactgtgcttagggccagcgtttctgggaaacccgggcggtgacagtgggagaccaccgccggccggcgagtgagacacgagcccggaacaagtctctaagcggcgccgggcctcgccatccacacctgccagttccctgcatcctttcagcccctggccaggtgtcacctcctggcgtccttttcagtgcctgccacttagtgcgtgtgtatttaactctagtccggttgccatcctcttgccagacccagataggaagcggctgaaaggtcgggcctcagcccggtgggaggtgggcagcgaagagtgtacagcgggcttggctggggcaggtcggtggccccgcgccctgctccaggggaaccagactgtgtaatctggcttccgaagaaaggatcatgagcagcaccagcagtaagagggctccgaccacggcaacccagaggctgaagcaggactaccttcgcattaagaaagacccggtgccttacatctgtgccgagcccctcccttcgaatattctcgagtg

SEQ ID NO: 7800 - DNA, 530 bp, Homo sapiens
ggttccgccccgcgagcggccatcttggaggctgaggcggcggcggcggcgctgcggcgggttcggtgggcccaatcccggggcggtgcggctgtttcgggcgcgggccccgcttttccgcaccctgctccggcctcgactacggcgagcctgagcgcggcggcggcccacgcgcagcgacagggagagaattgggggaaatagccccctggcctcctgggggacgtgagaatgctgttctgtgtgaagctcaggaagagtggctggggaaacagcagttgaatcgtgaacatgattttaaaagcctctccaagcagatgagcagcaccagcagtaagagggctccgaccacggcaacccagaggctgaagcaggactaccttcgcattaagaaagacccggtgccttacatctgtgccgagcccctcccttcgaatattctcgagtggcactatgtcgtccgaggcccagagatgaccccttatgaaggtggctattatcatggaaaactaatttttcccagagaattt

SEQ ID NO: 7801 - DNA, 1087 bp, Homo sapiens
gtagttccgtcagagcggacatcttgtggctgtgtcgtgcgcgtgagccccgtagggccggggaggcaccagctgccgcgcggggaggaggccgaggccgcagcttgagggaggccccggcccctctaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccag

SEQ ID NO: 7802 - DNA, 896 bp, Homo sapiens
gggaactggcgggtagcgaggccctcctcggaatctcgtgtgaaggtggccctcctcttgggcctttaacgtctgtagatgctggagaccagcagaaaggatactgtgtgcgatgagataagcatgtgagaatgctttctaaccgaaagtgcctttcaaaagcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaa

SEQ ID NO: 7803 - DNA, 2389 bp, Homo sapiens
agaatagctcgctgcgaggatagcaatacacatcaagtctcccttcctttatttccttccttttcccggccgcacctttggacagaaaccgaaagcagcccggcgtccgtccggagtcttatgcttccccctccccccttgcctttctttgccctagtgacgccggtatagcgccgactaggccccggctcctcctctgctgggctccggaccctgccccgcacccacccctttctcctacgcctcttcctctcccacccgggtctcttcctttctagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaataggttagcaagagagtggacagagaaatacgctatgttgtagggtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtggg

SEQ ID NO: 7804 - DNA, 838 bp, Homo sapiens
ctcgatgcttctctgagcctaagggtttccgccactcgttcaccctccccccagctcatgatcctcctccctcccccgccctcctggtccaatctccgatctgtttagtaagaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatg

SEQ ID NO: 7805 - DNA, 660 bp, Homo sapiens
cgcggcggactgccgaggcgcgggaactggcgggtagcgaggccctcctcggaatctcgtgtgaaggtggccctcctcttgggcctttaacgtctgtagatgctggagaccagcagaaaggatactgtgtgcgatgagataagcatgtgagaatgctttctaaccgaaagtgcctttcaaaagaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgt

SEQ ID NO: 7806 - DNA, 2368 bp, Homo sapiens
accaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcctcctccctcccccgccctcctggtccaatctccgatctgtttagtaagaaggtgctgttccgagaagaaggaaaagggcttgacacgtattcactcggccccggacgtgggaagcaagccgtctggcttcggcctcacatcggtcttgtgctcgggacggcggcgttggcggactgatccgcggcggtgaagaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattgga

SEQ ID NO: 7807 - DNA, 2227 bp, Homo sapiens
ccaaccaccggcataagcattcaggggcgttgctttcctggcagtggcccgccccagttcgagccggtgccttactgcgtctcgcgagaacttatgcattttggaggcggaaccccgtcaggaaaagcgcacaaaactgctcttaagtcattgcagagctaccgcttcggttagccagccacgaagttctcgcgagagtcgtctcctcgataccaagcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattgga

SEQ ID NO: 7808 - DNA, 2575 bp, Homo sapiens
accaagtgaggaaactgggggacgctgtggggaggggcgtggggctggatcgcgcagcggctgcttcctttaccttcctcccatggtctccttccggttctcgatgcttctctgagcctaagggtttccgccactcgttcaccctccccccagctcatgatcctcctccctcccccgccctcctggtccaatctccgatctgtttagtaagaaggtgctgttccgagaagaaggaaaagggcttgacacgtattcactcggccccggacgtgggaagcaagccgtctggcttcggcctcacatcggtcttgtgctcgggacggcggcgttggcggactgatccgcggcggtgaagagaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattgg

SEQ ID NO: 7809 - DNA, 3990 bp, Homo sapiens
gttcaccctccccccagctcatgatcctcctccctcccccgccctcctggtccaatctccgatctgtttagtaagaaggtgctgttccgagaagaaggaaaagggcttgacacgtattcactcggccccggacgtgggaagcaagccgtctggcttcggcctcacatcggtcttgtgctcgggacggcggcgttggcggactgatccgcggcggtgaagaggcaggaggagggggaggggcggagcgtggcagctggcagtagttccgtcagagcggacatcttgtggctgtgtcgtgcgcgtgagccccgtagggccggggaggcaccagctgccgcgcggggaggaggccgaggccgcagcttgagggaggccccggcccctctgcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctttaacaatttctaaagttcttttatccatttgttcactgctatgtgatccaaacccagatgaccccctagtgccagagattgcacggatctataaaacagacagagataagtacaacagaatatctcgggaatggactcagaagtatgccatgtgatgctaccttaaagtcagaataacctgcattatagctggaataaactttaaattactgttccttttttgattttcttatccggctgctcccctatcagacctcatcttttttaattttattttttgtttacctccctccattcattcacatgctcatctgagaagacttaagttcttccagctttggacaataactgcttttagaaactgtaaagtagttacaagagaacagttgcccaagactcagaatttttaaaaaaaaaaatggagcatgtgtattatgtggccaatgtcttcactctaacttggttatgagactaaaaccattcctcactgctctaacatgctgaagaaatcatctgagggggagggagatggatgctcagttgtcacatcaaaggatacagcattattctagcagcatccattcttgtttaagccttccactgttagagatttgaggttacatgatatgctttatgctcataactgatgtggctggagaattggtattgaatttatagcatcagcagaacagaaaatgtgatgtattttatgcatgtcaataaaggaatgacctgttcttgttctacagagaatggaaattggaagtcaaacaccctttgtattccaaaatagggtctcaaacattttgtaattttcatttaaattgttaggaggcttggagctattagttaatctatcttccaatacactgtttaatatagcactgaataaatgatgcaagttgtcaatggatgagtgatcaactaatagctctgctagtaattgatttatttttcttcaataaagttgcataaaccaatgagttagctgcctggattaatcagtatgggaaacaatcttttgtaaatgcaaagctgttttttgtatatactgttgggatttgcttcattgtttgacatcaaatgatgatgtaaagttcgaaagagtgaatattttgccatgttcagttaaagtgcacagtctgttacaggttgacacattgcttgacctgatttatgcagaattaataagctatttggatagtgtagctttaatgtgctgcacatgatactggcagccctagagttcatagatggacttttgggacccagcagttttgaaatgtgtttatggagtttaagaaatttattttccaggtgcagcccctgtctaactgaaatttctcttcaccttgtacacttgacagctgaaaaaaaacaacatgggagtaataatgggtcaaaatttgcaaaataaagtactgttttggtgtgggagttgtcatgaggctgtgttgaagtgacttatctatgtgggatattgagtatccattgaaatggatttgttcagccatttacattaatgagcatttaaatgcaacagatatcatttcaggtgacttaacatgaatgaataaaagtcaatgctattggattgttttttgtttgacaagtgctatctgtgccactgatttaacttctgtagtaacaagggcattaccattcttcacctttcctaattctgatcccatagttttacatttttcctgtttattttgattttgttcactgctttatttcttaaagttctagcacatctgtgactcctccacttccacatttttgcactgcttacacttacgtgcaatcttattccttgtctgcacacacatgtggaaagctagaaataaatgttaaaacttactttttataaacattttaatatgtagtttggacatgatttattgacttaaggttcttctctaaactggaagtgaaatgcatgccttctgaagatgttctggctttgttaattctgtaatcatttcattggggaaaaaaccagctacgcagtttttccaatgagtgaattttttcattttgtgttttgcttaaaacggctccttcagggtagatgtcatactgcataacttttttggattcaaattatgaatgagaaattagttaacattctgctccacaaggtaagaaaaactgctctttggctctattttcaaaattacttctgagatgcatatagtctcaaaataacagctttagtaggcatatcacttcttgaaagccaaacatgagtgtaagacacttttatgaaacacggtggatccctaactggctttcaaattgacctttatagccttagacaacccttaggtatttacggagatgacttctttgattgtcataacaattagtggatgtgtccagttctctgtatctttgacttgatgctttatacatcatttcatttgttgcttctaagggaataagccatagaggcttctccaggtttaaaagaacagtaaagtacctggaaaaccaacatttttgaatgtatggacactggacatgagatatgtacaatgaaatcttaaaagaatctaagaatttgccctctttgccccactccacccagtaatttgacattactagtgccatgtataggacccaactgagtattagaatcagttttgactatgtctttgtatttcctaaatcttttaatgcataaaccgaattagggtccagttggcctgttaatggtaaatttacattttaaatgactcagtttgtttttcctgggcgagtttgcaatgtgataatcagattttttaaaactgattaatttgctttcttgtgtgggtgtactcacattttaaagtatgaaccacagttaactagtggtctcaggggtagtgaaacactcacttttttttttgtttgtttttttttgtttgttgaaatggcttagttgaagtatacttaaggtactgatcatgctgtgttagtaatttgggcggggaggggggtaactcagccatgttttgtgttggcataacaaaactgttaatgattgttgattacacttttaagtgaatttgtcttttatgaggaacccagtgcaagtcactaaatattgtctaatagtgacatctgcataagacttgtaatagctgaagttaattgagcttaaaggaattgttaccattaaagtctgtgtttaaagaca

SEQ ID NO: 7810 - DNA, 599 bp, Homo sapiens
acaaaactgctcttaagtcattgcagagctaccgcttcggttagccagccacgaagttctcgcgagagtcgtctcctcgataccaataagaaggtgctgttccgagaagaaggaaaagggcttgacacgtattcactcggccccggacgtgggaagcaagccgtctggcttcggcctcacatcggtcttgtgctcgggacggcggcgttggcggactgatccgcggcggtgaagaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatatta

SEQ ID NO: 7811 - DNA, 547 bp, Homo sapiens
agcgaggccctcctcggaatctcgtgtgaaggtggccctcctcttgggcctttaacgtctgtagatgctggagaccagcagaaaggatactgtgtgcgatgagataagcatgtgagaatgctttctaaccgaaagtgcctttcaaaaagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgtattctttttgacaattcattttcctacagactaccccttcaaaccacctaaggttgcatttacaacaagaatttatcatccaaatattaacagtaatggcagcatttgtctcgatattctaagatcacagtggtcgcctgctt

SEQ ID NO: 7812 - DNA, 604 bp, Homo sapiens
gcattttggaggcggaaccccgtcaggaaaagcgcacaaaactgctcttaagtcattgcagagctaccgcttcggttagccagccacgaagttctcgcgagagtcgtctcctcgataccaaaggccgggaagttaaacttgtagccaccacctccgctcttcccgtcaccctcgcccccacttcgggccgaaagcacggtacagaggctgttggtggctttgccacgccaccccacccaccccggatcgcggctgtcttaagggacctggattcatcaggggctcttcggggcctgtgcgagtgctgatctgctccgtttttgcaaaaggcgcctgtgtctggcagagctggtgtgagacgagacaatcctgccccgccgccgggataatcaagagttttggccggacctttgagcatacaccgagagagtgaggagccagacgacaagcacacactatggcgctgaaacggattaataaggaacttagtgatttggcccgtgaccctccagcacaatgttctgcaggtccagttggggatgatatgtttcattggcaagccacaattatgggacctaatgacagcccatatcaaggcggtgta

SEQ ID NO: 7813 - DNA, 4006 bp, Homo sapiens
ttcctccacttcctggactgcgcgaccggaggcctagcgggcgcgcgcccgcaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagtgaagcctgcctacagttttcacaaatctatcctgtagtgtgtgttccatccagtttctttattggagacagtggaattcccttggaagtaatagcaggaagtgtttctgcagatgaacttgttacaagaattcacaaggtccgacagatgcatttgctaaaaagtgaaacatcagtagcaaatggcagtcagtcagaaagttcagtgtctactccatctgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggaccgtgcagagagagctgctcgttttgcaaagacaaaggaagaagtagaggctgccaaagctgctgccttgctagcaaaacaggcagaaatggaagtcaagagggaatcttatgcaagagaaagaagcactgttgcaagaattcaattccgtcttcctgatggttcttcctttacaaatcagttcccttctgatgctcctctagaagaggcaaggcagtttgctgcacagactgttggcaacacttacggtaatttttcgttagcaaccatgtttcccaggagggaatttaccaaagaagattataaaaagaagttactggatttggaacttgccccaagcgcttcggtggtactgttgccagcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgatttttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaagtacatggtaaaaaaaaaaattcacaacagtatataaggctgtaaaatgagaattctgccccctcacctcttaccccagtactattctccagaggtaatctattaacaatttcttatgtaattttcagaaaatttgtatgcgtatataagcaaatatgtaatctttattttttaaataaatgggatcatattat

SEQ ID NO: 7814 - DNA, 3960 bp, Homo sapiens
ttcctccacttcctggactgcgcgaccggaggcctagcgggcgcgcgcccgcaccatcgactcgccaacgagagaaggtcctggggcacggacaccgacgggttgcgactgtgacgtgaggtgttctcgcgcgcgctagcgcgcgtctccgggtgccgctgacgggcgtgcgcgcttgtgcggagccggaggtgggggccgaaccagccaaggttgcgggggccgcagagccggacgaagacggagggcggagccggcttcgggactgcggagactacacaccgagcgagcgcctgggcccgaagggagcgatgctgtggttccagggcgccattccggccgccatcgcgacggccaaaaggagcggcgcggtcttcgtggtgttcgtggcaggtgatgatgaacagtctacacagatggctgcaagttgggaagatgataaagttacagaagcatcttcaaacagttttgttgctattaaaatcgataccaaaagtgaagcctgcctacagttttcacaaatctatcctgtagtgtgtgttccatccagtttctttattggagacagtggaattcccttggaagtaatagcaggaagtgtttctgcagatgaacttgttacaagaattcacaaggtccgacagatgcatttgctaaaaactgcgtcatttgaacctaacaacacttgtgaaaactctcagtccagaaatgcagagctttgtgagataccacccacttctgatacaaagtcagatactgcaacaggaggagaaagtgcaggccatgccacttcctctcaggagcctagtggatgctcagatcagagacctgcagaggacctcaacatccgagtggaaagactaacaaaaaaacttgaagaaaggagagaagagaaaagaaaagaggaagaacagagagaaattaagaaggaaattgagaggagaaaaactggaaaagaaatgttggattataaaagaaaacaagaagaagaattaacaaaaagaatgctggaggaaagaaacagagagaaagcagaagatagggcagctcgagaacgtataaaacagcagattgcattggaccgtgcagagagagctgctcgttttgcaaagacaaaggaagaagtagaggctgccaaagctgctgccttgctagcaaaacaggcagaaatggaagtcaagagggaatcttatgcaagagaaagaagcactgttgcaagaattcaattccgtcttcctgatggttcttcctttacaaatcagttcccttctgatgctcctctagaagaggcaaggcagtttgctgcacagactgttggcaacacttacggtaatttttcgttagcaaccatgtttcccaggagggaatttaccaaagaagattataaaaagaagttactggatttggaacttgccccaagcgcttcggtggtactgttgccagcaggaagaccaactgcatccattgtacactcttccagcggagacatttggaccttgttgggaacagtgctttatccattccttgccatctggagattaattagcaatttcttgtttagtaatccgcctcccacacagacttcagtgagagtaacatcgtcagaacccccaaaccctgcatcatctagcaaatcagaaaaaagggaaccagtgagaaaaagagtgctggaaaaacgtggagacgactttaaaaaggaggggaaaatttatagattaaggactcaagatgatggtgaagatgaaaacaacacttggaatggaaattccactcaacagatgtagtgtgacaagtataatatgtgcaataatcattgtttctcttatgatttaattcaactaaaattctactggagaagtgggactgctttatattttccaactggtctataaaatgtctctttattcctgcttagtgggtgtgggttgaaggtgtttaactcagaaaagtaaagacaggaaataactctctgctaggtccttgcttatatggcaaccactgctagaaccctaaaagaaccaaaaatctgccacagcctgcctccatcagcttcttatttagtatttcatatgcccattagccctatgcttcagatgacacgttttgtttagagctactttgctccaagactcttaagcccaaagtaactggtatgtcactgagtaacttgactcggtgtcagagcattttaactagccactcagatgagaatttatgtttaacttctctttttactcatcagctgcaagcaaaatcttgtagtttttaatcttaaacactgaataaaaaaactttcccctaaattggaatgatcttagttttgctttgagttttgttatctagcatctttttgttgcacagggctctattgaggtcctatgtctctgatttttttttttccccagtattgccctggagctgtctctggaaagtagctggcgaggttaccttaactatcactgaagaaagaaattttctgacacactgatggcatgtgacttgtctcctaagtcagtgaggcatcactttgtttgcataaagtatacggtttgttaaggcctttgttcttgtgagatgcaaaacagctgctagtctgcaacctagttttccctctcacctttaactgacgttttgtcctcaataattacacaaggacctagagtacctataggacaaaaagtatagaataaaaatatgcctttagtcatttggtttttcttaaaaagttgagattcttaatctgacttacatgttactttatccgtatgtctttgttagtggagaccgctaaactaatgatgtttgaaaacagttcctctgttttagattggaagatagcactctagagtggacatacggaaagactgtgactttattttgtaatgggaggaagaaattttctcagagcaaactttctattttttacctgtgaaataacagtgactttttaaaatggtgacagtgttggcaaggaaacagcaacacaggctgcgctgttggtaggagtgaaaaccagtataattcttctgaaaaacatttatcagaaacttaaaatatttcataccgtttgatccagtagcttcttctaaatcataaatgcagacaatgtttaggtaaagacatactcattaagtgttatttattttactcaagaactggaaaccaactaaatgccttctatagaagtaatttttgatgaggagaaatggtacaatactaattaacaacttggtttaacatgtttactgagcatctgttaagtgttgggggaaaaagcagcaggatccagagctataggtacagtgtgatctcagctttgcaaacacattttctacatagatagtactaggtattaatagatatgtaaagaaagaaatcacaccattaataatggtaagattggtttatgtgattttagtggtatttttggcacccttatatatgttttccaaactttcagcagtgatattatttccataacttaaaaagtgagtttgaaaaagaaaatctccagcaagcatctcatttaaataaaggtttgtcatctttaaaaatacagcaatatgtgactttttaaaaaagctgtcaaataggtgtgaccctactaataattattagaaatacatttaaaaacatcgagtacctcaagtcagtttgccttgaaaaatatcaaatataactcttagagaaatgtacataaaagaatgcttcgtaattttggagtaggaggttccctcctcaattttgtatttttaaaagtacatggtaaaaaaaaaaattcacaacagtatataaggctgtaaaatgagaattctgccccctcacctcttaccccagtactattctccagaggtaatctattaacaatttcttatgtaattttcagaaaatttgtatgcgtatataagcaaatatgtaatctttattttttaaataaatgggatcatattatatattcta

SEQ ID NO: 7815 - DNA, 10568 bp, Homo sapiens
acaccgcacggcgaagtgggggagggcagtccgtgtgtgtctgtgttgttgttcggcggcggcggcggcggtaagatggctgcccacgggggctccgcggcgtcctcggcgctgaaggggttaattcaacagttcaccaccattaccggtgcaagtgaaagtgtaggaaaacatatgcttgaagcgtgcaacaataatctggaaatggcagtcactatgtttttggatggtggaggaatcgctgaagagcccagtaccagttcagcaagtgtctctactgtcagaccacacacagaagaagaagttcgtgccccaattcctcaaaagcaggaaatactggtggaaccagaaccattatttggtgctcctaaaagacgacggcctgcacgttcaatttttgatggtttccgggattttcagactgaaactattcggcaagaacaagaattaagaaatggaggagctatcgataagaaattaactacccttgcagatctattccggccacccattgatttgatgcataaaggcagctttgaaacagccaaagagtgtggccagatgcaaaataagtggctgatgataaacattcaaaatgttcaagactttgcatgtcagtgcctcaaccgcgatgtgtggagcaacgaagctgtgaagaatattatccgggaacatttcattttctggcaggtttatcatgacagtgaggaaggtcagagatacatacagttttataagttaggggatttcccctatgtttccatattggacccacggacaggtcagaagctagtagaatggcaccagttagatgtatcttctttcttggaccaagtgacgggatttctgggtgaacatggacaactggatggactttctagcagtccccccaaaaaatgtgcccgttcagagagccttatagatgcaagtgaagacagccagctagaagctgccatcagagcctccttacaagaaacacattttgattcaacacagacaaaacaggatagccgctcagatgaagaatctgaatctgaacttttttctggcagtgaggagttcatatccgtttgtggctctgatgaagaagaagaggtagagaatcttgccaagtccagaaagtctccccacaaagatttggggcatagaaaagaggagaatagaaggccgctgactgagccaccagtcagaactgatcctggaacagccacaaaccaccaaggattgccagctgtggattcagagatactggagatgccacctgaaaaagcagatggagtagtggaggggatagatgtaaatggaccaaaagcacagctgatgttgcggtatccagatggaaaaagggaacagatcactcttccagagcaagctaaactgctagctttggtgaagcacgtgcagtctaaaggatacccaaatgaacgttttgaacttctcaccaactttcctcgaaggaaattatctcatctggactatgatattacattgcaagaggcaggcctttgtcctcaagagactgtctttgtacaggaaagaaattaacaccatggcttgacctctctcagcttaccccttttttcccttttcctgtgagatacatgtcactaagtatgcattttggctcataggaccacagagccaaagttgggcaagcaagtcaccttccttctcttatttcttgatctctcctataatcagtctctttctccccctttgtttctttctcctcttctgttttctcgctccccactccgtacccttctgcctccccctccccccacacttttctttcttacctaatctggtgaccaaactgaagtgtaaggataagacctctcctagtactagcagcaggaattgtgtgttccagtaagtggtctcttgcacggcacttttttgggatcaaatgttaacgttactccccagactcttcgggcaaaggaatggctagattcagagtaagaacaaccctcccttttttgtaagtccccgtgtttagcagggagaagaaattctctaacatgggtttggttttgttgtgttcttcatgtggaaatgtcgcttaacaaaatatccaggcttttgtttacgtggaaaaagcatcccttgtaatgattgctcatcatacttaaaaacctttttcaaaggattttcatgttcccagctataaggactatttccatgacatgtgttattggcagaatgagtgttaaatatggagcatatagcatggggtgactttcattgtcctaacctgagacagttttccttattactctgtattgatcctgctagtccaagaatggacatgaagtgaacctatcgtggtgactgggataggaaggtgcttgctatttttgccagcacagcatattagttcctttggagccctccattgtctgagtctgcagtgatctgtaggaaggcagctggtcaataatcatgtagtacaatggcttggaattgtaaccactatggttattgattgtcctgtgttgtttcaggcatacttaggtatgtccctggggaaaaagaaaaccattcagctgagagttgctaaccatgttcttttggttagaaataatggttcattttttgcccctggttggaatagtctctaaaaggctctggtgactgaattgaacatgagtccgcatgctgttttctttcaaaaggtatcaaaacggaaagcctctctaaggggaagacctttcaactccattcagaagacaacatttagtaaggaggatggcggaggttactagtaattttcagatgtcttgggctttttctgccaacaaaacccaaaatcaaattagagttggtgaaagctttcttcagtgtttttagaagaggccatcttgaatctgtagaataccatttacacatcaacttcaccctatgctcatttcgtattttgagcttaaatggagtcctctgaagggggggtagtcgtgattctggtggcaaaactagaacttttaacttgtaaaatgaaaaatattaaatggacctttttgtcagttgaggatttagattgattcttttatctgaggagcgtatgttcctcagatgttgcgtagagacctttaggttttcatctactttaagattgctctcttggcaattaggggatttgggaaaagaagaaaaaaagatgccatgtgttgctagtacacagttataggatatggtttctaatggttgaattttgaggaactctccctaaagaatgagttttatatctcctcaaggaaatcatggaaaaatctgtttattcttcagtgagtccttttgaattaatgttcttaaatttttttctaagtctgtgtaagtgcttatgtataagtatataattgtataaatatttataaatatatttatataattacggtttcatttctaccttgagtcaaagttctgtctttagattggtgactgagtaatacttacactttggtgttttttcttaggttcttgaggcttacttaactagcagcttctgatttattgagtgaaagatggttttcatgttaattcctcagttgcatctctgaacttggataacatacttgccgtttgaaaaatagagctgtatactgtcaaaggtgcactggagggtaaaacatttgttggtagtagacaagctcagaaatccaaaaattcagggagggcacagggtaagaagagaggtttgctcagctttgtgctctgatggcacccatctgtactccagcaaagtcatagctgaagcccaaatcgctcaaacgtgtgaagtcaatcatttttcctatagggctctgtttccttttctttaccttctagcttctcttgataaaacagttgggagaactgccaacgtgttcatcagtgagagggtgtggttctttccgatatgttcagcacgtgcatattcatttatgagaaaccaaagtaacttcttcaactcgggttactgtgggatgattaagtagatataaagtgatttaaaagacagcatggtactttcactcagcttaacatgcagctgggatgtctacaatacaagatgtggtgggttttattttattttattttgaggcaggagtgtaattatcttagggttgatataaaggcccatgggaagagttacggattgtacatgggaagaatccataaggagtattgccttgctcaagaatttaatccgctgacagtatgcttcttccagtttgccttacttcctctgcaagtttctttgctccttagggcagaggttttattgaatagattaaatgaggtcagtaagattagttaaaaatagtcattccttgtgggtgttggacacagcttgaaaggagtgtttaaaaaaaaaaagctagggaggaaaagaacaagaaagatagacttcgagagtgataagagaaaaatacagggagatggaatggaaactaccaggaaggccgggcgcggtggctcatgcctgtaatcccaacactttgggaggcggaggtgggcagatcacctaaggtcaggagatcgaggccagcctgagcaacatggtgaaaccccgtctctactaaaaatacaaaaattacctgggtgtggtggcgtgcacctgtaatcccagctactcagaggctgaggcaggggaatggcttgaacctgggaggcagaggttgcagtgagccaagatcgcaccattacactccagcctgggcgacaaagcgacactccatctcaaatttaaaaaaaaaaaagaagaagaagaagaaaactagtgggaaaaaagtgagaggaatacttttttgaaattggtatcggaaggaactggagaagagaaaacaacagtgccaaatgagaaaagaacaggaaacttaatactaattggcatgcaccagatacttttgtgtacatttgcctcttcaatctcccgaagaatcgtacaaaatgtatactttcttcccatgttaagaaaacaggtatagagaacttattcaggactcatagctagtgagtggcaaatcagaattggaatccagagtccatgctgtggtctccttcagcaagagaatcaagctacccagatgattctcttctcattgtttggctttgtaaagtgtcacttagttttgttcccataaatatagaggaagtagttgggttaaagttgtgggatttgcactatgcctatacatttttatttatgccattattttgagaggctgattattgcttttttaaaatgatgcactggtgaagatgtgaaagtaaaattgccacgtggcattatttgccaagaataaatgaaaagggtaaaaaaacaattttttctttttttaaacatttttcagaaaagatacaattaccttttttaataggtgagcgccaccacgcccggctaatttttgcatttttagtagagacagggtttcaccatgttggccaggatggtctcgatctcttgatctcgtgttccgcccacctcggcctcctaaagtgctgggattacaggcatgagccactgcgcccgatctacaattctgttttctgtgtcccatccataccagattattgaaccctctgtgtgtatgtttttaaatcttgtatataattctacttccttgacttacaagtcaacaattagctattgagttctttatagaagttggaagtattttgaaatctgagatctaattcctggccaggtgtggtggctcatgcctgtaatcccaatattttgggaggccgaggtgggtggatcacctgaggttgggagttcgagatcagcctggccaacatggtgaaaccccatctctactgaaaaatacaaaaattagccaggcatggtggctgtctgtaatcccagctaatggggaggctgaggcacaagaatctcttgaacctgggaggcggaggttgcagtgagccgagatcacaccactgcactccatcctgggcaatggagcgagactctgtctcaaaaaataataaataagatatgattcctgcctgttttatccagttagagagacacactacacatgaaataattggagagcatgtaaatgtttacctattagttcaaacttagaaaaagggaagaatatgttttagttagcaaagtcttaaacaagactgaagtggcaagcactgtagctcacgttttcttttgactcacctttttctttagctccaccttttgtaacttctagatttggggcatgaagttctgccactaaggcataaccagtacccaagtaggaaaggattattgatccctggagtaaagattcctagcttgcggggatctcactattgatcccccggagtaaagattcctagctcgcaggaatcttacttgcacacttagggaaaataccagagggagccactagcaaccgaaaaatgaaggaaagatttaatttctctacccaggtacaaatccaatgcatagtatagtatatgttatatgcagaaagggcactggaggtgtgagagccctttgggtaacagctctgctagttgttaccttcacacttctctttcttcttaatctctggtttctcgtctgaaaaatgagataattggactagattaatagttctcagccttttctagaacaacaaattagattatctctgaagtccttttccaaaatttcatgcttccagtctctccccgtgattgcgtattatccctaggctaattaaaagtgtgctggttaatcagtttctttactttttttttctctcttttttttattctgtgttcaggtatcatttgaccaacaacttgctcttaatcttactgcgatgactgaaatctccaaagaggagagtatagtagttataggtctagtaataataatcttgtaaacaattcattattttttaaaacttaatgctgtgtgcctaatcagtgttgagtatgactaaaatgtaaatgagaaccaaatatgacactaacgctggcactaaattttatttttacttgtgtacttaaagtactttactggcctgttgggaaattgatttgtataagattcacacctggttttggcagaaacagctttttaaagatacaattaggctgacttaaaaatgttttttattccacagaatgtatctttattatgtcattcttaccgtctctctgccttttttgaccatcatgtaactacgcagtagtaaatcatggggtgcaggctgatgaattagtagtctttgtaaaactaaaatgtaatgagcataggaagagacagctcttctggtgaacatggcagttttccggtaataccagccttgatgaataggctaaagacagctgtgtactatggacattcaacttcactggattgcctggcttagcttttcagttattgtcttgccgtgaaacatggtgttgcactgtacacattttagaatagtggcaagaatgttctttagaactgcagataacccaacagagaataccataccaatatatcggtttctcctgttacatagagatttggtatttcagtgatggttatggtttttgactcacctgtgtgtcagtcctgctagagagacagtatagaatcaagaatttcttgatgtctttttaaaaatagagattataatggccttgctagttgtcctgtgaagtgacagacccttaattagaaatcttttaatcctgctttccattttacttctccaccatttatttttaacattcattctctgaaaatagttatgatttttagtgtaattggctatgtttaagaaattccatttcaaagtcttaatatgtaacaatcttcattttttataaaattgaaggacatttttgaggcaaacttacttttatagctcattttctccctagttaaggagaattctctggtttcatatagagaatggctagctctgtgataccccaccctctttgtggcctaccagttgctgttgtgttgcttaaaattgcagatattctcataaacatgatgatttttggcacaggcctttctttgctattgatttcaaaataaagttgggcaatccaatttgaactactttaataaacataatttagcattcctgtaatgagaaagtattttcaaaagataaccagatttatttctaggattagagatggcaaataccaatgatagtatttttcccaagagcaatcacagattaatctataaatatgagaagtcgcattattgtacttaattctttggcaacaaacagcaagtttttattgtttaattgtatttcctctctagagatcacaatactctgggtattttatatcccttctaaaggtcatttgggttttcaaatgggaagaatagtcaagctaagctggactaaacctaagtaatattttttctcatcaaaagaagttattaatctaactgggttagcatgagtcattcattttttagacatgataaatgggaaacatatcaaatcattagataaattctgacctggaattgaattccccctttcttaaaatctttttaatttgcttttttcatagactcagtatggaactcttaactgataagggagagattcttgatctggaaccgttccctgccattctccttttttctctctatctaggtagctggttccatagtgcccgtcacgagggtccatttcagtttgatgacattagactgcttacactcagctggatgccttgctgtttgcagcaacatgattttacagtatgcttttctcaaagctttgcattcttaatggagatatcaaatggtgtaattccaaatataaatatgtttatgacactaatcatatgcttttaacaataactttttgataacttattgccctgtaagttaaaccttacacggagtgactgttgccatcagaaaatcccctttcacctgctagagagagtgaaagtagtgcgtggcctccacttttcagttaacgagtagcaagcttctagtaggggctgcttatctgacccatgtggggtcttgggccttgttactttcctgggttcgtcccttcagctggaaaggctgttgaaaacacttgccaggaaacagtaaagctgtgagagaatcttctagtcttagatatagagaaatgagtaccagttgatgctaacacgatacttagactttgaggggcttccatccaagctttggcatgaatctgttagacacggttttcttcactcctctgataatctttttttccagaatggttttttgttgttgttgttgttaacaaattctaaacatccagtgttactttttgttttgtttgttttgttttgttttgttttgttttgtttgcccttcaggaaagtcctttttcgagtaggtattgattgttccctggaaactctcagcagtgtctgtgcaggctctgtgcatgctttgtatgagttcggcttgaacaatgcatttgaagtcacctgggatgtccagttctggcatgtcttcattgattgtgtttttaaacatgtttcatgtttcatgtcattttccaaacctcactttacatcttactcagagaagttaatcaaggaatgaaatttctagggggatagggatgatgagggtgggttgggggcttgagtgaagtcaacttggggtatttgctttaaagtgttttctaaagcagttcctaacagtatttagagattccctgggatgtttgtggctcaacttattctggacaaagtgtgtgtgggggtggtcttactgagatttgcattcttaatgcaggacaggctctaaatttcatctgtactctaaatttgtgattgaatccaagaagataacagagacagtgctcctgttgtaatgtttctggcaagtgctccctaaaatgcacatcgaattctgttttctgggccttttctccaatggtgctaggagataccgttgatttctgcagctcttctcagtggtgggaagaagtctttgggattgttgagcaaggggcagctggaccatccactaaatttttttgttcaagacacattagagaccctcctgtatatctagtaagtcataataaaggtgcttgggaaagccttaaatttgaagacacatggaggcggtagaaaattaaacttgtaagaggagaaaaacatgccattaggtaacgcagagttgtaactactggctaagactcaatggaacttccacttgctctaaaaccagggaaatcttagataactgggtgtgatctacctatagatctacctagtctataggtaataatttccagaaggaggatcttgctgtcagttggggatcctctggtttggtctgtaccaaattgtgaatactcttgctgtgttgtacccagttgctttatattaatactgcaacttgaaacggggagggtggggggacaatggggtgggggagggaagggagtgggacgataagtcttttgaagacatcagctcactgtgctgagagagggaccaaactcaaggaaacctctgatctatacattcaactgctgcatttttttataaatacatgtaaatgtcctgttgtaatatttgatcttggaaataaaaacaaaaacttttcagta

SEQ ID NO: 7816 - DNA, 1398 bp, Homo sapiens
gttgttcggcggcggcggcggcggtaagatggctgcccacgggggctccgcggcgtcctcggcgctgaaggggttaattcaacagttcaccaccattaccgagaagaagttcgtgccccaattcctcaaaagcaggaaatactggtggaaccagaaccattatttggtgctcctaaaagacgacggcctgcacgttcaatttttgatggtttccgggattttcagactgaaactattcggcaagaacaagaattaagaaatggaggagctatcgataagaaattaactacccttgcagatctattccggccacccattgatttgatgcataaaggcagctttgaaacagccaaagagtgtggccagatgcaaaataagtggctgatgataaacattcaaaatgttcaagactttgcatgtcagtgcctcaaccgcgatgtgtggagcaacgaagctgtgaagaatattatccgggaacatttcattttctggcaggtttatcatgacagtgaggaaggtcagagatacatacagttttataagttaggggatttcccctatgtttccatattggacccacggacaggtcagaagctagtagaatggcaccagttagatgtatcttctttcttggaccaagtgacgggatttctgggtgaacatggacaactggatggactttctagcagtccccccaaaaaatgtgcccgttcagagagccttatagatgcaagtgaagacagccagctagaagctgccatcagagcctccttacaagaaacacattttgattcaacacagacaaaacaggatagccgctcagatgaagaatctgaatctgaacttttttctggcagtgaggagttcatatccgtttgtggctctgatgaagaagaagaggtagagaatcttgccaagtccagaaagtctccccacaaagatttggggcatagaaaagaggagaatagaaggccgctgactgagccaccagtcagaactgatcctggaacagccacaaaccaccaaggattgccagctgtggattcagagatactggagatgccacctgaaaaagcagatggagtagtggaggggatagatgtaaatggaccaaaagcacagctgatgttgcggtatccagatggaaaaagggaacagatcactcttccagagcaagctaaactgctagctttggtgaagcacgtgcagtctaaaggatacccaaatgaacgttttgaacttctcaccaactttcctcgaaggaaattatctcatctggactatgatattacattgcaagaggcaggcctttgtcctcaagagactgtctttgtacaggaaagaaattaacaccatggcttgacctctctcagcttaccccttttttcccttttcctg

SEQ ID NO: 7817 - DNA, 2965 bp, Homo sapiens
ttgcagatcagtgtgtgagggaactgccatcatgaggtctgacaagtcagctttggtatttctgctcctgcagctcttctgtgttggctgtggattctgtgggaaagtcctggtgtggccctgtgacatgagccattggcttaatgtcaaggtcattctagaagagctcatagtgagaggccatgaggtaacagtattgactcactcaaagccttcgttaattgactacaggaagccttctgcattgaaatttgaggtggtccatatgccacaggacagaacagaagaaaatgaaatatttgttgacctagctctgaatgtcttgccaggcttatcaacctggcaatcagttataaaattaaatgatttttttgttgaaataagaggaactttaaaaatgatgtgtgagagctttatctacaatcagacgcttatgaagaagctacaggaaaccaactacgatgtaatgcttatagaccctgtgattccctgtggagacctgatggctgagttgcttgcagtcccttttgtgctcacacttagaatttctgtaggaggcaatatggagcgaagctgtgggaaacttccagctccactttcctatgtacctgtgcctatgacaggactaacagacagaatgacctttctggaaagagtaaaaaattcaatgctttcagttttgttccacttctggattcaggattacgactatcatttttgggaagagttttatagtaaggcattaggaaggcccactacattatgtgagactgtgggaaaagctgagatatggctaatacgaacatattgggattttgaatttcctcaaccataccaacctaactttgagtttgttggaggattgcactgtaaacctgccaaagctttgcctaaggaaatggaaaattttgtccagagttcaggggaagatggtattgtggtgttttctctggggtcactgtttcaaaatgttacagaagaaaaggctaatatcattgcttcagcccttgcccagatcccacagaaggtgttatggaggtacaaaggaaaaaaaccatccacattaggagccaatactcggctgtatgattggataccccagaatgatcttcttggtcatcccaaaaccaaagcttttatcactcatggtggaatgaatgggatctatgaagctatttaccatggggtccctatggtgggagttcccatatttggtgatcagcttgataacatagctcacatgaaggccaaaggagcagctgtagaaataaacttcaaaactatgacaagcgaagatttactgagggctttgagaacagtcattaccgattcctcttataaagagaatgctatgagattatcaagaattcaccatgatcaacctgtaaagcccctagatcgagcagtcttctggatcgagtttgtcatgcgccacaaaggagccaagcacctgcgatcagctgcccatgacctcacctggttccagcactactctatagatgtgattgggttcctgctggcctgtgtggcaactgctatattcttgttcacaaaatgttttttattttcctgtcaaaaatttaataaaactagaaagatagaaaagagggaatagatctttccaaattcaagaaagacctgatggggtaatcctgttaattccagccacatagaatttggtgaaaaccttgctattttcatattatctattctgttattttatcttagctatatagcctagaattccacgatcatgaggttgtgagtatatctcattctttcgttgtattttcctaggtgtctttactctcttctctcactttgtgacacaaggacatgaatacatctaaattttcctatttctgatatgactgttttgatgatgtcattacttctataaccttaagtgatagggtgacatgcaatatgattattcctggtgtgcgcccaaacacatggatataaagaggtaaaaaacttaaaattcacaaaattcagtaaaccacacaaatcaggtaagtgttctatgagattagctggctatgagaaacataatgatgtttctttttcaatttaaataagcccttctacatagccagcatcagtgatctcagaaaataaattgctaataatgatgacatggcattatgcttagaaaagtttgctgtatttccatagacctcatctagatgtcatggcctacatttctgccatcactcaaccaatacttttttctgttttcttgatgataaaaagacctttctcatgattgccatcaaataacaaaagaaactattttttttctcacatagagaacatgtcagtaagatattcaaggtgaacagattatttttgggattagtaactatttgaaatatgtggtgataattactgagtttataaaatttatttgatagtacacttaaagaagatttatatgtttattctttaaaaatgatgaatactcataattcttatctctataatcaaaagtataatttactgtagaaaaataaagagatgcttgttctgaaagtaagatcagtgaactgcttttcagtctcaatctttgagaattgtaaattcatcaaataattgcttacatagtaaaaatttaaggtattagaaaacctgcataacaaatagtattatatattaaatattttgatatgtaaagctctacacaaagctaaatatagtgtaataatgtttacactaataagcaaatatgttaatcttctcatttttttactgtcatataatcttagtgatatgcctattaatagttttaaataaataaattggctcatctggctttttgaaaattttgaaattcttacagatgttgattaggtatatctacaaattaatttcaattttaaaatgatgatataaaaataaatataagtatttttcttgtgtatgtatacaataaatataaataaaattgtttactgttttgaaa

SEQ ID NO: 7818 - DNA, 1638 bp, Homo sapiens
cttatgaagaagctacaggaaaccaactacgatgtaatgcttatagaccctgtgattccctgtggagacctgatggctgagttgcttgcagtcccttttgtgctcacacttagaatttctgtaggaggcaatatggagcgaagctgtgggaaacttccagctccactttcctatgtacctgtgcctatgacaggactaacagacagaatgacctttctggaaagagtaaaaaattcaatgctttcagttttgttccacttctggattcaggattacgactatcatttttgggaagagttttatagtaaggcattaggaaggcccactacattatgtgagactgtgggaaaagctgagatatggctaatacgaacatattgggattttgaatttcctcaaccataccaacctaactttgagtttgttggaggattgcactgtaaacctgccaaagctttgcctaaggaaagttataccagaaaaccaagctctcttaagccatggcatctgtatctaaaatagaaatacagaaggagagctgacaatttccatcattctctaggaaatggaaaattttgtccagagttcaggggaagatggtattgtggtgttttctctggggtcactgtttcaaaatgttacagaagaaaaggctaatatcattgcttcagcccttgcccagatcccacagaaggtgttatggaggtacaaaggaaaaaaaccatccacattaggagccaatactcggctgtatgattggataccccagaatgatcttcttggtcatcccaaaaccaaagcttttatcactcatggtggaatgaatgggatctatgaagctatttaccatggggtccctatggtgggagttcccatatttggtgatcagcttgataacatagctcacatgaaggccaaaggagcagctgtagaaataaacttcaaaactatgacaagcgaagatttactgagggctttgagaacagtcattaccgattcctcttataaagagaatgctatgagattatcaagaattcaccatgatcaacctgtaaagcccctagatcgagcagtcttctggatcgagtttgtcatgcgccacaaaggagccaagcacctgcgatcagctgcccatgacctcacctggttccagcactactctatagatgtgattgggttcctgctggcctgtgtggcaactgctatattcttgttcacaaaatgttttttattttcctgtcaaaaatttaataaaactagaaagatagaaaagagggaatagatctttccaaattcaagaaagacctgatggggtaatcctgttaattccagccacatagaatttggtgaaaaccttgctattttcatattatctattctgttattttatcttagctatatagcctagaattccacgatcatgaggttgtgagtatatctcattctttcgttgtattttcctaggtgtctttactctcttctctcactttgtgacacaaggacatgaatacatctaaattttcctatttctgatatgactgttttgatgatgtcattacttctataaccttaagtgatagggtgacatgcaatatgattattcctggtgtgcgcccaaacacatggatataaagaggt

SEQ ID NO: 7819 - DNA, 1931 bp, Homo sapiens
ggaaaagaattatcacattgcacaaggatggctctgaaatggactacagttctgctgatacaactcagtttttactttagctctgggagttgtggaaaggtgctggtatgggccgcagaatacagcctttggatgaatatgaagacaatcctgaaagaacttgttcagagaggtcatgaggtgactgtactggcatcttcagcttccattctttttgatcccaacgactcatccactcttaaacttgaagtttatcctacatctttaactaaaactgaatttgagaatatcatcatgcaattggttaagagattgtcagaaattcaaaaagatacattttggttacctttttcacaagaacaagaaatcctgtgggcaattaatgacataattagaaacttctgtaaagatgtagtttcaaataagaaacttatgaaaaaactacaagagtcaagatttgacatcgtttttgcagatgcttatttaccctgtggtgagctgctggctgagctatttaacataccctttgtgtacagtcacagcttcagtcctggctactcatttgaaaggcacagtggaggatttattttccctccttcctacgtacctgttgttatgtcaaaattaagtgatcaaatgactttcatggagagggtaaaaaatatgctctatgtgctttattttgacttttggttccaaatatttaatatgaagaagtgggatcagttttacagtgaagttttaggaagacccactacattatctgagacaatgaggaaagctgacatatggcttatgcgaaactcctggaattttaaatttcctcatccattcttaccaaatgttgattttgttggaggactccactgcaaacctgccaaacccctacctaaggaaatggaggagtttgtacagagctctggagaaaatggtgttgtggtgttttctctggggtcaatggtcagtaacatgacagaagaaagggccaacgtaattgcaacagcccttgccaagatcccacaaaaggttctttggagatttgatgggaataaaccagatgccttaggtctcaatactcgactgtacaagtggataccccagaatgaccttctaggtcatccaaaaaccagagcttttataactcatggtggagccaatggcatctatgaggcaatctaccatgggatccctatggtgggcattccattgttttttgatcaacctgataatattgctcacatgaaggccaagggagcagctgttagagtggacttcaacacaatgtcgagtacagacctgctgaatgcactgaagacagtaattaatgatccttcatataaagagaatattatgaaattatcaagaattcaacatgatcaaccagtgaagcccctggatcgagcagtcttctggattgaatttgtcatgcgccacaaaggagccaaacatcttcgagttgcagcccacaacctcacctggttccagtaccactctttggatgtgattgggttcctgctggcttgtgtggcaaccgtgctatttatcatcacaaagtgttgtctgttttgtttctggaagtttgctagaaaaggaaagaagggaaaaagggattagttatatctgagatttgaagctggaaaacctgatagataggaatacttcagttgattccagcaataaatattgtgatgcaagatttctttcttcctgtgacaaaaaaaaatcctttcgaagtctaccttgtcaagtaaaaatttgtttttcagagatttaccacccagttaatggttagaaatattctgtggcaatgaagaaaacactaggggaaataaaaaataatataaagccatatgagcttgtattgaaatttgttgcacttatattgaaatgtgatcatggctcacttcagcctcaacttactaagctcaaga

SEQ ID NO: 7820 - DNA, 5122 bp, Homo sapiens
attaacgtgatttactgaggcccctgtcattcctggctcttagtaaggattttccagataggacagctgtgattacgcaggcagagaaaggttacagatcaggttaccaaccccctcctactgacttcaggtagtttgatagggtgagggcagattatcccatggagcatgcacccagggaggaggggcagcgggaaagagaacgaacagaagggcgagagaattggcaggatccgtctcctacctcttcctaggcccacagccagtgcctttggagtactgaggcgcgcacagagtccttagcccggcgcagggcgcgcagcccaggctgagatccgctgcttctgtggaagtgagcatggttgggcagcgggtgctgcttctagtggccttccttctttctggggtcctgctctcagaggctgccaaaatcctgacaatatctacactgggtggaagccattacctactgttggaccgggtgtctcagattcttcaagagcatggtcataatgtgactatgcttcatcagagtggaaagtttttgatcccagatattaaagaggaggaaaaatcataccaagttatcaggtggttttcacctgaagatcatcaaaaaagaattaagaagcattttgatagctacatagaaacagcattggatggcagaaaagaatctgaagcccttgtaaagctaatggaaatatttgggactcaatgtagttatttgctaagcagaaaggatataatggattccttaaagaatgagaactatgatctggtatttgttgaagcatttgatttctgttctttcctgattgctgagaagcttgtgaaaccatttgtggccattcttcccaccacattcggctctttggattttgggctaccaagccccttgtcttatgttccagtattcccttccttgctgactgatcacatggacttctggggccgagtgaagaattttctgatgttctttagtttctccaggagccaatgggacatgcagtctacatttgacaacaccatcaaggagcatttcccagaaggctctaggccagttttgtctcatcttctactgaaagcagagttgtggtttgttaactctgattttgcctttgattttgcccggcccctgcttcccaacactgtttatattggaggcttgatggaaaaacctattaaaccagtaccacaagacttggacaacttcattgccaactttggggatgcagggtttgtccttgtggcctttggctccatgttgaacacccatcagtcccaggaagtcctcaagaagatgcacaatgcctttgcccacctccctcaaggagtgatatggacatgtcagagttctcattggcccagagatgttcatttggccacaaatgtgaaaattgtggactggcttcctcagagtgacctcctggctcaccccagcatccgtctttttgtcactcatggtgggcagaacagcgtaatggaggccatccgtcatggtgtgcccatggtgggattaccagtcaatggagaccagcatggaaacatggtccgagtagtagccaaaaattatggtgtctctatccggttgaatcaggtcacagccgacacactgacacttacaatgaaacaagtcatagaagacaagaggtacaagtcggcagtggtggcagccagtgtcatcctgcactctcagcccctgagccccgcacagcggctggtgggctggatcgaccacatcctccagactgggggagcgacgcacctcaagccctatgccttccagcagccttggcatgagcagtacctcattgatgtctttgtgtttctgctggggctcactctgggcactatgtggctttgtgggaagctgctgggtgtggtggccaggtggctgcgtggggccaggaaggtgaagaagacatgaggctaggtgtagccttgggtgaggggagggcatccctggtcctttgaaggttctccccaccccagcacacgccacccctctgttctctcttcagctccacctgccactgatcctgcaacttgcttctttctattctctgcctctgtttagaaatcttcacgcaccactgaggcttcttgacttgccccttgtgacttgaaaccccagctcagatacaaattttcacctgccagccctgcctcctcctttctcccttttcctagacacaggactctgacaacttcatcctccttgtttagatgacttcccagtttccagtccccatttctccttctatcacttttcataaaaaaactcaggaaatatttgacatatcttccatttcaaattcttccattttatgcagatatcttgcccttcctataagctctcctcaaagctcaggaaacctggtctgctctcctgcatttagggaaggagaacccctgccaagacctttgctcactgcctgagaccccttccttagagagcacctcctttgctggtcagacatggagcctgcagttggtcacagatgatactgctttatttcagtttttacagttgtcttcttaagattcccgtcttataaatggagtacagggaacctcaagtagtgaagtggaaatccatgtgtaaggctttgtggcttcaggtaccagtggctaaggtagttttaaagactttgttgattttagaaaaagtccatcttccatccccgacatggcagttaatacccttctatatggtaaaaccttagagattaccttaatctgctaggaacagaagcaagaaaaaccatggcgtaaacacccccagagtttttgttcatttgtttcatctttcttgataaagcccgaaggtagcccattcagggctgttgtggttggttgctccatcatgtcatcaatagcccatatcttttcttttttatcttccttagtgtaacaccaaactacctctctgatagctggtgttcatgaaatattttaccttcaaatgattgtacctttttatttgctttagagttctgaaataaaatgaaattccactgtaataaaactgtcaaatgcatggtgtctgatgagttaaaaacacagagtagaaaacaggcatatggagaggccctggatgaaccatagttttagattgtttaattctagaattgtgaaacagatcttgaaacaattcagatcaaaagatgaaactgttacaaatgctcctgcagaaatagagaatgccccccaccaaaaactttgccaattccatgaaaggatttgcttgcgagtctgcagagctgagtgctggatgtctatccattttgtgagttctcatgacacaagagccagaagcatgaagcacgcagaagtacattagagtgtgtgtatctgtgtgcgtataatacaaggttttattgctgtaattcttatgaaaccacatgaattgattgatggccatactcccatgaagggcagacatggatgcttccctgtgttttctgttgaatcaacagccatgatttcattcccctcatgagcaacataaggtcttagggataagcctccctggccagtaactcccccctcaccccagaacatagcctttctctaacacttggtaattcattgaggtcaactttatgccacttgtataaacttgcatccctaaaatctgatcataagcagccaatgagccagaatgatgcttctaatcttgctctgtccaagcaccctccacagggctgcaagcatggctctgacaacctagaaatctggtgttatccctcactgtttaaaatctttgttcccattgtgtggaatataagggctctatgatttggtcctggctaccaatctaggcacacctggagcagttctcctcccactcttttccaaatgttcgctacaccccctcagaacacattttgctgtttttaacctctgaggtttgtctatgcccttccttctctcagaaataccatcctattcttgctggaatgagaaacttctgcttatctgtcagtatccagtgtcattgtgttcacattggtaagcctgtgcctgaccactacacctgaaatggagctcactgcattctcttttgaagcatttttcttactatatcgcaattatttattacaatatctgtttcctatttagaaaccataaggtcataaagacagggactggttcctatttatcttgttatagaacctggcatagtgcctggaacaaatactgctaggacaactggataatattgagaaaaaaggcaatatttgatccagacttcacactatatcaaaaactgaattcctatacaccagatatctaggtacaaaaaatgataccatgctgagtctaagagaaaaagtgaatttttccatagcctgtgtatagggagagactttctaaataggaagaaaaaatcctgatacaacaagagaagtgtaaattaatttgacacaaaaaactttggcatggcaaaaatcatggtaagaagattagcgatccaaattaaaaagttggagaaacatagctgcagcatatatcttacacatagacctaatatttctgataaactaagaactattaaaattgaagaaagaacctatgatacatatacatactgaaataatattcagctttaaactacaataaacaaaagcagaataagctaatatggagcaaattccaatatggttaagtaaaaaatagcaaagagtaagagtaactataggatgtatccttttttttataagaaaaaggaaagtatgtgtatgggggataatgaaaaaaatacatatctatgtgcattgccttgcaaaaacagtgcagagggaataaaccagagtgtgatagattatctatgagggtggtgtttgaatagggtggaaggatccatgtgtttatgtttttacatagtttggattttggaaacgttaatattttgcataccaagtatatgtttaaataaacaaggagagaaaagccaagaactgaaatacaaacggaaacaaatgaaatcaattttttccaaatgaaaatgtaactatactgtagtgaaaaaaattagcatcattaccttttaaacacagtacttttactatatactgtatacaatcaatcaacagaaaaaaaaaagaactccaaa

SEQ ID NO: 7821 - DNA, 3097 bp, Homo sapiens
agggggatacccaccatggtagaccagagccactggaaagaggcatgagtccacatatccataaaggcaaatatccaaatattggctgtctggacctacaggaatactaaagaaggcactgcagagacccacaactgagaaatactggctgtgtggaagccattacctactgttggaccgggtgtctcagattcttcaagagcatggtcataatgtgactatgcttcatcagagtggaaagtttttgatcccagatattaaagaggaggaaaaatcataccaagttatcaggtggttttcacctgaagatcatcaaaaaagaattaagaagcattttgatagctacatagaaacagcattggatggcagaaaagaatctgaagcccttgtaaagctaatggaaatatttgggactcaatgtagttatttgctaagcagaaaggatataatggattccttaaagaatgagaactatgatctggtatttgttgaagcatttgatttctgttctttcctgattgctgagaagcttgtgaaaccatttgtggccattcttcccaccacattcggctctttggattttgggctaccaagccccttgtcttatgttccagtattcccttccttgctgactgatcacatggacttctggggccgagtgaagaattttctgatgttctttagtttctccaggagccaatgggacatgcagtctacatttgacaacaccatcaaggagcatttcccagaaggctctaggccagttttgtctcatcttctactgaaagcagagttgtggtttgttaactctgattttgcctttgattttgcccggcccctgcttcccaacactgtttatattggaggcttgatggaaaaacctattaaaccagtaccacaaaatgggcaaccagctctcttcaccacccccagcttattctcctctggagtgtatcctgaaccactgagatggctttgaccctcagaatctggaggaaaaacacctcctagcctgtgtatcctgaaccactgagtctgctttgaccctcagaatctggaggaaaaacacctcctagccctcggaacaaaggtttggccaaattatgaaggactggcttggtctcaggaaggaaccattcattgtgataccatctggcagctggacattttctgtaggcgtgaggacgaatggcctgaggccccacatgtgcaggctttttataccttgcagggaaatctagatctttgctgacagtgtaggattgatccagccctcctgctttgtcatttcaggagaggctgcaaagggcaattccagggaactaaagaaacaaatcccagaggcactcccagcagagaagccagctccctccagctctgctcctctgggtccacctcaacctctctatccagcttcagtctctcgcttgcctaatcctagaaatcctcaccctagacaagccccagtctcactcctcctcttccaacagatgccaggtgaatttggccccagtaaggtgcaggtctccttccccctacaggacttaaagtacattaagggggatttttggcaagttttcacatgaccctgacagatagatagaggctttccagaatttaacccaggtatttgaactctcttggagagacattgtgttacttttgaatcagatcctgatgaacactgagaagcaggctgctctgcaagtagcagagagatttggggatgagctttgtttcacatatagtgtcaggaaagggggcaaactttatccgactggaagagaagcagtaccagtaaatgaccctggatgggatggatcccagtgttgaaatgggagactggaagaggagatactttcaggtatgcatcatggagggattacgtaggactaagaccaagcctcttgattatagcaagctatctatgatagaccagggatttaatgaaaatcccactgccttcttggagaggctaagaggggccttggtaaagcatacccccgtatcttctgattcagtgaagggacaactaattctgaagaataaatttattactcagacagcccctgatatcaggaggaagttgcagaaatgggccctgggaccagataatactttagaggtctaactgaaagtggccatctttgccttttacaatagagatgggggacacaagaaagaggcagaagcattaatggtcaccatgcaagcccataaaccccagaattcccagggtacacttgttaattgctacagatgtggcaagaacagttgtctctcttctaaagttgaaccgcttctatacaaggtttaatttctttcaccagggtgaaacagctcaaagcagaatggttttagtattttcacttgttatttctgtgatctttggcactagattattttcttgtataatacacttgtttaacccatgcctacttaaccttataaaacttgttttttcctctcacttagaggccatcaaactccaaatggtcaggcaaccggagcctcggacaacggctcccttttgcaaggacccttagataaacctctgggaggaatctgactgctgttttctccaaaatagtgccacctgtcagcagaaattagctaagattggccatcgtccatattctaatggcagttagatttgcctctgcagagaggggagatgatacggctaggagacagagaaatactgggtagaagagggcagttccctggcaaaggtcccaatttcaagcctggaaacctctggccctaactgagaacatgcattcctgttttcacacacaaaagttgccttttggctctccacacgcccctctcctgtactcatataaatctgagacctcaggttccagaagcagatgaaaaggagatgaacagaagagcagaagaatggcataatggtgtggcagagagaagagaaggagagtctgaacaccaagaggagttcagctgggggcgattggagaggagatcagccactggatggctgaactccaggaagaccatcttcccattccgtctcctttccagctccccatgcatcccatccccaccactcaataaaacccccacattcaccatc

SEQ ID NO: 7822 - DNA, 4084 bp, Homo sapiens
aagccaacctcgctcagcggacgactggccggatcccaacgcgctgccccttgcccagcctgcgagcgcgtggtacgaaggcgcgtctgcatccatgccccagcccggggagctggaggcgctcgcagtcagaggcgagtgatgctaggctgagcgcgtggcggcccgtgtcgtgccccgctgagccaagtgcggaagggcagcggcgcgctccgactctgctcgccgcacgcagggcggggcgcggctggggggcggggggcctggccgcccgctgggagctgcggacgagcaggcgcgctgaggacccgagggaggacacggttaaagcattgctatcaactgtgaacccagagagccctccttagccaacacgctaactccgaagcctcccttacgcccccgaaccaccgaaggcggcgacacctgattcagcgcacaaacacaggtcccttctgtcccggatacaattacgcggcagacacacactcaaactcgcgcggggcagccaagagacgagctatgaagtcttacactccatatttcattctcctgtggagtgctgttgggatagcgaaggctgccaaaatcatcatcgtgccgccaattatgtttgaaagccatatgtacattttcaagacgctagcctcagccttgcacgagagaggccaccatacagtgttcctcctctctgaaggcagagacatcgccccatctaatcattacagcctccagcgctacccagggatctttaacagtaccacctcagatgctttcctacagtccaagatgcggaatattttctctgggagattgacagcaatcgaactgtttgacatactggatcactatactaagaactgtgacctgatggttggcaaccatgccctgatccagggtctgaagaaagaaaaatttgacctgctgctggtggaccctaatgatatgtgtggatttgtgatagctcatcttttaggggttaaatatgctgtattttcaactggcctttggtatcctgctgaagtgggtgctcctgctccattagcatacgtcccagagtttaactcactcctcacagaccgcatgaacttgctgcaaaggatgaaaaataccggtgtttacctcatttccagattaggggtcagctttctggttcttcccaaatatgaaaggataatgcagaagtacaacctgctgccagagaagtccatgtatgatttggttcatgggtccagcctgtggatgctgtgtactgacgtagcactggaattcccaagacccactctgcctaatgttgtttatgtaggaggaatcctaaccaaaccagccagcccactaccagaagatctccaaagatgggtaaatggtgctaatgaacatggctttgtcttggtgtcttttggagctggtgtcaagtatctgtcagaagacattgctaacaaactggcaggagctctggggagattgcctcaaaaagtgatttggaggttttctggacccaaaccaaagaatctaggaaacaacactaaactcatagaatggttaccacaaaatgacctgcttgggcattcaaagattaaagccttcctgagccatggtggtttgaacagtatttttgaaactatatatcatggtgtgcctgtagtgggaattccactctttggagaccattatgatactatgaccagagtacaggcaaaaggcatggggatattgctagaatggaagacagttactgaaaaagagctctatgaagcactagtgaaggttatcaataatcccagctaccgtcagagggctcagaagctttcggaaattcacaaggatcaacctggtcaccctgtcaatcgaactatctattggatagattatattattcgtcacaatggagcccatcacctacgtgccgctgtccatcagatctccttttgtcagtattttttactggatattgcctttgtgcttttgcttggtgctgccttgttatactttctcttgtcttgggtgacaaaatttatctacagaaaaatcaaaagtctgtggtctagaaataagcatagcacagttaatggacattaccacaatggaatcctcaatggcaagtacaaaagaaatggccatattaaacatgaaaagaaagtgaaatgagccaacagcccaggtgatagaaataaattggttcactcattgaatttttattgctattatttagtctaacagctactaaaagtaaaacatcagtaaacaattctaacatgcccttatgagatctactaatgaaattctgtggaattaagatggctgtaaaaagcacaaacctaaaatgcagaaatgtattttattcaaatactgatgtagagagttttggcactgaaccttttagaagccttaattatttaaatcaattcagtgactgtgtcagaccttagttttaaatcttgatatgtgcgtgtcccggatcaggaatggtttcatttttcttaataatgtgtgtgtgtgtatgtgtgtgtgtgtgtgtgtgtgtttgtgtgtgtgtgtgtgtgtcctaattaagagaatttttactggctgcttgttacatttgttgagggtacaacacactcaagaataaagtaaaaggatagtcaggatccagatgtttcttttctagcatttaatgtgtgtgaactcagaacactaccatgaaagaacacttccccccaaaactggatgcagaggaagaaaaaaaaaaaagaaatggcacagttttttgtatttttttttttagttattttttgttgttgttgtttgtattgtttttcttttctgatagagtatggccacttctgggggaaaaacatgtaattaagtaaatgtatacattggttttcacgttttacttttgttttcccactaccaataattttcctctggaagaattttatagttttttctatttcattttaatgagtaacaatatgttaaatgcataattaagacaaagcaatgaaattctgactttattcaaagtactgaagattattgcttctagggcatttttaaacagcaccattgtattgttgaatgtttatgtaactgatggcttttctataatgtaatttttgaatgttcaggtgttacatttccaaagtttaacttttaaaaaaccatcttctgatcccttttattgtctgggccatacaatctatattacataggtgccaacatttaattcttttaaatggaacatttgcagttttccatattggtacctgctttttctggagaggtttgagatcttgttaacaaatcagactttacactatatacagatgtgacagataaattgaaccacttgtttgtgaaaatgagttcctgtcatcttcctcattcactcagccctcaccccagcagccttttccggtcattgtagctgacatggagcagtgacagtattcatttgagaacagggatgcaagtcacagacatcataaaatcagggtctccctgctgaagcattcactagttggcaactatgaatttattccatgtcattctgtttacttagcacttgcactacccttgttggttgagtgtatgctttatttgtttctagtttgaaatcccacatctgatagctgagagtaggcaaatacaacatttacctaatgtcattcactaacatggaagagttgtgaaaattctagagtgctgtaaatccttggcatacactatgacaaacaacttcattactctcccaccaggagctgctctcctgcacttagaaataatgtcacaagtagttttctaatgtacaatgcagacaaatgtactgctctctgaatacttgaagaaatggtattatacatacatagaaacttattagttataccttttcacaatcttattacgatgttgccgttaaaagggaaaaaagacacaggcaatgaatggtgggatagtaagaggacttagagtgtatgaatgagttgattttacttttttggaatttgattaagttgacagtaggcactgattggatgattaaacataagttaatctccactgtgataaaaacttaaataataaacatgatttaaaatag

SEQ ID NO: 7823 - DNA, 2448 bp, Homo sapiens
gggttggttccaagtctttgctattgtgaatagtgccgcaataaacatacgtgtgcatgtgtctttatagcagcatgatttatagtcctttgggtatatacccagtaatgggatggctgggttctagatccctgaggaatcgccacattgacttgcacaatggttgaactagtttacagtcccaccaacagtgtaaaagtgttcctatttctccacatcctctccggcacctgttgtttcctgactttttaatgattgccattctaactggtgtgagatgatatctcattgtggttttgatttgcatttctctgatggccagtgatggtgagcattttttcatgtgttttttggctgcataaatgtcttcttttgagaagtgtctgttcatgattttttttttagacaaagtattagatcagatatttttggggaaaaatgctttgtgattgcttgttttgaatggtgagcattgtattttgttttaagttgttttctggttgttattacagctatgaagtcttacactccatatttcattctcctgtggagtgctgttgggatagcgaaggctgccaaaatcatcatcgtgccgccaattatgtttgaaagccatatgtacattttcaagacgctagcctcagccttgcacgagagaggccaccatacagtgttcctcctctctgaaggcagagacatcgccccatctaatcattacagcctccagcgctacccagggatctttaacagtaccacctcagatgctttcctacagtccaagatgcggaatattttctctgggagattgacagcaatcgaactgtttgacatactggatcactatactaagaactgtgacctgatggttggcaaccatgccctgatccagggtctgaagaaagaaaaatttgacctgctgctggtggaccctaatgatatgtgtggatttgtgatagctcatcttttaggggttaaatatgctgtattttcaactggcctttggtatcctgctgaagtgggtgctcctgctccattagcatacgtcccagagtttaactcactcctcacagaccgcatgaacttgctgcaaaggatgaaaaataccggtgtttacctcatttccagattaggggtcagctttctggttcttcccaaatatgaaaggataatgcagaagtacaacctgctgccagagaagtccatgtatgatttggttcatgggtccagcctgtggatgctgtgtactgacgtagcactggaattcccaagacccactctgcctaatgttgtttatgtaggaggaatcctaaccaaaccagccagcccactaccagaagatctccaaagatgggtaaatggtgctaatgaacatggctttgtcttggtgtcttttggagctggtgtcaagtatctgtcagaagacattgctaacaaactggcaggagctctggggagattgcctcaaaaagtgatttggaggttttctggacccaaaccaaagaatctaggaaacaacactaaactcatagaatggttaccacaaaatgacctgcttgggcattcaaagattaaagccttcctgagccatggtggtttgaacagtatttttgaaactatatatcatggtgtgcctgtagtgggaattccactctttggagaccattatgatactatgaccagagtacaggcaaaaggcatggggatattgctagaatggaagacagttactgaaaaagagctctatgaagcactagtgaaggttatcaataatcccagctaccgtcagagggctcagaagctttcggaaattcacaaggatcaacctggtcaccctgtcaatcgaactatctattggatagattatattattcgtcacaatggagcccatcacctacgtgccgctgtccatcagatctccttttgtcagtattttttactggatattgcctttgtgcttttgcttggtgctgccttgttatactttctcttgtcttgggtgacaaaatttatctacagaaaaatcaaaagtctgtggtctagaaataagcatagcacagttaatggacattaccacaatggaatcctcaatggcaagtacaaaagaaatggccatattaaacatgaaaagaaagtgaaatgagccaacagcccaggtgatagaaataaattggttcactcattgaatttttattgctattatttagtctaacagctactaaaagtaaaacatcagtaaacaattctaacatgcccttatgagatctactaatgaaattctgtggaattaagatggctgtaaaaagcacaaacctaaaatgcagaaatgtattttattcaaatactgatgtagagagttttggcactgaaccttttagaagccttaattatttaaatcaattcagtgactgtgtcagaccttagttttaaatcttgatatgtgcgtgtccc

SEQ ID NO: 7824 - DNA, 735 bp, Homo sapiens
aggacacggttaaagcattgctatcaactgtgaacccagagagccctccttagccaacacgctaactccgaagcctcccttacgcccccgaaccaccgaaggcggcgacacctgattcagcgcacaaacacaggtcccttctgtcccggatacaattacgcggcagacacacactcaaactcgcgcggggcagccaagagacgagtgagagtaacacatgcgcactgtggattcctttgtgaatacataaaaggaaaagttaaaactcttataattcacactatccagagaaaaacaatactattttgctatgaagtcttacactccatatttcattctcctgtggagtgctgttgggatagcgaaggctgccaaaatcatcatcgtgccgccaattatgtttgaaagccatatgtacattttcaagacgctagcctcagccttgcacgagagaggccaccatacagtgttcctcctctctgaaggcagagacatcgccccatctaatcattacagcctccagcgctacccagggatctttaacagtaccacctcagatgctttcctacagtccaagatgcggaatattttctctgggagattgacagcaatcgaactgtttgacatactggatcactatactaagaactgtgacctgatggttggcaaccatgccctgatccagggtctgaagaaagaaaaatttgacctgctgctggtggaccctaatgatat

SEQ ID NO: 7825 - DNA, 2793 bp, Homo sapiens
ggcctgggccgccggcccggcgcgggcgccatgaagctgctgcggcgggcgtggcggcggcgggcggcgctaggcctgggcacgctggcgctgtgcggggcggcgctgctctacctggcgcgctgcgcggccgagcccggggaccccagggcgatgtcgggccgcagcccgcctccccccgcgcccgcgcgcgccgccgccttcctggcagtgctggtggccagcgcgccccgcgccgccgagcgccgcagcgtgatccgcagcacgtggcttgcgcggcgcggggccccgggcgacgtgtgggcgcgctttgccgtgggcacggccggcctgggcgccgaggagcggcgcgccctggagcgggagcaggcgcggcacggggacctgctgctgctgcccgcgctgcgcgacgcctacgaaaacctcacggccaaggtgctggccatgctggcctggctggacgagcacgtggccttcgagttcgtgctcaaggcggacgacgactccttcgcgcggctggacgcgctgctggccgagctgcgcgcccgcgagcccgcgcgccgccgccgcctctactggggcttcttctcgggccgcggccgcgtcaagccgggggggcgctggcgcgaggccgcctggcaactctgcgactactacctgccctacgcgctgggcggcggctacgtgctctcggccgacctggtgcactacctgcgcctcagccgcgactacctgcgcgcctggcacagcgaggacgtgtctctgggcgcctggctggcgccggtggacgtccagcgggagcacgacccgcgcttcgacaccgaataccggtcccgcggctgcagcaaccagtacctggtgacgcacaagcagagcctggaggacatgctggagaagcacgcgacgctggcgcgcgagggccgcctgtgcaagcgcgaggtgcagctgcgcctgtcctacgtgtacgactggtccgcgccgccctcgcagtgctgccagagaagggagggcatcccctgagccgccgcggcccggccctccgggacacctgcttcacccggcggcgccttggggcaggtgccgagcgggcgcactacgcccgggccccaaggcccccgtcccgcagccacgcttgtggtcgctgcgtcccggtctgcgtttgggagacccctgggggttgccggggcagcgcgccgtgtccaggtggaggtgcccgttcctggacctcagcgagcctgagccgggcccggccgcacgctgacccccgtgctgtccccgaccggctcacggggctgggctccgatcttccgtgtctcttatcagtggcgtttctcacgtctgcgtctcagatctaacgtggtttcacatcaatccgctttcatgggattttggtctctgtccagtgacttcgtggtaaatgtaactcagtgtttgcttgcgacttatttataaatattgtaagtttgtgtcgatgagtgtaagttggcagtgcgcacgtctcggtttttttacatgatttaaggaaagacttttatgtcagaacttggtgcctgtaccgtcaaccccgctgctgcccgtgtttaaacgcaggagaactttaaaactggccatctatcttttcagtgtacaagtcactgaacccattgtttctttctgaagagactttcctttcaaggcttcccatgggtccgcgccacacagggccggtgctgctttatttcagactctgccccaggttccaggaatccgaaccccggagtgctgacgcggttccccaacttccgccttaagaaaacaggaccagccggcaccaggcccgtctctcacgtactttaacacatccttgaaagcccctcgtttaatgagaaaagcgaacactgcggtccttgccaaagtaaaatgaagctgccccaggacaaggggttaccatgagctccctggagtccgacgcgggttttctctctgggggacctgggtggtccccgctgtggtctttgttgtcccactttgggaccgggtccagtctggggtctagtctcgagcatcagggtcaggctcggggcagggctgggttaggctccgggtcagtcttgccatgggtttgggagcaggtttgggttacttgcgtttgaaggcagcagtggtctcaggaggaagaaacgggggcgggagagagtggtgatctgtggtcagtgggtcagtgacctgcacggtgattctcccacctccaaaaggtaggggtgggactggaggcgtccctaggtcaggccgttgagttcgagctccgatgggccaccttgaatccaggactgaccgcccgtgtgtgcacagtttgttcttggacgaggactcgtgaggatcgagggctggggaccccggtgtgagcaggatggggccctgccctcccgtgggagttgtggactcgagcccaggggctgcccgtcacagcggtgtcccaggtccctgccatccgattttacctgggatgtcttctctggagtttggaattgcttgaggaaccctgcgtgtgcttggagaggccagagggcttgctgagaaccccatggacagtggagagcgggattcgaaccaagggctggactcccacacctctggcctgcgtcgcccagttctttgtggctctgaagaattggccgctgtggaaaagagcaaatgtccgagacccccaacaggaagagtctaaaaatccagtttgcaaccacttctgacctacaaaaaaatggaaatttagtgtttttcagcctaagacattaaatttcatatcagaacaaa

SEQ ID NO: 7826 - DNA, 2168 bp, Homo sapiens
ggctacgcagcttgctcctggcacgggcaccttgaatctcctcctcacacagatggagaccatgcttgatttcctgaacttgtagtaagaagaaggaaaacacagcacgctggagccaacagagttaagaggaagatttatgagtcatggaaccctccatcagatttggaagaaagtagaatgagcgcagaggtgacagacagccactgaggcccatggacaatctccacctcacgcttctctatcaaacttgaagatttattagtaatatgctgcctttggaagatgaaaacaaactagtgccaaggaggcgtattcttcaatatttggaatagacgtgttctcaagacaatggcttcaaaggtctcctgtttgtatgttttgacagttgtgtgctgggccagcgctctctggtacttgagtataactcgccctacttcttcttacactggctccaaaccattcagccacctaacagttgccaggaaaaacttcacctttggcaacataagaactcgacctatcaacccacattcttttgaatttcttatcaacgagcccaataaatgtgagaaaaacattccttttcttgttatcctcatcagcaccactcacaaggaatttgatgcccgtcaggcaatcagagagacgtggggggatgagaacaactttaaggggatcaagatagccaccctgttcctcctgggcaagaatgctgatcctgttctcaatcagatggtggagcaagagagccaaatcttccatgatatcatcgtggaggactttattgactcctaccataaccttaccctcaaaacattaatggggatgagatgggtggccactttttgttcaaaagccaagtatgtcatgaaaacagacagcgacatttttgtaaacatggacaatcttatttataaattactgaaaccctccaccaagccacgaagaaggtattttactggctatgtcattaatggaggaccgattcgggatgtccgcagtaagtggtatatgcccagggatttgtacccagacagtaactacccacctttctgttcggggactggctacatcttttcagccgatgtagctgaactcatttacaagacctcactccacacaaggctgcttcaccttgaagacgtatatgtgggactgtgtcttcgaaagctgggcatacatcctttccagaacagtggcttcaatcactggaaaatggcctacagtttgtgtaggtatcgccgagttatcactgtgcatcagatctctccagaagaaatgcacagaatctggaatgacatgtcaagcaagaaacatctcagatgttaggatttttaccaatgtaaatatgtttcttttctttttttaagaaatgggacctaaggtgttggtattttccaggtgtcgggggaaatgaactggtgaaggggttttgtaaagtttttgcttcctgctataagttcttttcttggattaccaatttatgaatgttagactctggtcatagaaacaataaatgagttagaagggccagatttcattctcagtcccagagcattgctatttatctcaaaaagtgacttccaaacaactcttaggattgacgtaccgtgcatctgagataaaaatttggttctgggaaactgaaactcacagtaatgtgtcatatcatccctgcaaaaattaatacacaaatagaaaccattttcaaaagcaattcagaaaggatgcacagtcaggaagacacactggatgtgattattaatatcgtgtgtgttgttacattatatttttacatatattcccatgtaatgtgtacagtctttgcagttccaccaagaaatgaacttggtacctgcagagtggctgcagttaaatagatgggagtttaaatttgagaatcaaacattctatgtgtttggaagacaactctgcttgctcatccaaggattaaatctggtcagcaggtggaatgtgtataaaatgctacttaacaaagtaaacaaaagattttttttttctttttttttctttcttttttgttttgctctttcagaacaaacattaaatggtgcctccaaggaaactttgccaaatataatctcacctgcttccttccagacagtgtcgctaagtgcatttcacagtttttggatctggcaggc

SEQ ID NO: 7827 - DNA, 1909 bp, Homo sapiens
tattagtaatatgctgcctttggaagatgaaaacaaactagtgccaaggaggcgtattcttcaatatttggaatagacgtgttctcaagacaatggcttcaaaggtctcctgtttgtatgttttgacagttgtgtgctgggccagcgctctctggtacttgagtataactcgccctacttcttcttacactggctccaaaccattcagccacctaacagttgccaggaaaaacttcacctttggcaacataagaactcgacctatcaacccacattcttttgaatttcttatcaacgagcccaataaatgtgagaaaaacattccttttcttgttatcctcatcagcaccactcacaaggaatttgatgcccgtcaggcaatcagagagacgtggggggatgagaacaactttaaggggatcaagatagccaccctgttcctcctgggcaagaatgctgatcctgttctcaatcagatggtggagcaagagagccaaatcttccatgatatcatcgtggaggactttattgactcctaccataaccttaccctcaaaacattaatggggatgagatgggtggccactttttgttcaaaagccaagtatgtcatgaaaacagacagcgacatttttgtaaacatggacaatcttatttataaattactgaaaccctccaccaagccacgaagaaggtattttactggctatgtcattaatggaggaccgattcgggatgtccgcagtaagtggtatatgcccagggatttgtacccagacagtaactacccacctttctgttcggggactggctacatcttttcagccgatgtagctgaactcatttacaagacctcactccacacaaggctgcttcaccttgaagacgtatatgtgggactgtgtcttcgaaagctgggcatacatcctttccagaacagtggcttcaatcactggaaaatggcctacagtttgtgtaggtatcgccgagttatcactgtgcatcagatctctccagaagaaatgcacagaatctggaatgacatgtcaagcaagaaacatctcagatgttaggatttttaccaatgtaaatatgtttcttttctttttttaagaaatgggacctaaggtgttggtattttccaggtgtcgggggaaatgaactggtgaaggggttttgtaaagtttttgcttcctgctataagttcttttcttggattaccaatttatgaatgttagactctggtcatagaaacaataaatgagttagaagggccagatttcattctcagtcccagagcattgctatttatctcaaaaagtgacttccaaacaactcttaggattgacgtaccgtgcatctgagataaaaatttggttctgggaaactgaaactcacagtaatgtgtcatatcatccctgcaaaaattaatacacaaatagaaaccattttcaaaagcaattcagaaaggatgcacagtcaggaagacacactggatgtgattattaatatcgtgtgtgttgttacattatatttttacatatattcccatgtaatgtgtacagtctttgcagttccaccaagaaatgaacttggtacctgcagagtggctgcagttaaatagatgggagtttaaatttgagaatcaaacattctatgtgtttggaagacaactctgcttgctcatccaaggattaaatctggtcagcaggtggaatgtgtataaaatgctacttaacaaagtaaacaaaagattttttttttctttttttttctttcttttttgttttgctctttcagaacaaacattaaatggtgcctccaaggaaactttgccaaatataatctcacctgcttccttccagacagtgtcgctaagtgcatttcacagtttttggatctggcaggc

SEQ ID NO: 7828 - DNA, 2072 bp, Homo sapiens
gggcggcgggcggggcggcgctcggggctcggctggcctcggctcgcctcggctgcgctcggcaggctgcggtaaatccgggcttgcggccgctggcgtagtctgtggccgggtggtcgttgctgcgcgccccgagccccgagagccatgcagatgtcctacgccatccggtgcgccttctaccagctgctgctggccgcgctcatgctggtggcgatgctgcagctgctctacctgtcgctgctgtccggactgcacgggcaggaggagcaagaccaatattttgagttctttcccccgtccccacggtccgtggaccaggtcaaggcgcagctccgcaccgcgctggcctctggaggcgtcctggacgctagcggcgattaccgcgtctacaggggcctgctgaagaccaccatggaccccaacgatgtgatcctggccacgcacgccagcgtggacaacctgctgcacctgtcgggtctgctggagcgctgggagggcccgctgtccgtgtcggtgttcgcggccaccaaggaggaggcgcagctggccacggtgctggcctacgcgctgagcagccactgccccgacatgcgcgccagggtcgccatgcacctcgtgtgcccctcgcgttacgaggcagccgtgcccgacccccgggagccgggggagtttgccctgctgcggtcctgccaggaggtctttgacaagctagccagggtggcccagcccgggattaattatgcgctgggcaccaatgtctcctaccccaataacctgctgaggaatctggctcgtgagggggccaactatgccctggtgatcgatgtggacatggtgcccagcgaggggctgtggagaggcctgcgggaaatgctggatcagagcaaccagtggggaggcaccgcgctggtggtgcctgccttcgaaatccgaagagcccgccgcatgcccatgaacaaaaacgagctggtgcagctctaccaggttggcgaggtgcggcccttctattatgggttgtgcaccccctgccaggcacccaccaactattcccgctgggtcaacctgccggaagagagcttgctgcggcccgcctacgtggtaccttggcaggacccctgggagccattctacgtggcaggaggcaaggtgcccaccttcgacgagcgctttcggcagtacggcttcaaccgaatcagccaggcctgcgagctgcatgtggcggggtttgattttgaggtcctgaacgaaggtttcttggttcataagggcttcaaagaagcgttgaagttccatccccaaaaggaggctgaaaatcagcacaataagatcctatatcgccagttcaaacaggagttgaaggccaagtaccccaactctccccgacgctgctgagcccttccctcccctaatctgagaagtcagcctcttggctcctcaggccaccatttaggcctgactggggtaagaaatgtcgctccactttacagaggtagctgtggtgttgaaacactggacttggatatggggtgctgggatcgattcctagctttaccactaactagctgtgtggccttgagtaaatcccgttacctctctgagcctcggttaccctgtctgtaaaaagggaggtgagaatacctacctcacggaactgttgggaggctcagatgagatgctatatgtgaaaacattctgtaagcttcgtacaaatgtgaagtattaatattatcgcagtattattgttgttattattattgttattattaacaatcttgggtgggtagtaggagagcaaaaagtatgaatgggatggagctaagaagtctgaatacttaatgaaatggactttttggaaagaaatcagatgaaggcataaaatttagttcttagctcttgaacagaagcctaaaattcctggttctctcagggcttcgccttcaagggttctggaggagggaagggtctgcaggttccatgggtgacagcctgagatctgtcccttcaacgggctgggctgggtatgtgcctaccgatgacaatgtgtaaataaatgcgtgttcacacccaca

SEQ ID NO: 7829 - DNA, 1416 bp, Homo sapiens
agtctgtggccgggtggtcgttgctgcgcgccccgagccccgagagccatgcagatgtcctacgccatccggtgcgccttctaccagctgctgctggccgcgctcatgctggtggcgatgctgcagctgctctacctgtcgctgctgtccggactgcacgggcaggaggagcaagaccaatattttgagttctttcccccgtccccacggtccgtggaccaggtcaaggcgcagctccgcaccgcgctggcctctggaggcgtcctggacgctagcggcgattaccgcgtctacaggggcctgctgaagaccaccatggaccccaacgatgtgatcctggccacgcacgccagcgtggacaacctgctgcacctgtcgggtctgctggagcgctgggagggcccgctgtccgtgtcggtgttcgcggccaccaaggaggaggcgcagctggccacggtgctggcctacgcgctgagcagccgggggagtttgccctgctgcggtcctgccaggaggtctttgacaagctagccagggtggcccagcccgggattaattatgcgctgggcaccaatgtctcctaccccaataacctgctgaggaatctggctcgtgagggggccaactatgccctggtgatcgatgtggacatggtgcccagcgaggggctgtggagaggcctgcgggaaatgctggatcagagcaaccagtggggaggcaccgcgctggtggtgcctgccttcgaaatccgaagagcccgccgcatgcccatgaacaaaaacgagctggtgcagctctaccaggttggcgaggtgcggcccttctattatgggttgtgcaccccctgccaggcacccaccaactattcccgctgggtcaacctgccggaagagagcttgctgcggcccgcctacgtggtaccttggcaggacccctgggagccattctacgtggcaggaggcaaggtgcccaccttcgacgagcgctttcggcagtacggcttcaaccgaatcagccaggcctgcgagctgcatgtggcggggtttgattttgaggtcctgaacgaaggtttcttggttcataagggcttcaaagaagcgttgaagttccatccccaaaaggaggctgaaaatcagcacaataagatcctatatcgccagttcaaacaggagttgaaggccaagtaccccaactctccccgacgctgctgagcccttccctcccctaatctgagaagtcagcctcttggctcctcaggccaccatttaggcctgactggggtaagaaatgtcgctccactttacagaggtagctgtggtgttgaaacactggacttggatatggggtgctgggatcgattcctagctttaccactaactagctgtgtggccttgagtaaatcccgttacctctctg

SEQ ID NO: 7830 - DNA, 2763 bp, Homo sapiens
ggagcctggagtgaggcgcagcggcagcggcagcagcggcaacaagtgccggaggctagcagagccaagccggagcagtccctgccgccgacaccgccgggccgcccgtccggggcgccgcgcatggagcgtgagctgcggcggtcgccgggctgagccgcgcggagcggccgggacgtggatgtggccgcgatctcccgcccttgcccccgccccgccgagctggagctgctcccggacaagatatgagaaatgagtgttggacgtcgaagaataaagttgttgggtatcctgatgatggcaaatgtcttcatttattttattatggaagtctccaaaagcagtagccaagaaaaaaatggaaaaggggaagtaataatacccaaagagaagttctggaagatatctacccctcccgaggcatactggaaccgagagcaagagaagctgaaccggcagtacaaccccatcctgagcatgctgaccaaccagacgggggaggcgggcaggctctccaatataagccatctgaactactgcgaacctgacctgagggtcacgtcggtggttacgggttttaacaacttgccggacagatttaaagactttctgctgtatttgagatgccgcaattattcactgcttatagatcagccggataagtgtgcaaagaaacctttcttgttgctggcgattaagtccctcactccacattttgccagaaggcaagcaatccgggaatcctggggccaagaaagcaacgcagggaaccaaacggtggtgcgagtcttcctgctgggccagacacccccagaggacaaccaccccgacctttcagatatgctgaaatttgagagtgagaagcaccaagacattcttatgtggaactacagagacactttcttcaacttgtctctgaaggaagtgctgtttctcaggtgggtaagtacttcctgcccagacactgagtttgttttcaagggcgatgacgatgtttttgtgaacacccatcacatcctgaattacttgaatagtttatccaagaccaaagccaaagatctcttcataggtgatgtgatccacaatgctggacctcatcgggataagaagctgaagtactacatcccagaagttgtttactctggcctctacccaccctatgcagggggaggggggttcctctactccggccacctggccctgaggctgtaccatatcactgaccaggtccatctctaccccattgatgacgtttatactggaatgtgccttcagaaactcggcctcgttccagagaaacacaaaggcttcaggacatttgatatcgaggagaaaaacaaaaataacatctgctcctatgtagatctgatgttagtacatagtagaaaacctcaagagatgattgatatttggtctcagttgcagagtgctcatttaaaatgctaaaatagatacaaactcaattttgcatagaaaggtgtattttgaatagttcccatgttgtgttctcacattagagtaatttctatattaaaccatgaaaattgcctttatgagtgatacccatttgagggcctctaaacccttcaatttggtactcacgtgaagagggaaagcggaagatggtaatttttttttatggatgatatggcaggatgattggttctgatcttaccggctagtggtcatttttaaaaaacttgtaccctcttatctgaaatcctgtttctggaatttggccattttaagtgattttgtttgccctcttctataatattcctacttcccataataatgactgatttatttgtaattcaggtatttataaacctattggctacaaagactttgttaaacattatccagtggttttcgtgaaatggaattatgtttatttttatgggatttgggtaaattttaaattgtctagaaaactgaaatttcagttgtcagttgtggaattcagtttttcaattgtggaaatttcctgccaccccaacagtatttttgtgtgttaattaattttgcaaaatgagaatcatggtgtgacactcatctaatttatcttgttgtgatgttatggtcataataaggagaaagagggtttaatttttcttgtatttggtttcctggtggtatcatagtgtaattttagtatttgaaaatcagtgtgattccttaatggccaactgaagattgaattgccgctaacaaccatatcgtgttagtgaattttcaatatggaccaggaaggcatatgtattttgaacttgagtgaaaaggttgaagttacagacttttgcatagatggtttgtcaatttaaaattccagaatttattattgccatattttcacatgctgcttatacaagattattattgagtagtaactgcttccctgtctatgtagaagtgcctgtgtttttatttattgttcagatcaaagaccaaaacattttcttaaatatattttatgtaatattttatttgtatacagtgttgttgatgaaatatttaactagagcatgatattttaaatgttaaggtgtaacatatgttaaataaaactgttatttttgaattttaaaatttgttttttgggggtatgaactactagagtttaaaattctgccaaactattacttatatgtactattgtgtaacatactttcttgaaatatttttgtttatagaattgaaggttcttatcagatgggatactggggactataaacaatggaaataaagccactgtatttttaa

SEQ ID NO: 7831 - DNA, 2436 bp, Homo sapiens
agagccatttagctgcaaactgtctctgtctctgtttatccgagcagaacctggaaggggctggcaaggactaggcaacagatgggacagccagagagatatgagaaatgagtgttggacgtcgaagaataaagttgttgggtatcctgatgatggcaaatgtcttcatttattttattatggaagtctccaaaagcagtagccaagaaaaaaatggaaaaggggaagtaataatacccaaagagaagttctggaagatatctacccctcccgaggcatactggaaccgagagcaagagaagctgaaccggcagtacaaccccatcctgagcatgctgaccaaccagacgggggaggcgggcaggctctccaatataagccatctgaactactgcgaacctgacctgagggtcacgtcggtggttacgggttttaacaacttgccggacagatttaaagactttctgctgtatttgagatgccgcaattattcactgcttatagatcagccggataagtgtgcaaagaaacctttcttgttgctggcgattaagtccctcactccacattttgccagaaggcaagcaatccgggaatcctggggccaagaaagcaacgcagggaaccaaacggtggtgcgagtcttcctgctgggccagacacccccagaggacaaccaccccgacctttcagatatgctgaaatttgagagtgagaagcaccaagacattcttatgtggaactacagagacactttcttcaacttgtctctgaaggaagtgctgtttctcaggtgggtaagtacttcctgcccagacactgagtttgttttcaagggcgatgacgatgtttttgtgaacacccatcacatcctgaattacttgaatagtttatccaagaccaaagccaaagatctcttcataggtgatgtgatccacaatgctggacctcatcgggataagaagctgaagtactacatcccagaagttgtttactctggcctctacccaccctatgcagggggaggggggttcctctactccggccacctggccctgaggctgtaccatatcactgaccaggtccatctctaccccattgatgacgtttatactggaatgtgccttcagaaactcggcctcgttccagagaaacacaaaggcttcaggacatttgatatcgaggagaaaaacaaaaataacatctgctcctatgtagatctgatgttagtacatagtagaaaacctcaagagatgattgatatttggtctcagttgcagagtgctcatttaaaatgctaaaatagatacaaactcaattttgcatagaaaggtgtattttgaatagttcccatgttgtgttctcacattagagtaatttctatattaaaccatgaaaattgcctttatgagtgatacccatttgagggcctctaaacccttcaatttggtactcacgtgaagagggaaagcggaagatggtaatttttttttatggatgatatggcaggatgattggttctgatcttaccggctagtggtcatttttaaaaaacttgtaccctcttatctgaaatcctgtttctggaatttggccattttaagtgattttgtttgccctcttctataatattcctacttcccataataatgactgatttatttgtaattcaggtatttataaacctattggctacaaagactttgttaaacattatccagtggttttcgtgaaatggaattatgtttatttttatgggatttgggtaaattttaaattgtctagaaaactgaaatttcagttgtcagttgtggaattcagtttttcaattgtggaaatttcctgccaccccaacagtatttttgtgtgttaattaattttgcaaaatgagaatcatggtgtgacactcatctaatttatcttgttgtgatgttatggtcataataaggagaaagagggtttaatttttcttgtatttggtttcctggtggtatcatagtgtaattttagtatttgaaaatcagtgtgattccttaatggccaactgaagattgaattgccgctaacaaccatatcgtgttagtgaattttcaatatggaccaggaaggcatatgtattttgaacttgagtgaaaaggttgaagttacagacttttgcatagatggtttgtcaatttaaaattccagaatttattattgccatattttcacatgctgcttatacaagattattattgagtagtaactgcttccctgtctatgtagaagtgcctgtgtttttatttattgttcagatcaaagaccaaaacattttcttaaatatattttatgtaatattttatttgtatacagtgttgttgatgaaatatttaactagagcatgatattttaaatgttaaggtgtaacatatgttaaataaaactgttatttttgaa

SEQ ID NO: 7832 - DNA, 4123 bp, Homo sapiens
atcccgcccgcatacagcccgcatcccgccggggaagcgagcccagtccagcgctgcccgtccagtcctcgcccaagatttaaagcccgcaagttttgttcttgagaccagcgactttagctccgatgcgggaaggaaagccgacctccgatttggacatttaaagagctgggcttgaacttcgtgagtttcgctctaaactgcccttgaaatgaagctggacttggaggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaatattttgaaagcctagtccatcagaatgtttctttgattctagaagctgtttaatatcacttatctacttcattgcctaagttcatttcaaagaatttgtatttagaaaaggtttatattattagtgaaaacaaaactaaagggaagttcaagttctcatgtaatgccacatatatacttgaggtgtagagatgttattaagaagttttgatgttagaataattgcttttggaaaataccaaatgaacgtacagtacaacatttcaaggaaatgaatatattgttagaccaggtaagcaagtttatttttgttaaagagcacttggtggaggtagtaggggcagggaaaggtcagcataggagagaaagttcatgaatctggtaaaacagtctcttgttcttaagaggagatgtagaaaaatgtgtacaatgttattataaacagacaaatcacgtcttaccacatccatgtagctactggtgttagagtcattaaaatacctttttttgcatcttttttcaaagtttaatgtgaacttttagaaaagtgattaatgttgccctaatactttatatgtttttaatggatttttttttaagtattagaaaatgacacataacacgggcagctggttgctcatagggtccttctctagggagaaaccattgttaattcaaataagctgattttaatgacgttttcaactggtttttaaatattcaatattggtctgtgtttaagtttgttatttgaatgtaatttacatagaggaatataataatggagagacttcaaatggaaagacagaacattacaagcctaatgtctccataattttataaaatgaaatcttagtgtctaaatccttgtactgattactaaaattaacccactcctccccaacaaggtcttataaaccacagcactttgttccaagttcagagttttaaattgagagcattaaacatcaaagttataatatctaaaacaatttatttttcatcaataactgtcagaggtgatctttattttctaaatatttcaaacttgaaaacagagtaaaaaagtgatagaaaagttgccagtttggggttaaagcatttttaaagctgcatgttccttgtaatcaaagagatgtgtctgagatctaatagagtaagttacatttattttacaaagcaggataaaaatgtggctataatacacactacctcccttcactacagaaagaactaggtggtgtctactgctagggagattatatgaaggccaaaataatgacttcagcaagagtgactgaactcactctaaggcctttgactgcagaggcacctgttagggaaaatcagatgtctcatataataaggtgatgtcggaaacacgcaaaacaaaacgaaaaaagatttctcagtatacacaactgaatgatgatacttacaatttttagcaggtagctttttaatgtttacagaaattttaatttttttctattttgaaatttgaggcttgtttacattgcttagataatttagaatttttaactaatgtcaaaactacagtgtcaaacattctaggttgtagttactttcagagtagatacagggttttagatcattacagtttaagttttctgaccaattaaaaaaacatagagaacaaaagcatatttgaccaagcaacaagcttataattaatttttattagttgattgattaatgatgtattgccttttgcccatatataccctgtgtatctatacttggaagtgtttaaggttgccattggttgaaaacataagtgtctctggccatcaaagtgatcttgtttacagcagtgcttttgtgaaacaattatttatttgctgaaagagctcttctgaactgtgtccttttaatttttgcttagaatagaatggaacaagtttaaatttcaaggaaatatgaaggcacttcctttttttctaagaaggaagttgctagatgattccttcatcacacttacttaaagtactgagaagagtatctgtaaataaaagggttccaaccttttaaaaaagaaggaaaaaactttttggtgctccagtgtagggctatctttttaaaaaatgtcaacaaagggaaaataaactatcagcttggatggtcacttgaatagaagatggttatacacagtgttattgttaaaatttttttaccttttggttggtttgcatcttttttccatattgttaattttataccaaaatgttaaatatttgtattacttgaattttgctcttgtatggcaaaataattagtgagtttaaaaaaaatctatagtttccaataaacaactgaaaaattatcatga

SEQ ID NO: 7833 - DNA, 3368 bp, Homo sapiens
ctgggccggtggttccgcgcggagttagtctgtggtcagttacgtggtgaaaacacggctgtgccgcggccgcatctttccgcggccgaggcctctctgggtgggagtgttggcttcctttccggatcgctaaatggggaaagttctggccgctcggcgggatacgtctccaggccacggatggttcgttctccgtgccgcggccccgagctgggctccctgggtctccagcgcgggctcccggcattgggggctgcgggccggcccctccgccccgcccccgccccgccgcgcctcctcggccgagcggctcgcggtctccggcgcgggaggctccgagtctgcccactccgggccgagcgaggtctctggaggagaagagtggcgaggaggtgagggcacgccggccctcgcccggcgggtggcgccaggacttcaggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaatattttgaaagcctagtccatcagaatgtttctttgattctagaagctgtttaatatcacttatctacttcattgcctaagttcatttcaaagaatttgtatttagaaaaggtttatattattagtgaaaacaaaactaaagggaagttcaagttctcatgtaatgccacatatatacttgaggtgtagagatgttattaagaagttttgatgttagaataattgcttttggaaaataccaaatgaacgtacagtacaacatttcaaggaaatgaatatattgttagaccaggtaagcaagtttatttttgttaaagagcacttggtggaggtagtaggggcagggaaaggtcagcataggagagaaagttcatgaatctggtaaaacagtctcttgttcttaagaggagatgtagaaaaatgtgtacaatgttattataaacagacaaatcacgtcttaccacatccatgtagctactggtgttagagtcattaaaatacctttttttgcatcttttttcaaagtttaatgtgaacttttagaaaagtgattaatgttgccctaatactttatatgtttttaatggatttttttttaagtattagaaaatgacacataacacgggcagctggttgctcatagggtccttctctagggagaaaccattgttaattcaaataagctgattttaatgacgttttcaactggtttttaaatattcaatattggtctgtgtttaagtttgttatttgaatgtaatttacatagaggaatataataatggagagacttcaaatggaaagacagaacattacaagcctaatgtctccataattttataaaatgaaatcttagtgtctaaatccttgtactgattactaaaattaacccactcctccccaacaaggtcttataaaccacagcactttgttccaagttcagagttttaaattgagagcattaaacatcaaagttataatatctaaaacaatttatttttcatcaataactgtcagaggtgatctttattttctaaatatttcaaacttgaaaacagagtaaaaaagtgatagaaaagttgccagtttggggttaaagcatttttaaagctgcatgttccttgtaatcaaagagatgtgtctgagatctaatagagtaagttacatttattttacaaagcaggataaaaatgtggctataatacacactacctcccttcactacagaaagaactaggtggtgtctactgctagggagattatatgaaggccaaaataatgacttcagcaagagtgactgaactcactctaaggcctttgactgcagaggcacctgttagggaaaatcagatgtctcatataataaggtgatgtcggaaacacgc

SEQ ID NO: 7834 - DNA, 608 bp, Homo sapiens
agtttgctgtaagtttccttactttgttactgaggcccccagagctccacgcataagtggtgtgaccagaaaccttttaacaagacccgcctgagcctgcgttagagctcccgctcggaaagtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctg

SEQ ID NO: 7835 - DNA, 684 bp, Homo sapiens
gaacgccgcgcccaccaattcggttgccggccgggggccccaggcttgcggccacccgcctccggctggagggctgaattcgagtcgaaagcccgtgtcgggctggaaagaagaaaccgccaacctgagaacgctttcggtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaa

SEQ ID NO: 7836 - DNA, 1766 bp, Homo sapiens
tgcacccacagcagtctgttgtggatggttgctgagctgcgcattcggcattgggcttgctttgtttcctgccaggcccagcattttcttctaccagatcggcaggcttgtgggcttcttcctaggtccctcccctgcactctgaataggaaagctggaagctgtgctttagagaagctttaagacgccgaaagaaaccagaagagtgagcgccagttgtatgtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatacctcataaatagctatgactttgtgaatgataccctgtctcttaagcacacctcagcggggcctcgctaccaatacttgattaaccacaaggaaaagtgtcaagctcaagacgtcctccttttactgtttgtaaaaactgctcctgaaaactatgatcgacgttccggaattagaaggacgtggggcaatgaaaattatgttcggtctcagctgaatgccaacatcaaaactctgtttgccttaggaactcctaatccactggagggagaagaactacaaagaaaactggcttgggaagatcaaaggtacaatgatataattcagcaagactttgttgattctttctacaatcttactctgaaattacttatgcagttcagttgggcaaatacctattgtccacatgccaaatttcttatgactgctgatgatgacatatttattcacatgccaaatctgattgagtaccttcaaagtttagaacaaattggtgttcaagacttttggattggtcgtgttcatcgtggtgcccctcccattagagataaaagcagcaaatactacgtgtcctatgaaatgtaccagtggccagcttaccctgactacacagccggagctgcctatgtaatctccggtgatgtagctgccaaagtctatgaggcatcacagacactaaattcaagtctttacatagacgatgtgttcatgggcctctgtgccaataaaatagggatagtaccgcaggaccatgtgtttttttctggagagggtaaaactccttatcatccctgcatctatgaaaaaatgatgacatctcatggacacttagaagatctccaggacctttggaagaatgctacagatcctaaagtaaaaaccatttccaaaggtttttttggtcaaatatactgcagattaatgaagataattctcctttgtaaaattagctatgtggacacatacccttgtagggctgcgtttatctaatagtacttgaatgttgtatgttttcactgtcactgagtcaaacctggatgaaaaaaacctttaaatgttcgtctataccctaagtaaaatgaggacgaaagacaaa

SEQ ID NO: 7837 - DNA, 614 bp, Homo sapiens
attcggcattgggcttgctttgtttcctgccaggcccagcattttcttctaccagatcggcaggcttgtgggcttcttcctaggtccctcccctgcactctgaataggaaagctggaagctgtgctttagagaagctttaagacgccgaaagaaaccagaagagtggcatggaatattcacatgggagagccgcatgaggccgcccaccacgcttcctgaaggatgcccgtgtggaagaattttgacgtgccagtgtcctcgttctacagggtgttccattcttccgcaatctcagaaaaatgggactaaaagaaactattttgtaaaataagaagacttccatttttaatgaccaacatgtattaagatggacacctactctacgaaacacgaagttctatggtctcgaagaagcccgtgcctgtttaaaactgatcctaactaaaaacagacttgagtggatatgagaatgttggttagtggcagaagagtcaaaaaatggcagttaattattcagttatttgctacttgttttttagcgagcctcatgtttttttgggaaccaatcgataatcacattgtgagccatatgaagtcatattcttacagatac

SEQ ID NO: 7838 - DNA, 3706 bp, Homo sapiens
gcttggggagcctaggggccgtctcggagaaatggggtggtccccgccaggcggcggcggggcgggccctgggcgccgaaggggttaaggcacctgggccaccgcccctgccggcccctcctcccgcggccgggaagaggaaagtcgcggcgggggcgcggcccggtctccgtccccacccgcccgccgtcccgccggcccgagccgtggcgcccagagctgcgagccgctcgcccctccgccgctccggcccgggccgccatgtcgctgtggaagaaaaccgtctaccggagtctgtgcctggccctggccctgctcgtggccgtgacggtgttccaacgcagtctcacccctggtcagtttctgcaggagcctccgccacccaccctggagccacagaaggcccagaagccaaatggacagctggtgaaccccaacaacttctggaagaacccgaaagatgtggctgcgcccacgcccatggcctctcaggggccccaggcctgggacgtgaccaccactaactgctcagccaatatcaacttgacccaccagccctggttccaggtcctggagccgcagttccggcagtttctcttctaccgccactgccgctacttccccatgctgctgaaccacccggagaagtgcaggggcgatgtctacctgctggtggttgtcaagtcggtcatcacgcagcacgaccgccgcgaggccatccgccagacctggggccgcgagcggcagtccgcgggtgggggccgaggcgccgtgcgcaccctcttcctgctgggcacggcctccaagcaggaggagcgcacgcactaccagcagctgctggcctacgaagaccgcctctacggcgacatcctgcagtggggctttctcgacaccttcttcaacctgaccctcaaggagatccacttcctcaagtggctggacatctactgcccccacgtccccttcattttcaaaggcgacgatgacgtcttcgtcaaccccaccaacctgctagaatttctggctgaccggcagccacaggaaaacctgttcgtgggcgatgtcctgcagcacgctcggcccattcgcaggaaagacaacaaatactacatcccgggggccctgtacggcaaggccagctatccgccgtatgcaggcggcggtggcttcctcatggccggcagcctggcccggcgcctgcaccatgcctgcgacaccctggagctctacccgatcgacgacgtctttctgggcatgtgcctggaggtgctgggcgtgcagcccacggcccacgagggcttcaagactttcggcatctcccggaaccgcaacagccgcatgaacaaggagccgtgctttttccgcgccatgctcgtggtgcacaagctgctgccccctgagctgctcgccatgtgggggctggtgcacagcaatctcacctgctcccgcaagctccaggtgctctgaccccagccgggctactaggacaggccagggcacttgctcctgagcccccatggtattggggctggagccacagtgcccaggcctagcctttggtccccaaggggaggtggagggttgaggcctacgtgccactgggtgtggtggggtgcaggtagccagaaagggacctccctgtgtggataattctaggaaactgaggcccaggaacggttggagctgcccagtctggaggccctctctgaggagcgaggcgccaggccctggcagccctcctgacctgggtccgttgctggccccctcagatgtggtgggaggtcctggtgacctctggaggaacgctgtgctcaggtacctgggctaggcctggcctgatgggtctgtggccgcccctcgtcttcacagggaagagtcttctgtgaaatgcctcagtctccccagaggccgggcggccctggcaggagaaactcaaccctgtgcgggctcacaggcaccccccagtccacaccctggtctcctgggagagagggcccagccggctctccgcagccccaggcctgcctggagacgggccgcctctgccacagggcctccactcctggctgtgtcctgtaaggtctggaagggcgaccgctctgactacctcagcgcccctcagaatctccctggggctgcagccctaccccaccccgacacagggcagaagagcagcgctcctggccccccgaagtcccagagctgctgacccccaccccaggcaagtctctcccgcagcccccacacccccaggcctggctccctggctggaaagcagccggtttggccctggaagtggacattcctctattactgtgaagttttatttatgaagaatttggagggagaaggctccaggcttcaggagggggtggtgtcctccctggccctcctcccttccctcccctcattccagctgcctgccctcagcacccccaggcccctcacagcccagccccctccagagccctgccccaccgcaccctgcttctccagggcctagcagaccagcatctgccccggtgaagggatggatcagctgtgggggtgggtgcagaaggttgccacctcctacctcagcgggagtcacctaggaaagatggagggattgacactattttctcaataaaatgggacttttttttttttttttttttttttttggtgtgaaacttcctgttcccagctgcatcagagagcctgtctggggccaaggttgccagagatttctgaagacacagcttgttccttgttcttggctggtgggtgcacaaggacttctggaagggatttagacggggctgagtgctaggattaaagtggggatgggagtacggcaacagaaaaacctgggagctagcaatgcacccagcccttgactgtgccctggtggacagccgagctgtggctctagcgtgagccagtgccttcctgtccctgccaagggtgaggccagagttggccccgaggctaatgtttcagtgggtgagattaggtcggccgtacagaggccggtgggctccctgacatcccttccaggcaacctgaaagcactgaaatagcttatggccctgtgccagggaccttggcccaagctgctgacctccagggtggggagggagctacccccaggagaagagtcactcagacagcagtatgagcaagccagccagcagctccgtgcctgcacccagctcaggggaatcccagggggttcagatgcccaggaaggaaaaggggacagcgctactgctatggaatgagaccaccacttctcctgttgtccttcccagcttctccccaacctccccttttccctagtttataagacaggagaaaagggagaaagcaaaaagctggaaagaaacagaagtaagataaatagctagacgaccttggcgccaccacctggccctggtggttaaaatgataataatattaacccctgaccaaaacgactggtgttatctgtaaatcccagacattgtgtgagaaagcaccgtaaaactttttgtcctattagctgatgtgtgtagcccccagtcacgttcctcacgcttacttgatctattatgaccctttcacgtggaccccttagagttgtaagctcttaaaagggctaggaatttctttttcggggagctcggctcttaagacgcgagtctgccgacgctcccggccgaataaaaacctcttccttctttaa

SEQ ID NO: 7839 - DNA, 1873 bp, Homo sapiens
tcttcctccagctgttcccacaggctccattattcaaactttgggggaggaaatcagggctggacagatcatcaactgctgctgctgacagactgtgttcctgccatgatggggacaggcctgccccaaaccaggctgtctcaccagaaaccagccctaacacgccagagccccatctctcaggtcggcctcctgccctcctccctccctccctccctccctctctcctgcctcagccccgccccggcccctggggccctccctgctcccgctccactcccctccccgcccctctggactggctgggcagggctgggccccgccggtcgacaacacaggggctggggcaggcagatcagagggagctgagggaggcctgacctgaggccggcacccggagctggcgggagccagacccagagctcccgcggccgccccttccctgggccgggtcatgcgctgccccaagtgccttctctgcctgtcagcactgctcacactcctgggcctcaaagtgtacatcgagtggacatccgagtcccggctcagcaaggcctaccccagccctcggggcaccccgccaagccccacgccagccaaccctgagcccaccctacctgccaacctctccacccgcctgggccagactatcccgctgccctttgcttactggaaccagcagcagtggcggctggggtccctgcccagtggggacagcactgaaacggggggctgccaggcttggggggccgccgccgccaccgagatccctgacttcgcctcctaccccaaggacctccgccgcttcttgctgtcagcagcctgccggagcttcccacagtggctgcctggaggtggtggcagccaagtctccagctgctcagatactgatgtcccctacctgctgttggccgtcaagtcagaaccagggcgctttgcagaacgacaggccgtgagagagacgtggggcagtccagctccagggatccggctgctcttcctgctagggtctccggtgggtgaggcggggcctgacctagactcactagtggcctgggagagccgtcgctacagtgacctgctgctctgggacttcctcgacgtcccattcaaccagacgctcaaagacctgctgctgctggcctggctgggccgccactgccccaccgtgagttttgtcttgcgagctcaggacgatgcctttgtacacacccctgccctgctggctcacctgcgggccctgccacctgcctcggcccgaagcctctacctgggtgaggtctttacccaggccatgcctctccggaagccaggaggacccttctatgtgcccgagtccttcttcgaaggtggctacccagcctatgcaagcgggggtggctacgtcattgccgggcgcctggcaccctggctgctgcgggcggcagcccgtgtggcacccttcccctttgaggacgtctacactggcctttgcatccgagccctgggcctggtgccccaggcccacccaggcttcctcacagcctggccagcagaccgcactgcggaccactgtgctttccgcaacctgctgctggtacggcccctgggcccccaggccagcattcggctctggaaacaactgcaagacccaaggctccagtgctgactctcattggggagggcggaggtgctgacctggcctgggcctctggggccggcccctggctcagcccctccttccaggtcttgatgggagggaggagggcccagaagctggacaacttaagccactccttggcctcccccagccaggggcctgggcaggaaagatggggtggtggactgtttttgcctactttttgtttttgaaaaacatgcactccccactctg

SEQ ID NO: 7840 - DNA, 1209 bp, Homo sapiens
atgaggaggaggctgcgcctacgcagggacgcattgctcacgctgctccttggcgcctccctgggcctcttactctatgcgcagcgcgacggcgcggccccgacggcgagcgcgccgcgagggcgagggagggcggcaccgaggcccacccccggaccccgcgcgttccagttacccgacgcgggtgcagccccgccggcctacgaaggggacacaccggcgccgcccacgcctacgggaccctttgacttcgcccgctatttgcgcgccaaggaccagcggcggtttccactgctcattaaccagccgcacaagtgccgcggcgacggcgcacccggtggccgcccggacctgcttattgctgtcaagtcggtggcagaggacttcgagcggcgccaagccgtgcgccagacgtggggcgcggagggtcgcgtgcagggggcgctggtgcgccgcgtgttcttgctgggcgtgcccaggggcgcaggctcgggcggggccgacgaagttggggagggcgcgcgaacccactggcgcgccctgctgcgggccgagagccttgcgtatgcggacatcctgctctgggccttcgacgacaccttttttaacctaacgctcaaggagatccactttctagcctgggcctcagctttctgccccgacgtgcgcttcgtttttaagggcgacgcagatgtgttcgtgaacgtgggaaatctcctggagttcctggcgccgcgggacccggcgcaagacctgcttgctggtgacgtaattgtgcatgcgcggcccatccgcacgcgggctagcaagtactacatccccgaggccgtgtacggcctgcccgcctatccggcctacgcgggcggcggtggctttgtgctttccggggccacgctgcaccgcctggctggcgcctgtgcgcaggtcgagctcttccccatcgacgacgtctttctgggcatgtgtctgcagcgcctgcggctcacgcccgagcctcaccctgccttccgcacctttggcatcccccagccttcagccgcgccgcatttgagcaccttcgacccctgcttttaccgtgagctggttgtagtgcacgggctctcggccgctgacatctggcttatgtggcgcctgctgcacgggccgcatgggccagcctgtgcgcatccacagcctgtcgctgcaggccccttccaatgggactcctag

SEQ ID NO: 7841 - DNA, 2969 bp, Homo sapiens
ttgcagatcagtgtgtgagggaactgccatcatgaggtctgacaagtcagctttggtatttctgctcctgcagctcttctgtgttggctgtggattctgtgggaaagtcctggtgtggccctgtgacatgagccattggcttaatgtcaaggtcattctagaagagctcatagtgagaggccatgaggtaacagtattgactcactcaaagccttcgttaattgactacaggaagccttctgcattgaaatttgaggtggtccatatgccacaggacagaacagaagaaaatgaaatatttgttgacctagctctgaatgtcttgccaggcttatcaacctggcaatcagttataaaattaaatgatttttttgttgaaataagaggaactttaaaaatgatgtgtgagagctttatctacaatcagacgcttatgaagaagctacaggaaaccaactacgatgtaatgcttatagaccctgtgattccctgtggagacctgatggctgagttgcttgcagtcccttttgtgctcacacttagaatttctgtaggaggcaatatggagcgaagctgtgggaaacttccagctccactttcctatgtacctgtgcctatgacaggactaacagacagaatgacctttctggaaagagtaaaaaattcaatgctttcagttttgttccacttctggattcaggattacgactatcatttttgggaagagttttatagtaaggcattaggaaggcccactacattatgtgagactgtgggaaaagctgagatatggctaatacgaacatattgggattttgaatttcctcaaccataccaacctaactttgagtttgttggaggattgcactgtaaacctgccaaagctttgcctaaggaaatggaaaattttgtccagagttcaggggaagatggtattgtggtgttttctctggggtcactgtttcaaaatgttacagaagaaaaggctaatatcattgcttcagcccttgcccagatcccacagaaggtgttatggaggtacaaaggaaaaaaaccatccacattaggagccaatactcggctgtatgattggataccccagaatgatcttcttggtcatcccaaaaccaaagcttttatcactcatggtggaatgaatgggatctatgaagctatttaccatggggtccctatggtgggagttcccatatttggtgatcagcttgataacatagctcacatgaaggccaaaggagcagctgtagaaataaacttcaaaactatgacaagcgaagatttactgagggctttgagaacagtcattaccgattcctcttataaagagaatgctatgagattatcaagaattcaccatgatcaacctgtaaagcccctagatcgagcagtcttctggatcgagtttgtcatgcgccacaaaggagccaagcacctgcgatcagctgcccatgacctcacctggttccagcactactctatagatgtgattgggttcctgctggcctgtgtggcaactgctatattcttgttcacaaaatgttttttattttcctgtcaaaaatttaataaaactagaaagatagaaaagagggaatagatctttccaaattcaagaaagacctgatggggtaatcctgttaattccagccacatagaatttggtgaaaaccttgctattttcatattatctattctgttattttatcttagctatatagcctagaattccacgatcatgaggttgtgagtatatctcattctttcgttgtattttcctaggtgtctttactctcttctctcactttgtgacacaaggacatgaatacatctaaattttcctatttctgatatgactgttttgatgatgtcattacttctataaccttaagtgatagggtgacatgcaatatgattattcctggtgtgcgcccaaacacatggatataaagaggtaaaaaacttaaaattcacaaaattcagtaaaccacacaaatcaggtaagtgttctatgagattagctggctatgagaaacataatgatgtttctttttcaatttaaataagcccttctacatagccagcatcagtgatctcagaaaataaattgctaataatgatgacatggcattatgcttagaaaagtttgctgtatttccatagacctcatctagatgtcatggcctacatttctgccatcactcaaccaatacttttttctgttttcttgatgataaaaagacctttctcatgattgccatcaaataacaaaagaaactattttttttctcacatagagaacatgtcagtaagatattcaaggtgaacagattatttttgggattagtaactatttgaaatatgtggtgataattactgagtttataaaatttatttgatagtacacttaaagaagatttatatgtttattctttaaaaatgatgaatactcataattcttatctctataatcaaaagtataatttactgtagaaaaataaagagatgcttgttctgaaagtaagatcagtgaactgcttttcagtctcaatctttgagaattgtaaattcatcaaataattgcttacatagtaaaaatttaaggtattagaaaacctgcataacaaatagtattatatattaaatattttgatatgtaaagctctacacaaagctaaatatagtgtaataatgtttacactaataagcaaatatgttaatcttctcatttttttactgtcatataatcttagtgatatgcctattaatagttttaaataaataaattggctcatctggctttttgaaaattttgaaattcttacagatgttgattaggtatatctacaaattaatttcaattttaaaatgatgatataaaaataaatataagtatttttcttgtgtatgtatacaataaatataaataaaattgtttactgttttgaaagttt

SEQ ID NO: 7842 - DNA, 1638 bp, Homo sapiens; identical to SEQ ID NO: 7818

SEQ ID NO: 7843 - DNA, 2756 bp, Homo sapiens
aaaagaattatcacattgcacaaggatggctctgaaatggactacagttctgctgatacaactcagtttttactttagctctgggagttgtggaaaggtgctggtatgggccgcagaatacagcctttggatgaatatgaagacaatcctgaaagaacttgttcagagaggtcatgaggtgactgtactggcatcttcagcttccattctttttgatcccaacgactcatccactcttaaacttgaagtttatcctacatctttaactaaaactgaatttgagaatatcatcatgcaattggttaagagattgtcagaaattcaaaaagatacattttggttacctttttcacaagaacaagaaatcctgtgggcaattaatgacataattagaaacttctgtaaagatgtagtttcaaataagaaacttatgaaaaaactacaagagtcaagatttgacatcgtttttgcagatgcttatttaccctgtggtgagctgctggctgagctatttaacataccctttgtgtacagtcacagcttcagtcctggctactcatttgaaaggcacagtggaggatttattttccctccttcctacgtacctgttgttatgtcaaaattaagtgatcaaatgactttcatggagagggtaaaaaatatgctctatgtgctttattttgacttttggttccaaatatttaatatgaagaagtgggatcagttttacagtgaagttttaggaagacccactacattatctgagacaatgaggaaagctgacatatggcttatgcgaaactcctggaattttaaatttcctcatccattcttaccaaatgttgattttgttggaggactccactgcaaacctgccaaacccctacctaaggaaatggaggagtttgtacagagctctggagaaaatggtgttgtggtgttttctctggggtcaatggtcagtaacatgacagaagaaagggccaacgtaattgcaacagcccttgccaagatcccacaaaaggttctttggagatttgatgggaataaaccagatgccttaggtctcaatactcgactgtacaagtggataccccagaatgaccttctaggtcatccaaaaaccagagcttttataactcatggtggagccaatggcatctatgaggcaatctaccatgggatccctatggtgggcattccattgttttttgatcaacctgataatattgctcacatgaaggccaagggagcagctgttagagtggacttcaacacaatgtcgagtacagacctgctgaatgcactgaagacagtaattaatgatccttcatataaagagaatattatgaaattatcaagaattcaacatgatcaaccagtgaagcccctggatcgagcagtcttctggattgaatttgtcatgcgccacaaaggagccaaacatcttcgagttgcagcccacaacctcacctggttccagtaccactctttggatgtgattgggttcctgctggcttgtgtggcaaccgtgctatttatcatcacaaagtgttgtctgttttgtttctggaagtttgctagaaaaggaaagaagggaaaaagggattagttatatctgagatttgaagctggaaaacctgatagataggaatacttcagttgattccagcaataaatattgtgatgcaagatttctttcttcctgtgacaaaaaaaaatcctttcgaagtctaccttgtcaagtaaaaatttgtttttcagagatttaccacccagttaatggttagaaatattctgtggcaatgaagaaaacactaggggaaataaaaaataatataaagccatatgagcttgtattgaaatttgttgcacttatattgaaatgtgatcatggctcacttcagcctcaacttactaagctcaagaggttctctcacctcagccccccaagtagctgggaccataggtgcatgtcaccatgtccaactaattttttattttttgtagtgatgagatctcattgtgttctccatgctgatttcaaactcctgggctcaaacaatcctcccattttagcatcccaaagggatgagattacaggtatgtaccaccataactttacaaaatgagatttttatataagaatgattcaaatgttcagggatgaaagagtcactaacataaaagaagaatgggatgaggtgagaaggatgaatacaaaaataattagatattcttgaaatcagaaatgtgctccctaattatatgaaatgttgtttgattacataaaataaagtggaaatgaatgattgactgaacagcccacaagaagaatcacttaatgctctgaaaattaccagtaaactgattaaaatctaaaattgctttctgttaaagctttactgattagtttttcttccaaagctctcttgtttctagttgttttcttggtcttaactacccattatatgctttgttaaagtgtttatgccctgattcaatgtgattatctcaatttttatttcattctgtcctaactcttgcaacctgcatgtcctctttattattgatcaatccaactgcaaagttcaccttacctgactaaggattattcattaagttttacttgtttatctgacatttattattttgtctctttgctagtcactctgagccatggtcatgatgacttaggattctggatctcttatgaataacaaatttatccttaataaagtctctatactaaagaa

SEQ ID NO: 7844 - DNA, 2482 bp, Homo sapiens
tgtcttccacaggtctatagtgagcgagagctgctactttttacttgggcattcattcaaagtgttgaagaataacagcctctaccatcccttattcactggctcatcagctgtcccaggttttgctcttctaggaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattaggtatgatttttaatgaacgcgatcaagagttgagagacttgggctatcagaaacatgcttttaatatgcttatcagtgaccgcttgggctaccacagagatgtgccagacacaaggaatgcagcatgtaaagaaaagttctacccacctgacctgccagctgctagtgttgttatctgtttctataatgaagcgttttctgccttgcttcggacagtgcacagtgtcatagaccgcacgccagcacacctgcttcatgagatcatccttgtggatgatgatagtgactttgatgatttgaaaggagaactagatgaatatgtccaaaaatacctccctggaaaaattaaagtcataagaaatacaaagcgtgaggggttgattcgagggagaatgattggcgcggcccacgcgacaggagaagtccttgtgttcctggacagccactgtgaagtgaatgtgatgtggctgcagcccttgctggccgccatccgtgaggaccggcacaccgtggtgtgcccagtgattgacatcatcagcgccgacacgctggcctacagctcgtcccctgtcgtccgcggagggttcaactggggactgcacttcaaatgggatcttgtccccctttctgagctaggacgagcggagggagccactgcaccaataaagtcaccaacaatggctggaggtttgtttgccatgaacagacagtatttccatgaacttggacagtatgatagtggcatggatatctggggaggagaaaatttggaaatatcatttcggatctggatgtgtggcggtaagctcttcatcatcccttgctctagagtaggacacattttccgaaaaaggcgaccatatggatctcccgaaggccaggacaccatgacacacaactctttgcggctggcacatgtctggttggatgaatacaaggagcagtatttttccttaagacctgacctgaagacgaaaagctatggcaatatcagtgagcgtgtggaactgagaaagaagttgggctgtaaatcatttaaatggtatttggataatgtatacccagagatgcagatatctgggtcccacgccaaaccccaacaacccatttttgtcaatagagggccaaaacgacccaaagtccttcaacgtggaaggctctatcacctccagaccaacaaatgcctggtggcccagggccgcccaagtcagaagggaggtctcgtggtgcttaaggcctgtgactacagtgacccaaatcagatctggatctataatgaagagcatgaattggttttaaatagtctcctttgtctagatatgtcagagactcgctcatcagacccgccacggctcatgaaatgccacgggtcaggaggatcccagcagtggacctttgggaaaaacaatcggctataccaggtgtcggttggacagtgcctgagagcagtggatcccctgggtcagaagggctctgtcgccatggcgatctgcgatggctcctcttcacagcagtggcatttggaaggttaaggtggatgctgtggtgggaacgttgcttcatcaggcgttgcctccggtgtggagtttggggctttaggaaagcctgggttgggtggagcagaaccatcttggagaagatgacagttccctgtcctcccggagatgcctgggtgtgttagcagaggtgacacgtgtctgacagagacgggagctctgagtgtccacgggtgaagaagtgagtgtccacgggtgaagaagtgagtatgtttcacctggacattaaggtgatgtttgagctgctgttaaggaatttcttgcttatagaggcaaaccacagtatcattttaactctagaattgggcttgtacagaaggataaaacccaggaaaatggatatttctattcagatttatttatgcctctttttaatcccctttaatgatgcagtggtttttatctgatcaggaacttgtcatgatttcctttcttagacttcataggagatagtgcttt

SEQ ID NO: 7845 - DNA, 2555 bp, Homo sapiens
attactcttcccctcccctgccagagggatctctctgggatcttttaccttagtgcctggtggagttcctggaggtaaagcccacagaagtgtgggtctcgcacctcctgagactgcttccccgagtttctcactctcactagtccacaccgagcatccagcaccagcttatggctctggcagtttctgctccaggtctatagtgagcgagagctgctactttttacttgggcattcattcaaagtgttgaagaataacagcctctaccatcccttattcactggctcatcagctgtcccaggttttgctcttctaggaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattaggtatgatttttaatgaacgcgatcaagagttgagagacttgggctatcagaaacatgcttttaatatgcttatcagtgaccgcttgggctaccacagagatgtgccagacacaaggaatgcagcatgtaaagaaaagttctacccacctgacctgccagctgctagtgttgttatctgtttctataatgaagcgttttctgccttgcttcggacagtgcacagtgtcatagaccgcacgccagcacacctgcttcatgagatcatccttgtggatgatgatagtgactttggtaaggaatgctgcacctggtaacattggatccaggctgtcagtcactacagcactgacaaacactaacacagctgaactttcaagtacgtggtaggtggggatcctacacgtgcagtcacagctgggctgaccacaaataagtctgaagaaatccattatctttgtaacctgcttataaactatgctacccaaatttgggccgtgaaattttttccgtggcttactttaaaaaacacacctctttttatttgaaataactgtaggttcacaggaagttacaaagacggcctatgtacctttatccagttgctccatcataaaattcccctgtcagaaccaggaatccacattggtacagtgtgtgtggtccagggtcattctgtcacacaggtggactcccacaaccctcactgcaatgatacagaactgtttcctcacccggagggcccttgtgctgcctctttctagtcacacctcctgctttcctctactcttccccagtccctgaaaccacgactctatgattttgtttccatctctgattttgttatttcaagaatgtcatataaatggaatcacacggtatgtgaccttttgagatgggcttttttcatttggcatgatgccttggcttatgcttctctattaagtctcttacactgatcgtccccagataaaagtggattgcattctgatagctcctcaatgatctctgaatgccagtattttatgattcactacatattctatattctgtacgcctttcttaattcaacatagactcttgctaagaatggctttgtgtacccaaacaggatagaaggctttttattacactgctcattcagctctcagtgaccttgcaagaaaggctggaagcccattttatagagggagaaatataaaaagtaatttgctcagaccccatagctgttaagtagtagagtggaaatgagacctctggtctgcatagctccaagccttctgctcttttcatgacagcaggctgcaggaacacagtggtacaggtgtatgccagtgactttttcatgcactcgagcgtttattaagtaccacttgtatcaacatcagagttggtataccagtatacttaaatatagaaggtaaagaaatggagagagtcatgggagcaaaattctcaaaccttggccaaaaacaaacaaacaaaaaacctaataaataaatctgagtctggaccacgtagaagattggttacatactgatttctagaatttatggttggtttttgtttttttttaagtcaacttgtattttggttttcactttgtggctattttacctaaaaggaaaaattcataatttgaggtggtttgtatattaactatggaaagaattactgcttattatcttacacgatctttcaagttattctgaaatatacaggtgaatgacatagaattccttaaaaaatatttagcaaccttggaagaaagatgctaaattaataaaaggacatattcaatgctgttcttgttattcttggtaggggcaatagaagttgtttcttaactattttgaaatggactaagacttaataaattcctttgtaataaaaggcatttatatctca

SEQ ID NO: 7846 - DNA, 716 bp, Homo sapiens
tttcactgccgttggttctctgagcattaacccacaggcctgaggttttcattgttgaaccctttttaaaaactcagtactatccatacatcttcttgtatttgaatatccgttaactgaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattaggtatgatttttaatgaacgcgatcaagagttgagagacttgggctatcagaaacatgcttttaatatgcttatcagtgaccgcttgggctaccacagagatgtgccagacacaaggaatgcagcatgtaaagaaaagttctacccacctgacctgccagctgctagtgttgttatctgtttctataatgaagcgttttctgccttgcttcggacagtgcacagtgtcatagaccgcacgccagcacacctgcttcatgagatcat

SEQ ID NO: 7847 - DNA, 948 bp, Homo sapiens
attgttgaaccctttttaaaaactcagtactatccatacatcttcttgtatttgaatatccgttaactgaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattagatgtaaagaaaagttctacccacctgacctgccagctgctagtgttgttatctgtttctataatgaagcgttttctgccttgcttcggacagtgcacagtgtcatagaccgcacgccagcacacctgcttcatgagatcatccttgtggatgatgatagtgactttgatgatttgaaaggagaactagatgaatatgtccaaaaatacctccctggaaaaattaaagtcataagaaatacaaagcgtgaggggttgattcgagggagaatgattggcgcggcccacgcgacaggagaagtccttgtgttcctggacagccactgtgaagtgaatgtgatgtggctgcagcccttgctggccgccatccgtgaggaccggcacaccgtggtgtgcccagtgattgacatcatcagcgccgacacgctggcctacagctcgtcccctgtcgtccgcggagggttcaactggggactgcacttcaaatgggatcttgtccccctttctgagctaggacgagcggagggagccactgcaccaataaagtaa

SEQ ID NO: 7848 - DNA, 2720 bp, Homo sapiens
gactgggcgagggccctgggcctgaggaggcgcggccgccactgcgcccagcgcctgcgcgacgcctggctgctgggccccggggcagttcagcccgcgccgctcctgcgggtcggactggggctgtggcgggagagaagatgccgcagcccgagtcccagaaggcggcgatcctgggctgcgggcaaggcggaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattaggtatgatttttaatgaacgcgatcaagagttgagagacttgggctatcagaaacatgcttttaatatgcttatcagtgaccgcttgggctaccacagagatgtgccagacacaaggaatgcagcatgtaaagaaaagttctacccacctgacctgccagctgctagtgttgttatctgtttctataatgaagcgttttctgccttgcttcggacagtgcacagtgtcatagaccgcacgccagcacacctgcttcatgagatcatccttgtggatgatgatagtgactttgatgatttgaaaggagaactagatgaatatgtccaaaaatacctccctggaaaaattaaagtcataagaaatacaaagcgtgaggggttgattcgagggagaatgattggcgcggcccacgcgacaggagaagtccttgtgttcctggacagccactgtgaagtgaatgtgatgtggctgcagcccttgctggccgccatccgtgaggaccggcacaccgtggtgtgcccagtgattgacatcatcagcgccgacacgctggcctacagctcgtcccctgtcgtccgcggagggttcaactggggactgcacttcaaatgggatcttgtccccctttctgagctaggacgagcggagggagccactgcaccaataaagtcaccaacaatggctggaggtttgtttgccatgaacagacagtatttccatgaacttggacagtatgatagtggcatggatatctggggaggagaaaatttggaaatatcatttcggatctggatgtgtggcggtaagctcttcatcatcccttgctctagagtaggacacattttccgaaaaaggcgaccatatggatctcccgaaggccaggacaccatgacacacaactctttgcggctggcacatgtctggttggatgaatacaaggagcagtatttttccttaagacctgacctgaagacgaaaagctatggcaatatcagtgagcgtgtggaactgagaaagaagttgggctgtaaatcatttaaatggtatttggataatgtatacccagagatgcagatatctgggtcccacgccaaaccccaacaacccatttttgtcaatagagggccaaaacgacccaaagtccttcaacgtggaaggctctatcacctccagaccaacaaatgcctggtggcccagggccgcccaagtcagaagggaggtctcgtggtgcttaaggcctgtgactacagtgacccaaatcagatctggatctataatgaagagcatgaattggttttaaatagtctcctttgtctagatatgtcagagactcgctcatcagacccgccacggctcatgaaatgccacgggtcaggaggatcccagcagtggacctttgggaaaaacaatcggctataccaggtgtcggttggacagtgcctgagagcagtggatcccctgggtcagaagggctctgtcgccatggcgatctgcgatggctcctcttcacagcagtggcatttggaaggttaaggtggatgctgtggtgggaacgttgcttcatcaggcgttgcctccggtgtggagtttggggctttaggaaagcctgggttgggtggagcagaaccatcttggagaagatgacagttccctgtcctcccggagatgcctgggtgtgttagcagaggtgacacgtgtctgacagagacgggagctctgagtgtccacgggtgaagaagtgagtgtccacgggtgaagaagtgagtatgtttcacctggacattaaggtgatgtttgagctgctgttaaggaatttcttgcttatagaggcaaaccacagtatcattttaactctagaattgggcttgtacagaaggataaaacccaggaaaatggatatttctattcagatttatttatgcctctttttaatcccctttaatgatgcagtggtttttatctgatcaggaacttgtcatgatttcctttcttagacttcataggagatagtgctttaaaaaaaaaaaaaacttctattatttgtttagtatgttgtaagtagatcattttaaaaaactgaatctatattatgtttaacttcagaaggcatcatttataagacagtatggcagttaattataaaattattttgatgaattatgatacaatctacataataaagaatccttttgatta

SEQ ID NO: 7849 - DNA, 626 bp, Homo sapiens
ctgaggaggcgcggccgccactgcgcccagcgcctgcgcgacgcctggctgctgggccccggggcagttcagcccgcgccgctcctgcgggtcggactggggctgtggcgggagagaagatgccgcagcccgagtcccagaaggcggcgatcctgggctgcgggcaaggcgtcctctgtaagcaggaagtgtcccagtctgacgtggctgctgcgtaaatgtgtccggaattggttccttccagtggattcttggtctcgctgacttcaagaatgaagccacggactgtcgcggaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattag

SEQ ID NO: 7850 - DNA, 2747 bp, Homo sapiens
attttgagttgattttcacatagaggtgggaggctagtttcattcctctgcatatgaatatccagttttcccagtatcatctattgaagatactgtcctttccccaagggatctctctgggatcttttaccttagtgcctggtggagttcctggaggtaaagcccacagaagtgtgggtctcgcacctcctgagactgcttccccgagtttctcactctcactagtccacaccgagcatccagcaccagcttatggctctggcagtttctgctccaggtctatagtgagcgagagctgctactttttacttgggcattcattcaaagtgttgaagaataacagcctctaccatcccttattcactggctcatcagctgtcccaggttttgctcttctaggaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattaggtatgatttttaatgaacgcgatcaagagttgagagacttgggctatcagaaacatgcttttaatatgcttatcagtgaccgcttgggctaccacagagatgtgccagacacaaggaatgcagcatgtaaagaaaagttctacccacctgacctgccagctgctagtgttgttatctgtttctataatgaagcgttttctgccttgcttcggacagtgcacagtgtcatagaccgcacgccagcacacctgcttcatgagatcatccttgtggatgatgatagtgactttgatgatttgaaaggagaactagatgaatatgtccaaaaatacctccctggaaaaattaaagtcataagaaatacaaagcgtgaggggttgattcgagggagaatgattggcgcggcccacgcgacaggagaagtccttgtgttcctggacagccactgtgaagtgaatgtgatgtggctgcagcccttgctggccgccatccgtgaggaccggcacaccgtggtgtgcccagtgattgacatcatcagcgccgacacgctggcctacagctcgtcccctgtcgtccgcggagggttcaactggggactgcacttcaaatgggatcttgtccccctttctgagctaggacgagcggagggagccactgcaccaataaagtcaccaacaatggctggaggtttgtttgccatgaacagacagtatttccatgaacttggacagtatgatagtggcatggatatctggggaggagaaaatttggaaatatcatttcggatctggatgtgtggcggtaagctcttcatcatcccttgctctagagtaggacacattttccgaaaaaggcgaccatatggatctcccgaaggccaggacaccatgacacacaactctttgcggctggcacatgtctggttggatgaatacaaggagcagtatttttccttaagacctgacctgaagacgaaaagctatggcaatatcagtgagcgtgtggaactgagaaagaagttgggctgtaaatcatttaaatggtatttggataatgtatacccagagatgcagatatctgggtcccacgccaaaccccaacaacccatttttgtcaatagagggccaaaacgacccaaagtccttcaacgtggaaggctctatcacctccagaccaacaaatgcctggtggcccagggccgcccaagtcagaagggaggtctcgtggtgcttaaggcctgtgactacagtgacccaaatcagatctggatctataatgaagagcatgaattggttttaaatagtctcctttgtctagatatgtcagagactcgctcatcagacccgccacggctcatgaaatgccacgggtcaggaggatcccagcagtggacctttgggaaaaacaatcggctataccaggtgtcggttggacagtgcctgagagcagtggatcccctgggtcagaagggctctgtcgccatggcgatctgcgatggctcctcttcacagcagtggcatttggaaggttaaggtggatgctgtggtgggaacgttgcttcatcaggcgttgcctccggtgtggagtttggggctttaggaaagcctgggttgggtggagcagaaccatcttggagaagatgacagttccctgtcctcccggagatgcctgggtgtgttagcagaggtgacacgtgtctgacagagacgggagctctgagtgtccacgggtgaagaagtgagtgtccacgggtgaagaagtgagtatgtttcacctggacattaaggtgatgtttgagctgctgttaaggaatttcttgcttatagaggcaaaccacagtatcattttaactctagaattgggcttgtacagaaggataaaacccaggaaaatggatatttctattcagatttatttatgcctctttttaatcccctttaatgatgcagtggtttttatctgatcaggaacttgtcatgatttcctttcttagacttcataggagatagtgcttt

SEQ ID NO: 7851 - DNA, 2567 bp, Homo sapiens
agttcagcccgcgccgctcctgcgggtcggactggggctgaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattaggtatgatttttaatgaacgcgatcaagagttgagagacttgggctatcagaaacatgcttttaatatgcttatcagtgaccgcttgggctaccacagagatgtgccagacacaaggaatgcagcatgtaaagaaaagttctacccacctgacctgccagctgctagtgttgttatctgtttctataatgaagcgttttctgccttgcttcggacagtgcacagtgtcatagaccgcacgccagcacacctgcttcatgagatcatccttgtggatgatgatagtgactttgatgatttgaaaggagaactagatgaatatgtccaaaaatacctccctggaaaaattaaagtcataagaaatacaaagcgtgaggggttgattcgagggagaatgattggcgcggcccacgcgacaggagaagtccttgtgttcctggacagccactgtgaagtgaatgtgatgtggctgcagcccttgctggccgccatccgtgaggaccggcacaccgtggtgtgcccagtgattgacatcatcagcgccgacacgctggcctacagctcgtcccctgtcgtccgcggagggttcaactggggactgcacttcaaatgggatcttgtccccctttctgagctaggacgagcggagggagccactgcaccaataaagtcaccaacaatggctggaggtttgtttgccatgaacagacagtatttccatgaacttggacagtatgatagtggcatggatatctggggaggagaaaatttggaaatatcatttcggatctggatgtgtggcggtaagctcttcatcatcccttgctctagagtaggacacattttccgaaaaaggcgaccatatggatctcccgaaggccaggacaccatgacacacaactctttgcggctggcacatgtctggttggatgaatacaaggagcagtatttttccttaagacctgacctgaagacgaaaagctatggcaatatcagtgagcgtgtggaactgagaaagaagttgggctgtaaatcatttaaatggtatttggataatgtatacccagagatgcagatatctgggtcccacgccaaaccccaacaacccatttttgtcaatagagggccaaaacgacccaaagtccttcaacgtggaaggctctatcacctccagaccaacaaatgcctggtggcccagggccgcccaagtcagaagggaggtctcgtggtgcttaaggcctgtgactacagtgacccaaatcagatctggatctataatgaagagcatgaattggttttaaatagtctcctttgtctagatatgtcagagactcgctcatcagacccgccacggctcatgaaatgccacgggtcaggaggatcccagcagtggacctttgggaaaaacaatcggctataccaggtgtcggttggacagtgcctgagagcagtggatcccctgggtcagaagggctctgtcgccatggcgatctgcgatggctcctcttcacagcagtggcatttggaaggttaaggtggatgctgtggtgggaacgttgcttcatcaggcgttgcctccggtgtggagtttggggctttaggaaagcctgggttgggtggagcagaaccatcttggagaagatgacagttccctgtcctcccggagatgcctgggtgtgttagcagaggtgacacgtgtctgacagagacgggagctctgagtgtccacgggtgaagaagtgagtgtccacgggtgaagaagtgagtatgtttcacctggacattaaggtgatgtttgagctgctgttaaggaatttcttgcttatagaggcaaaccacagtatcattttaactctagaattgggcttgtacagaaggataaaacccaggaaaatggatatttctattcagatttatttatgcctctttttaatcccctttaatgatgcagtggtttttatctgatcaggaacttgtcatgatttcctttcttagacttcataggagatagtgctttaaaaaaaaaaaaaacttctattatttgtttagtatgttgtaagtagatcattttaaaaaactgaatctatattatgtttaacttcagaaggcatcatttataagacagtatggcagttaattataaaattattttgatgaattatgatacaatctacataataaagaatccttttgatta

SEQ ID NO: 7852 - DNA, 717 bp, Homo sapiens
attaacccacaggcctgaggttttcattgttgaaccctttttaaaaactcagtactatccatacatcttcttgtatttgaatatccgttaactgtacgcatagtggtcctacttggtggtttggaaaacagtgattctgtatttggtggatggtttaaagtatactgaagtgtctaacatatttattcttcttttttaggaaattgacaatggcccttcagctatgctaggtctataatgggaagtgtcacagttcggtatttctgttatgggtgcctttttacatctgcgacctggacagttttgctttttgtttatttcaacttcagtgaagtgactcagccacttaagaatgtgcccgtcaaggggtctgggccccacggaccatctccaaaaaaattctatccccgtttcactcgaggcccaagtcgagtgctcgagccacagttcaaagcaaacaaaattgacgatgtgatagacagtcgtgttgaagatccagaagaaggccacttgaaattctcttctgaattaggtatgatttttaatgaacgcgatcaagagttgagagacttgggctatcagaaacatgcttttaatatgcttatcagtgaccgcttgggctaccacagagatgtgccagacacaaggaatgcagcatgtaaagaaaagttctacccacctgacctgccagctgctagtgttgttatctgtttctat

SEQ ID NO: 7853 - DNA, 1736 bp, Homo sapiens
gcgacgcctggctgctgggccccggggcagttcagcccgcgccgctcctgcgggtcggactggggctgtggcgggagagaagatgccgcagcccgagtcccagaaggcggcgatcctgggctgcgggcaaggcggtatgatttttaatgaacgcgatcaagagttgagagacttgggctatcagaaacatgcttttaatatgcttatcagtgaccgcttgggctaccacagagatgtgccagacacaaggaatgcagcatgtaaagaaaagttctacccacctgacctgccagctgctagtgttgttatctgtttctataatgaagcgttttctgccttgcttcggacagtgcacagtgtcatagaccgcacgccagcacacctgcttcatgagatcatccttgtggatgatgatagtgactttgatgatttgaaaggagaactagatgaatatgtccaaaaatacctccctggaaaaattaaagtcataagaaatacaaagcgtgaggggttgattcgagggagaatgattggcgcggcccacgcgacaggagaagtccttgtgttcctggacagccactgtgaagtgaatgtgatgtggctgcagcccttgctggccgccatccgtgaggaccggcacaccgtggtgtgcccagtgattgacatcatcagcgccgacacgctggcctacagctcgtcccctgtcgtccgcggagggttcaactggggactgcacttcaaatgggatcttgtccccctttctgagctaggacgagcggagggagccactgcaccaataaagtcaccaacaatggctggaggtttgtttgccatgaacagacagtatttccatgaacttggacagtatgatagtggcatggatatctggggaggagaaaatttggaaatatcatttcggatctggatgtgtggcggtaagctcttcatcatcccttgctctagagtaggacacattttccgaaaaaggcgaccatatggatctcccgaaggccaggacaccatgacacacaactctttgcggctggcacatgtctggttggatgaatacaaggagcagtatttttccttaagacctgacctgaagacgaaaagctatggcaatatcagtgagcgtgtggaactgagaaagaagttgggctgtaaatcatttaaatggtatttggataatgtatacccagagatgcagatatctgggtcccacgccaaaccccaacaacccatttttgtcaatagagggccaaaacgacccaaagtccttcaacgtggaaggctctatcacctccagaccaacaaatgcctggtggcccagggccgcccaagtcagaagggaggtctcgtggtgcttaaggcctgtgactacagtgacccaaatcagatctggatctataatgaagagcatgaattggttttaaatagtctcctttgtctagatatgtcagagactcgctcatcagacccgccacggctcatgaaatgccacgggtcaggaggatcccagcagtggacctttgggaaaaacaatcggctataccaggtgtcggttggacagtgcctgagagcagtggatcccctgggtcagaagggctctgtcgccatggcgatctgcgatggctcctcttcacagcagtggcatttggaaggttaaggtggatgctgtggtgggaacgttgcttcatcaggcgttgcctccggtgtggagtttggggctttaggaa

SEQ ID NO: 7854 - DNA, 6171 bp, Homo sapiens
gctgaatgaagttttctgggtaatggcatgaaatgttttccttatgagaagtggtgttgagttacagcgtgcagacggagaacggggaggagagaaacggcagtctcaatctggcccccaccttttcttgggcttgtaggaaggtggacatgggctcccggagacaagacaagtgatatgttgaactgttcggtggctggaatcaactgctcctggagtgacctaaggccagtgtttatcagaacttagccagggccagccaagcaggcacagatgctctgctatgaaatgccacgcaggcagagactgacaagcggtaggaactgagctttccccttggactgctgcttcctgctgtgttcaggggagggggtcactttctggcaactctgctgctgctgctgctgctgctgctacttcagcttcctctccactcaaggtaagcaggctaagggagggcaggctgctagggaaagctttgtaccatgaacaggatccgaaagtttttccgaggaagtgggcgagtcttggcatttatctttgtagcttctgtcatctggctcctctttgacatggcagctctccgcctctcattcagtgagatcaacactcgggtcatcaaggaagacattgtgaggagggagcggataggattcagagttcagccagaccaaggaaaaattttttacagcagcataaaagagatgaaacctcccctaaggggacatgggaaaggggcatggggcaaagagaatgttagaaaaactgaggagagtgtgctcaaggttgaggtggacttggaccaaacccagagggaaagaaaaatgcagaatgccctgggaaggggcaaggttgtgccgttgtggcatcctgcacatctgcagaccctccctgtgactcctaacaagcagaagacagacgggagaggcaccaaacctgaagcctcctctcaccaggggacaccaaagcaaacgacagctcagggggctccaaagacctcattcatagcagcaaaaggaactcaggtagtcaaaatatcagtacacatgggacgtgtcagtttaaaacaggagccccggaagagtcatagtcccagcagtgacacatcaaaactagcagctgaaagggacttgaatgtgaccatcagtcttagtactgatagaccaaagcagcgatcacaggcagtagcaaacgagagggcacaccctgccagcacagcagtgccgaagtctggggaagccatggccttaaacaaaactaagactcagagcaaagaagtcaatgcaaataaacacaaagccaatacgagtcttccttttcctaagttcactgtcaattcaaatcgcttaaggaagcaatctattaatgagacacctttgggaagtttgtcaaaggatgatggagctagaggggctcatgggaagaaactcaatttctctgaaagccatcttgtgattataaccaaagaggaagagcaaaaggcagaccccaaagaggtctctaattctaaaaccaaaacaatatttcctaaagtattgggtaaaagccaaagtaaacacatttccaggaatagaagtgagatgtcttcctcttcacttgctccacatagagtgccactgtcccaaactaaccatgctttaactggagggctagagccagcaaaaatcaacataactgccaaagccccctctacagaatacaaccagagtcatataaaagcccttttacctgaagacagtggaacgcaccaggtgttaagaattgatgtgacactttctccaagggaccccaaagctccagggcagtttgggcgtcctgtagttgtcccccatggaaaggagaaggaggcagaaagaagatggaaagaaggaaacttcaatgtctaccttagcgatttgatcccagtggatagagccattgaagacaccagacctgctggatgtgcagagcagctagttcacaataacctcccaaccaccagtgtcatcatgtgctttgtggatgaagtgtggtccactctcctgagatctgttcacagtgtcatcaatcgctctcctccacacctcatcaaggagattctgctggtagatgacttcagcaccaaagactatctaaaagataatttggataaatacatgtcccagtttccaaaagttcggattcttcgcctcaaagagagacatggcttaataagggccaggctggcaggagcacagaatgcaacaggtgatgtgttgacatttttagattctcatgtggaatgtaacgttggttggttggaacctcttctggaaagagtttatttaagtagaaagaaagtggcctgtccagtaatcgaagtcatcaatgataaggatatgagttacatgacagtggataactttcaaagaggcatctttgtgtggcccatgaactttggttggagaacaattcctccagatgtcattgcaaaaaacagaattaaagaaactgatacaataaggtgccctgtcatggctggtggattgttttctattgacaaaagttacttttttgaacttggaacatacgaccctggccttgatgtttggggtggggaaaatatggagctctcattcaaggtgtggatgtgtggtggtgaaattgagatcattccctgctcccgagtgggccatatattcagaaatgacaatccatattccttccccaaagaccggatgaagacagtggagcggaacttggtgcgggttgccgaggtctggctggatgagtataaggagctgttctatggccacggagaccacctcatcgaccaagggctagatgttggcaacctcacccagcaaagggagctgcgaaagaaactgaagtgcaaaagtttcaaatggtacttggagaatgtctttcctgacttaagggctcccattgtgagagctagtggtgtgcttattaatgtggctttgggtaaatgcatttccattgaaaacactacagtcattctggaagactgcgatgggagcaaagagcttcaacaatttaattacacctggttaagacttattaaatgtggagaatggtgtatagcccccatccctgataaaggagccgtaaggctgcacccttgtgataacagaaacaaagggctaaaatggctgcataaatcaacatcagtctttcatccagaactggtgaatcacattgtttttgaaaacaatcagcaattattatgcttggaaggaaatttttctcaaaagatcctgaaagtagctgcctgtgacccagtgaagccatatcaaaagtggaaatttgaaaaatattatgaagcctgaagtgtaactgatgtttttatatagtaaacccattaaatactgtgaaaataacactgaacttggaaactatatttctcagcggtagtttaaattttcaattttaataacatttgaatggaagattttttataaatcacaatatttggaataccaaaagatgactcaggaaaacagtccaacattggactgaagtccttcttcggaactgggtggcctttgaattgcctgctttccaccctatgctagacctcatcatgcaaatttccctgtgaaagctaacaggtaactggaaatgaagacagaaggacttgagaaagcatgaggatattcccaatgactatgtttggtaataatcagctcttctggcccacaagtaggaatgatcaatgagaacttaacttagtcctttatttggggattttttcatcaaacaaaaatttcttgagttcttatggctagaagacctcagatgcccacagctgtcacgtttgtgaaatccctccagactacatgcatgcttacctaacagtttgaaatagtattgatctactgctggtaaccctgcttgatggcagcattttgatctaaattacataatggtttttcccaatctgaatcagtggaaaaaaatttaagtgaggaagaagaggccttcaaatgcttatttaattctaggtatgaacactatttcagttcattttgtgcttttaaaactacagttttaaagatttatgataccaataacttcctagattcatgtggattttttttaaggcaatgaaaaaaggctggattataacacactgtagtaatcaaaaatgcatttaagcattgaatgcactctagtgcagggccaagtaagaggagttgaaatgagtaaagcagaaatagagctgctgaaagtttcttttatataaaaataataaaatactactttagatatagtagcattcacagggatgaaatatgcgaaaaatgggttctaaaatatttcaaagggaaaatgaagtgaaggaaacatcatgaaaggggaaaggaatgaggtaaacaagtcttaggaagagagttaagaaaaaattccgctggacttggccaaagaaagaaggggatctagtatctctatgaaggaaaaaagagtaaagccctcagtgtgaacccagtgagaacactgacaaatttgggaaaagttaaatactgatttcatccaaataaagcctctaatcttaagcataccaatactttggcataccagaagacaccttagaaatcaggatagcctttgcattcattttggtaagaaaactgatgctgagaggataaattacctaaaaatcttaaaacccaggcaagttagtcaaagaatcaagattagaattcaggtttccagagacagggctcattctaatgcctcaggtcactggcccgaacaaatctgcttcacagaattccttagaaagagatacacaattctttgctgggattgggtccctggaggacaaccatactatattcttgttaatatgttttttctttttttaaatttaaacttttgttcagttgagatgattgtgaaactaggtatctttcattctgactcctagtttaacatttaattttgactcccaatgagttacgtaaaagcaaaactataactaagaatgggaaaaagaactatttctgcacatttgtaacatatttaagatgttttcttcatataattgaaaactgcagatgagtaagagaatgactaggaaatgagatacagttatatgacacataatgatgttttagtcaacaatgaaccacatatttgacattggtcccaaaagattatattaataatatggtatctttagtgtgcttttctatgtttagacacacaaatactcaccatgatgttacaatagcctacagtgttcaatacagtaacatgcacaagtttgtaacctaggagcaacagggattccatatagcctaggtgtgtagtaggctacctacaccatctaggtttgtgtaagtacactctgatattcacacaatgatgaaattgcctaatgacacatttctcagaatgtatttgtgttattaaatgatgcatgactctaattcttttcaaaacagagccatatggggcaagggggatggggggacgcaagtcagttgtcaaaagactaattgagttactgacaaactgaacatgctaggtgcctcatgtaattcttcatgtaactaaaaaatgttgagaggtttttttcccccgggtatataggctctctttttatccgaaaatagtttccacaaagaagtcaactctgttctgaaaaaaaatgaattgcattttgaatacacttatctttgggtatatcaactaaaggaagttggatttttttccttaacagaaacttctgcagtcctctcagttcacatcctttctgactttaccctgacaaacttattatataaagctatatttaaatctatattgtcaatataacaaaggattgtttttgaacatcacaaatttgttcttggatagaattttatacattgcttttcatcatatatttgctcagttactctaagaagcaaggaactgatcactagttgggaatctatatgggcctaaacttgagtgtattgatttattattacatctactaccaacattttcttaagcatagccttctaaattttttcaggagattagaataaaggtatacatgctactcggtcttctggtaattctagtgataaacctttggatgagacaggtcctaatcagcactgaattcttcaataggaggctgtgttacaggagctacagatttttccctggattagcttaggtcattgcctttacttt

SEQ ID NO: 7855 - DNA, 3141 bp, Homo sapiens
actcggcgcgcttctctcccagtgcgcagtggcctggtgggtcagccggcggcggctggagcgcggggccggccctgcgcacgaatgaatgggcgcccgggggacgcgcgcgctcggggctgaagggcattaggaccgtgaggatcgctccgcgatcctgtctctccctatcacccccccgcccccccacctctctcctttttctgctctgcaggactgagcagctaggcgcgagcgaaaacaaacagctggggctgcgagcgcccccgccccggccccgagagcacgccggcccagtcccccacctggggcgcccgtctgcccaccatgaggaagatccgcgccaatgccatcgccatcctgaccgtagcctggatcctgggcactttctactacttatggcaggacaaccgagcccacgcagcatcctccggcggccggggcgcgcagagggcaggcaggaggtcggagcagctccgcgaggaccgcaccatcccgctcattgtgacaggaactccctcgaaaggctttgatgagaaggcctacctgtcggccaagcagctgaaggctggagaggacccctacagacagcacgccttcaaccagctggagagtgacaagctgagcccagaccggcccatccgggacacccgccattacagctgcccatctgtgtcctactcctcggacctgccagccaccagcgtcatcatcaccttccacaatgaggcccgttccaccctgctgcgcacagtgaagagtgtcctgaaccgaactcctgccaacttgatccaggagatcattttagtggatgacttcagctcagatccggaagactgtctactcctgaccaggatccccaaggtcaagtgcctgcgcaatgatcggcgggaagggctgatccggtcccgagtgcgtggggcggacgtggctgcagctaccgttctcacctttctggatagccactgcgaagtgaacaccgagtggctgccgcccatgctgcagcgggtgaaggaggaccacacccgcgtggtgagtcccatcattgatgtcatcagtctggataattttgcctaccttgcagcatctgctgaccttcgtggagggttcgactggagcctgcatttcaagtgggagcagatccctcttgagcagaagatgacccggacagaccccaccaggcccataaggacgcctgtcatagctggaggaatcttcgtgatcgacaagtcctggtttaaccacttgggaaagtatgatgcccagatggacatctgggggggagagaattttgagctctccttcagggtgtggatgtgtggtggcagtctggagatcgtcccctgcagccgggtgggccatgtcttcaggaaacggcacccctacaacttccctgagggtaatgccctcacctacatcaggaatactaagcgcactgcagaagtgtggatggatgaatacaagcaatactactatgaggcccggccctcggccatcgggaaggccttcggcagtgtggctacgcggatagagcagaggaagaagatgaactgcaagtccttccgctggtacctggagaacgtctacccagagctcacggtccccgtgaaggaagcactccccggcatcattaagcagggggtgaactgcttagaatctcagggccagaacacagctggtgacttcctgcttggaatggggatctgcagagggtctgccaagaacccgcagcccgcccaggcatggctgttcagtgaccacctcatccagcagcaggggaagtgcctggctgccacctccaccttaatgtcctcccctggatccccagtcatactgcagatgtgcaaccctagagaaggcaagcagaaatggaggagaaaaggatctttcatccagcattcagtcagtggcctctgcctggagacaaagcctgcccagctggtgaccagcaagtgtcaggctgacgcccaggcccagcagtggcagctgttgccacacacatgacggagggattttcttgaagggtcagctattgcactgtgctgggaggctggctgtggctcctgtttgtgaagagaactcccagttccttttcacagccgctgagaacacatccacacatctaccccacggccttgtcttggaactgctcctgctatccccacaccctgcttcctcaccccactggctcttgggcaaatgactgttggtaccaggaccctgggggtctcccctacaaagcagaccagcctggggcagatatacctaccacaggagccccctgtctttcataggccaaggatccacatacccatagagttcatggattctagagggtctaggaatctcttgaaattgtccctaaaatactgcatgtgtgtgcatacatgcattttcctggggaaaaagtccatggcttctaaaagaggtccctgatccccaaagggcctgaacctctgctctggattgaagccactgtctgcccaagctgccaccccctaatcttcctccctggcgtgctcaaactgccatcgcctgctccctccacacggcccttggggtcagcagccaagtgtctgtggtccgcagcacctgctctggagggctctccagcagtttcgcctcctgactctcaccagcgtcctctcggcagcactcccgtgcccaagtgcacccctctggacttgccagcgcaggccccttcgctcccagggccatgctttgcctgtcctctgtcgtgatgtttcttccgcagccaggtgcagcctcagatcccctgttcatctgggaagcctcctgccacagcttaggacagaactgggcccagggcaaaggcctctccccagaggatggactagaaggcctgggccacactcgggcatggacctttggggctggggagccggggctgcgcctgttgaatgtaagaggactgctgaccagagggccttcaagagggtctctctgtcctttgctgtggtcagatcaggctctgcacttatcagccggtcctttgtggcaacgcagccctgttctgtttttgcttttcctcttcttgaccaaagcatgtgccactagctgtccttgaggacctcgtctttatgaaacacacacctggaataaaaccacttcttacatgtc

SEQ ID NO: 7856 - DNA, 2270 bp, Homo sapiens
aaaacaaacagctggggctgcgagcgcccccgccccggccccgagagcacgccggcccagtcccccacctggggcgcccgtctgcccaccatgaggaagatccgcgccaatgccatcgccatcctgaccgtagcctggatcctgggcactttctactacttatggcaggacaaccgagcccacgcagcatcctccggcggccggggcgcgcagagggcaggcaggaggtcggagcagctccgcgaggaccgcaccatcccgctcattgtgacaggaactccctcgaaaggctttgatgagaaggcctacctgtcggccaagcagctgaaggctggagaggacccctacagacagcacgccttcaaccagctggagagtgacaagctgagcccagaccggcccatccgggacacccgccattacagctgcccatctgtgtcctactcctcggacctgccagccaccagcgtcatcatcaccttccacaatgaggcccgttccaccctgctgcgcacagtgaagagtgtcctgaaccgaactcctgccaacttgatccaggagatcattttagtggatgacttcagctcagatccggaagactgtctactcctgaccaggatccccaaggtcaagtgcctgcgcaatgatcggcgggaagggctgatccggtcccgagtgcgtggggcggacgtggctgcagctaccgttctcacctttctggatagccactgcgaagtgaacaccgagtggctgccgcccatgctgcagcgggtgaaggaggaccacacccgcgtggtgagtcccatcattgatgtcatcagtctggataattttgcctaccttgcagcatctgctgaccttcgtggagggttcgactggagcctgcatttcaagtgggagcagatccctcttgagcagaagatgacccggacagaccccaccaggcccataaggacgcctgtcatagctggaggaatcttcgtgatcgacaagtcctggtttaaccacttgggaaagtatgatgcccagatggacatctgggggggagagaattttgagctctccttcagggtgtggatgtgtggtggcagtctggagatcgtcccctgcagccgggtgggccatgtcttcaggaaacggcacccctacaacttccctgagggtaatgccctcacctacatcaggaatactaagcgcactgcagaagtgtggatggatgaatacaagcaatactactatgaggcccggccctcggccatcgggaaggccttcggcagtgtggctacgcggatagagcagaggaagaagatgaactgcaagtccttccgctggtacctggagaacgtctacccagagctcacggtccccgtgaaggaagcactccccggcatcattaagcagggggtgaactgcttagaatctcagggccagaacacagctggtgacttcctgcttggaatggggatctgcagagggtctgccaagaacccgcagcccgcccaggcatggctgttcagtgaccacctcatccagcagcaggggaagtgcctggctgccacctccaccttaatgtcctcccctggatccccagtcatactgcagatgtgcaaccctagagaaggcaagcagaaatggaggagaaaaggatctttcatccagcattcagtcagtggcctctgcctggagacaaagcctgcccagctggtgaccagcaagtgtcaggctgacgcccaggcccagcagtggcagctgttgccacacacatgacggtagccctggggcctcctgtaccttttgcatgagacttcgggaccggaagggggttagggtgggggagtgcaaagtgggctgttcccatctcctcacatttctgccaggaccatcagcaaatacccaccatgacacacgttctccaaagcttgttctaggagggcgcaggcgggcacgccccgatgccctcagtgctgtcctggccttgccccgggagaggagatggtcagggtgctggactgttgctgggtagagactgagtaggtgcccctggccctttgtcctctcccttggcgcttcttggggctgggacaatagtgtgtggtctctcccttgttgcccggagaaagcaaggacagaagcccacacaggggtcttttgggtcatgaggcccagctgtgcaggcaggcagggccaggggaaattgggcagcatggatggagaggctgaaggctgggaagagggaaggggagaggggcagcctgcaggggtagctgaag

SEQ ID NO: 7857 - DNA, 866 bp, Homo sapiens
acctctctcctttttctgctctgcaggactgagcagctaggcgcgagcgaaaacaaacagctggggctgcgagcgcccccgccccggccccgagagcacgccggcccagtcccccacctgaggaatactaagcgcactgcagaagtgtggatggatgaatacaagcaatactactatgaggcccggccctcggccatcgggaaggccttcggcagtgtggctacgcggatagagcagaggaagaagatgaactgcaagtccttccgctggtacctggagaacgtctacccagagctcacggtccccgtgaaggaagcactccccggcatcattaagcagggggtgaactgcttagaatctcagggccagaacacagctggtgacttcctgcttggaatggggatctgcagagggtctgccaagaacccgcagcccgcccaggcatggctgttcagtgaccacctcatccagcagcaggggaagtgcctggctgccacctccaccttaatgtcctcccctggatccccagtcatactgcagatgtgcaaccctagagaaggcaagcagaaatggaggagaaaaggatctttcatccagcattcagtcagtggcctctgcctggagacaaagcctgcccagctggtgaccagcaagtgtcaggctgacgcccaggcccagcagtggcagctgttgccacacacatgacggtagccctggggcctcctgtaccttttgcatgagacttcgggaccggaagggggttagggtgggggagtgcaaagtgggctgttcccatctcctcacatttctgccaggaccatcagcaaatacccaccatgacacacgttctccaaagcttgttctag

SEQ ID NO: 7858 - DNA, 1629 bp, Homo sapiens
atgaggaagatccgcgccaatgccatcgccatcctgaccgtagcctggatcctgggcactttctactacttatggcaggacaaccgagcccacgcagcatcctccggcggccggggcgcgcagagggcaggcaggaggtcggagcagctccgcgaggaccgcaccatcccgctcattgtgacaggaactccctcgaaaggctttgatgagaaggcctacctgtcggccaagcagctgaaggctggagaggacccctacagacagcacgccttcaaccagctggagagtgacaagctgagcccagaccggcccatccgggacacccgccattacagctgcccatctgtgtcctactcctcggacctgccagccaccagcgtcatcatcaccttccacaatgaggcccgttccaccctgctgcgcacagtgaagagtgtcctgaaccgaactcctgccaacttgatccaggagatcattttagtggatgacttcagctcagatccggaagactgtctactcctgaccaggatccccaaggtcaagtgcctgcgcaatgatcggcgggaagggctgatccggtcccgagtgcgtggggcggacgtggctgcagctaccgttctcacctttctggatagccactgcgaagtgaacaccgagtggctgccgcccatgctgcagcgggtgaaggaggaccacacccgcgtggtgagtcccatcattgatgtcatcagtctggataattttgcctaccttgcagcatctgctgaccttcgtggagggttcgactggagcctgcatttcaagtgggagcagatccctcttgagcagaagatgacccggacagaccccaccaggcccataaggacgcctgtcatagctggaggaatcttcgtgatcgacaagtcctggtttaaccacttgggaaagtatgatgcccagatggacatctgggggggagagaattttgagctctccttcagggtgtggatgtgtggtggcagtctggagatcgtcccctgcagccgggtgggccatgtcttcaggaaacggcacccctacaacttccctgagggtaatgccctcacctacatcaggaatactaagcgcactgcagaagtgtggatggatgaatacaagcaatactactatgaggcccggccctcggccatcgggaaggccttcggcagtgtggctacgcggatagagcagaggaagaagatgaactgcaagtccttccgctggtacctggagaacgtctacccagagctcacggtccccgtgaaggaagcactccccggcatcattaagcagggggtgaactgcttagaatctcagggccagaacacagctggtgacttcctgcttggaatggggatctgcagagggtctgccaagaacccgcagcccgcccaggcatggctgttcagtgaccacctcatccagcagcaggggaagtgcctggctgccacctccaccttaatgtcctcccctggatccccagtcatactgcagatgtgcaaccctagagaaggcaagcaggtgagtctccttgcctctggcccagaggcccagcagcccgaggggccatgcctcagggtggcagaccttggcaggagagcccctgattga

SEQ ID NO: 7859 - DNA, 4669 bp, Homo sapiens
gaaaggaaaccaggcactgcctgccggctttacatctgttgatctgacctgactggaagcgtccaaagagggacggctgtcagccctgcttgactgagaacccaccagctcatcccagacacctcatagcaacctatttatacaaagggggaaagaaacacctgagcagaatggaatcattatttttttcccaaggagaaaaccggggtaaagggagggaagcaattcaatttgaagtccctgtgaatgggctttcagaaggcaattaaagaaatccactcagagaggacttggggtgaaacttgggtcctgtggttttctgattgtaagtggaagcaggtcttgcacacgctgttggcaaatgtcaggaccaggttaagtgactggcagaaaaacttccaggtggaacaagcaacccaggttctgctgcaagcttgaaggagcctggagcgggagaaagctaacttgaacatgacctgttgcatttggcaagttctagcaacatgctcctaaggaagcgatacaggcacagaccatgcagactccagttcctcctgctgctcctgatgctgggatgcgtcctgatgatggtggcgatgttgcaccctccccaccacaccctgcaccagactgtcacagcccaagccagcaagcacagccctgaagccaggtaccgcctggactttggggaatcccaggattgggtactggaagctgaggatgagggtgaagagtacagccctctggagggcctgccaccctttatctcactgcgggaggatcagctgctggtggccgtggccttaccccaggccagaaggaaccagagccagggcaggagaggtgggagctaccgcctcatcaagcagccaaggaggcaggataaggaagccccaaagagggactggggggctgatgaggacggggaggtgtctgaagaagaggagttgaccccgttcagcctggacccacgtggcctccaggaggcactcagtgcccgcatccccctccagagggctctgcccgaggtgcggcacccactgtgtctgcagcagcaccctcaggacagcctgcccacagccagcgtcatcctctgtttccatgatgaggcctggtccactctcctgcggactgtacacagcatcctcgacacagtgcccagggccttcctgaaggagatcatcctcgtggacgacctcagccagcaaggacaactcaagtctgctctcagcgaatatgtggccaggctggagggggtgaagttactcaggagcaacaagaggctgggtgccatcagggcccggatgctgggggccaccagagccaccggggatgtgctcgtcttcatggatgcccactgcgagtgccacccaggctggctggagcccctcctcagcagaatagctggtgacaggagccgagtggtatctccggtgatagatgtgattgactggaagactttccagtattacccctcaaaggacctgcagcgtggggtgttggactggaagctggatttccactgggaacctttgccagagcatgtgaggaaggccctccagtcccccataagccccatcaggagccctgtggtgcccggagaggtggtggccatggacagacattacttccaaaacactggagcgtatgactctcttatgtcgctgcgaggtggtgaaaacctcgaactgtctttcaaggcctggctctgtggtggctctgttgaaatccttccctgctctcgggtaggacacatctaccaaaatcaggattcccattcccccctcgaccaggaggccaccctgaggaacagggttcgcattgctgagacctggctggggtcattcaaagaaaccttctacaagcatagcccagaggccttctccttgagcaaggctgagaagccagactgcatggaacgcttgcagctgcaaaggagactgggttgtcggacattccactggtttctggctaatgtctaccctgagctgtacccatctgaacccaggcccagtttctctggaaagctccacaacactggacttgggctctgtgcagactgccaggcagaaggggacatcctgggctgtcccatggtgttggctccttgcagtgacagccggcagcaacagtacctgcagcacaccagcaggaaggagattcactttggcagcccacagcacctgtgctttgctgtcaggcaggagcaggtgattcttcagaactgcacggaggaaggcctggccatccaccagcagcactgggacttccaggagaatgggatgattgtccacattctttctgggaaatgcatggaagctgtggtgcaagaaaacaataaagatttgtacctgcgtccgtgtgatggaaaagcccgccagcagtggcgttttgaccagatcaatgctgtggatgaacgatgaatgtcaatgtcagaaggaaaagagaattttggccatcaaaatccagctccaagtgaacttaaagagcttatatatttcatgaagctgatccttttgtgtgtgtgctcctggtgttaggagagaaaaaagctctatgaaagaatataggaagtttctccttttcacaccttatttcattgactgctggctgctttaaaaaaaaaaaaaaaggatccattgtaccgttgtcttcatcactgggaaatgattattacatagtacagaagattctttgtttttctccactgagcacttaacaattgctttctctctggcctggacattctctggcagcacctccaggatacataaattcaatggatcaatttatttgtcttcaaatggccttaacttggattgtctgtttggccaaccatgaaaattaaagagtgaagcagatgtaatggcctgacattccaaaaactctgaattgggtttattagcacaaatgttgtgttcatttgttgagccatatctcagaagaaggaaagggagctacagaaaggaggtttaggattgcagagaagatgcaagagcactttggcccaattctccagctcaacccagcagctgaaaagcttcaagagatctaggaaaagacattttcatgttaatgagaatttccaccattgtagagaatttccttcctactgagaatctacctctattccccctgccctagctcttctctaacttggttaaccataaccataaccagattcccttgcaatcgatttctctttagtcgttggtgttagaagtaccagcacaatttgagcattcccattaacaaaggtgttcacagttgagaaactctcctgccgggcgcggtggctcatgcctgtaattccagcactttgggaggcagagttgggaggatcacctgatgtcaggggtttgagaccagcctggtcaacattgcaaaaccttgtctctactaaaaatacaaaaattagctgggcatggtggcgcatacctgtaatcccagctacttgggaggctgaggcaagagaatcgcttgaacccaggaggcagaggttgcagtgagctgagatcatgccattgcactccaacctgggtgacagagtgagactccatctcaaaaaaaaaaaaaaagagagaaactctcctgatgccctgttacagggtttgcactgactggagcagaaacagcaacctttctaaaaaagcaaacctttttcctgggaggaaaatgccagagcctgagccaaaattcttatgacaggtaacatttgggtgttaatgtccatgagagctgacagggccatctctgagcccatataactgtctggaacccccaaatgtgtccacaggttgaatgtccatgagtgtgggaagaacacggctcatctggagcacagctgaggctagtaagagctaaatgactttccttgctatgacttggcttacctgaattagctgtaagagttgccgaatgggatgggttctgctatttaataaacagcattcatattcatttttccccagatggagttacctacctttccacatggtcagcttagaaatcttcccctaaagatgctaatctcctttgggctgtctcagaacacagtatccttcaaataagaaaaactgagtgggaagtgcagtgtttccaaacaatacctatcataactacgtattcattgtctacctgctaagtcaagggttcactgcatttctccttcctcagaatacactctggacctgtgctgtctaatatggtagccactaacaaaatgtggccattttgatggaaatccattaaaatcaaagaaaatttaaaactcaattcctcaattgggctggccacatttcaaatgctcactacccacctgtggctagggtctacttctactgtattggcgagcatggatatagaacatttcatcacagttctgttggaccaatctagatagattcattatcccatctagagaagagactttagtcactgtcttcttgcttcagacccatctatatttaaaacaaatttccctaaatcctgagactgagacggagctacaaattctcagatggcgaccgtgtaaatggtattagcggctgaagaaaaaaaatttttcaagacctctgttttttaactgaactttatcattggcattgtgggtctttgaagttgctgggataaattaatataattaaataaaagactgaatttaattgca

SEQ ID NO: 7860 - DNA, 2775 bp, Homo sapiens
caggctgagaagccagactgcatggaacgcttgcagctgcaaaggagactgggttgtcggacattccactggtttctggctaatgtctaccctgagctgtacccatctgaacccaggcccagtttctctggaaagctccacaacactggacttgggctctgtgcagactgccaggcagaaggggacatcctgggctgtcccatggtgttggctccttgcagtgacagccggcagcaacagtacctgcagcacaccagcaggaaggagattcactttggcagcccacagcacctgtgctttgctgtcaggcaggagcaggtgattcttcagaactgcacggaggaaggcctggccatccaccagcagcactgggacttccaggagaatgggatgattgtccacattctttctgggaaatgcatggaagctgtggtgcaagaaaacaataaagatttgtacctgcgtccgtgtgatgaaaagcccgccagcagtggcgttttgaccagatcaatgctgtggatgaacgatgaatgtcaatgtcagaaggaaaagagaattttggccatcaaaatccagctccaagtgaacttaaagagcttatatatttcatgaagctgatccttttgtgtgtgtgctcctggtgttaggagagaaaaaagctctatgaaagaatataggaagtttctccttttcacaccttatttcattgactgctggctgctttaaaaaaaaaaaaaaaggatccattgtaccgttgtcttcatcactgggaaatgattattacatagtacagaagattctttgtttttctccactgagcacttaacaattgctttctctctggcctggacattctctggcagcacctccaggatacataaattcaatggatcaatttatttgtcttcaaatggccttaacttggattgtctgtttggccaaccatgaaaattaaagagtgaagcagatgtaatggcctgacattccaaaaactctgaattgggtttattagcacaaatgttgtgttcatttgttgagccatatctcagaagaaggaaagggagctacagaaaggaggtttaggattgcagagaagatgcaagagcactttggcccaattctccagctcaacccagcagctgaaaagcttcaagagatctaggaaaagacattttcatgttaatgagaatttccaccattgtagagaatttccttcctactgagaatctacctctattccccctgccctagctcttctctaacttggttaaccataaccataaccagattcccttgcaatcgatttctctttagtcgttggtgttagaagtaccagcacaatttgagcattcccattaacaaaggtgttcacagttgagaaactctcctgccgggcgcggtggctcatgcctgtaattccagcactttgggaggcagagttgggaggatcacctgatgtcaggggtttgagaccagcctggtcaacattgcaaaaccttgtctctactaaaaatacaaaaattagctgggcatggtggcgcatacctgtaatcccagctacttgggaggctgaggcaagagaatcgcttgaacccaggaggcagaggttgcagtgagctgagatcatgccattgcactccaacctgggtgacagagtgagactccatctcaaaaaaaaaaaaaaagagagaaactctcctgatgccctgttacagggtttgcactgactggagcagaaacagcaacctttctaaaaaagcaaacctttttcctgggaggaaaatgccagagcctgagccaaaattcttatgacaggtaacatttgggtgttaatgtccatgagagctgacagggccatctctgagcccatataactgtctggaacccccaaatgtgtccacaggttgaatgtccatgagtgtgggaagaacacggctcatctggagcacagctgaggctagtaagagctaaatgactttccttgctatgacttggcttacctgaattagctgtaagagttgccgaatgggatgggttctgctatttaataaacagcattcatattcatttttccccagatggagttacctacctttccacatggtcagcttagaaatcttcccctaaagatgctaatctcctttgggctgtctcagaacacagtatccttcaaataagaaaaactgagtgggaagtgcagtgtttccaaacaatacctatcataactacgtattcattgtctacctgctaagtcaagggttcactgcatttctccttcctcagaatacactctggacctgtgctgtctaatatggtagccactaacaaaatgtggccattttgatggaaatccattaaaatcaaagaaaatttaaaactcaattcctcaattgggctggccacatttcaaatgctcactacccacctgtggctagggtctacttctactgtattggcgagcatggatatagaacatttcatcacagttctgttggaccaatctagatagattcattatcccatctagagaagagactttagtcactgtcttcttgcttcagacccatctatatttaaaacaaatttccctaaatcctgagactgagacggagctacaaattctcagatggcgaccgtgtaaatggtattagcggctgaagaaaaaaaatttttcaagacctctgttttttaactgaactttatcattggcattgtgggtctttgaagttgctgggataaattaatataattaaataaaagactgaatttaattgc

SEQ ID NO: 7861 - DNA, 2504 bp, Homo sapiens
gctgttctcctagcagcgcgggccggtcggaccgccaaggcagccggcgctggcgatgggaagcggcgtggccgccgacacaggcagtggcaaagtttcccagacgtacacatctggacgcgcggctgccggctacccgtgacccctctaggaagggttcagggatttttaatttggaaaaaaatccacctggtttcctttgtcaaggtctctccgggtggccagcggcaggagctgcaaacttgggcacggcggctacaccggcagcggaccgggctttggagaacctcgggactcaggtgctgaggtgcccagcggctccggacgtgctacggggtgcgagcgcgggggagttcggggcgcacgacaaggaagggcccccgggagctctatatggaggaaggagcccagaatggtgtgcaccaggaagaccaaaactttggtgtccacttgcgtgatcctgagcggcatgactaacatcatctgcctgctctacgtgggctgggtcaccaactacatcgccagcgtgtatgtgcgggggcaggagccggcgcccgacaagaagctggaggaagacaaaggggacactctgaagattattgagcggctggaccacctggagaatgtcatcaagcagcacattcaagaggctcctgccaagcctgaggaggcagaggccgagcccttcacagactcctctctgtttgcacactggggccaggagctcagccccgaaggccggcgcgtggccctgaagcaattccagtactacggctacaacgcctacctcagcgaccgcctgcccctggaccggcccctgcctgacctcagacccagtgggtgccgtaacctctcatttcctgacagcctgccagaggtgagcatcgtgttcatcttcgtcaatgaagcgctttcagtgctgctgcgctccatccactcggccatggaacgcacgcccccacatctgctcaaggagatcattctggtggatgacaacagcagtaacgaggaactgaaggagaagctgaccgaatatgtggacaaggtgaacagccagaagccaggcttcatcaaagtcgtgcgtcacagcaagcaggaaggcctcatccgctccagggtcagtggctggagggcggccactgcccctgtggtggcactctttgatgcccacgtggagttcaatgtgggctgggctgaacctgtactcacccgcatcaaggagaaccggaagcggatcatctcgccatcctttgataacatcaaatatgacaactttgagatagaagagtacccgctggctgcccagggctttgactgggagctgtggtgccgctacctaaatccccccaaggcctggtggaagctggagaactccacagcgccaatcaggagccctgccctcattggctgcttcattgtggaccggcagtacttccaggagatcggcctgctggacgaaggcatggaagtctacgggggcgagaatgtggagcttgggatcagggtgtggcagtgtggcgggagtgtggaggtcctgccctgctcacggattgcccacattgagcgagcccacaagccctacacagaggacctcaccgcccatgtccgcaggaacgctctcagggtggctgaagtctggatggatgaatttaaaagccacgtctacatggcatggaacataccgcaggaggactcaggaattgacattggggacatcactgcaaggaaggctctcaggaaacagctgcagtgcaagaccttccggtggtacctggtcagcgtgtacccagagatgaggatgtactccgacatcattgcctatggagtgctgcagaattctctgaagactgatttgtgtcttgaccaggggccagatacagagaatgtccccatcatgtacatctgccatgggatgacgcctcagaacgtgtactacacgagcagtcagcagatccatgtgggcattctgagccccaccgtggatgatgatgacaaccgatgcctggtggacgtcaacagccggccccggctcatcgaatgcagctacgccaaagccaagaggatgaagcttcactggcagttctctcagggaggacccatccagaaccgcaagtctaagcgctgtctggagctgcaggagaatagcgacctggagttcggcttccagctggtgttgcagaagtgctcgggccagcactggagcatcaccaacgtcctgaggagcctcgcgtcctgacccaccggggccacttccggctgcctctttgctactgtgtagcacctgctgcaacgttgcctgctgtccacgtggggttgtttggagtctggggaaccaggttagtgggcccccaagaagagctttttatttcctattcaattttcatggagtttatagaaagatgctgattggtaggtgatggtatgatatcaaactattttgcagttgtaaataggggacagatggaaaatatttataactgacaataaaatattattaagaaaag

SEQ ID NO: 7862 - DNA, 1719 bp, Homo sapiens
gtgagggggactgtactgccctttgagtactactgtgtggccccgcaacccagcacaaccaggtatctgcttggaacccagccaccataaagcctgctagctaaaaaaaattttacatctctcagttcattcggcacagacccctgcctcattcagctgtgactctgcttggaaaattcatcagttacaaagcagccaatgcaattatctcaagggaaattgaaaaatggacctttgaaaatgctagatttacaatgagaaatgccataattcaaggtttattctatgggtccttgacatttgggatctggacagctctgttattcatatatttgcaccataatcatgtgagcagctggcagaagaaaagccaggagcctctgtcagcttggtcccctggaaaaaaagtgcatcagcaaattatctatggctcagagcaaataccaaaacctcatgtaatagtcaaaaggactgatgaagataaagcaaagtctatgttaggtacagattttaaccatacaaacccagaacttcataaagaacttttaaaatatggatttaatgtgattatcagtagaagcttgggcatcgaaagagaagtgccagataccaggagtaaaatgtgtcttcaaaaacattacccagcccgcctcccgactgccagcattgtcatttgcttctataatgaagaatgtaatgccttgtttcagaccatgtccagtgtcacgaacctcacgccacactattttcttgaagaaattattttggtagatgacatgagcaaagttgatgatttgaaagaaaaactagactatcacctggaaacttttcggggaaaggttaaaataataagaaacaaaaagagagaggggctgattcgagcaaggctgattggagcttctcatgcttcaggggatgttctggtgttcctggacagccactgtgaggtgaacagagtatggctggagcccctgctgcatgccattgccaaggaccccaaaatggtggtgtgccccctgatagatgtcattgatgatagaactctggagtataagccctctcctcttgtaaggggaacttttgattggaacctacaatttaaatgggataatgttttctcttatgagatggatggaccagaaggatctactaaaccaatccggtcacctgcaatgtctggaggaatttttgctatacgtcggcattattttaatgaaattggacagtatgacaaggatatggatttttggggaagagaaaatttggaactttcactaaggatctggatgtgtggaggccaactctttataatcccctgctctcgagtaggacatatcagtaagaaacaaactggaaaaccttctacaatcatcagtgctatgacacataactacctaagactggtgcacgtttggctggatgaatataaggagcagttttttcttcgaaagcctggtctgaaatatgtcacctacggaaatattcgcgagcgtgttgagttaaggaaacgactgggttgcaagtcatttcagtggtatttggataatgtcttcccagagttggaggcatctgtgaacagcctgtgaaaggaaaacaaatcactttcattaataaagggttaaaagtctcctagtcattcaacatagtgtcacaagagtgtaagtttggaacatcgtggaattacgtgaaatgcaattaaaaaaatatgaccagacgtga

SEQ ID NO: 7863 - DNA, 1678 bp, Homo sapiens
gatgtcatcaggctttgtgagggggactgtactgccctttgagtactactgtgtggccccgcaacccagcacaaccagcattgaattctgcatcttttagtgaagaaaataactgaacatggttttcttctgaagacacaaagtccaaaggccaatcacacacctcttacatcgatctcttggaaattgaaaaatggacctttgaaaatgctagatttacaatgagaaatgccataattcaaggtttattctatgggtccttgacatttgggatctggacagctctgttattcatatatttgcaccataatcatgtgagcagctggcagaagaaaagccaggagcctctgtcagcttggtcccctggaaaaaaagtgcatcagcaaattatctatggctcagagcaaataccaaaacctcatgtaatagtcaaaaggactgatgaagataaagcaaagtctatgttaggtacagattttaaccatacaaacccagaacttcataaagaacttttaaaatatggatttaatgtgattatcagtagaagcttgggcatcgaaagagaagtgccagataccaggagtaaaatgtgtcttcaaaaacattacccagcccgcctcccgactgccagcattgtcatttgcttctataatgaagaatgtaatgccttgtttcagaccatgtccagtgtcacgaacctcacgccacactattttcttgaagaaattattttggtagatgacatgagcaaagttgatgatttgaaagaaaaactagactatcacctggaaacttttcggggaaaggttaaaataataagaaacaaaaagagagaggggctgattcgagcaaggctgattggagcttctcatgcttcaggggatgttctggtgttcctggacagccactgtgaggtgaacagagtatggctggagcccctgctgcatgccattgccaaggaccccaaaatggtggtgtgccccctgatagatgtcattgatgatagaactctggagtataagccctctcctcttgtaaggggaacttttgattggaacctacaatttaaatgggataatgttttctcttatgagatggatggaccagaaggatctactaaaccaatccggtcacctgcaatgtctggaggaatttttgctatacgtcggcattattttaatgaaattggacagtatgacaaggatatggatttttggggaagagaaaatttggaactttcactaaggatctggatgtgtggaggccaactctttataatcccctgctctcgagtaggacatatcagtaagaaacaaactggaaaaccttctacaatcatcagtgctatgacacataactacctaagactggtgcacgtttggctggatgaatataaggagcagttttttcttcgaaagcctggtctgaaatatgtcacctacggaaatattcgcgagcgtgttgagttaaggaaacgactgggttgcaagtcatttcagtggtatttggataatgtcttcccagagttggaggcatctgtgaacagcctgtgaaaggaaaacaaatcactttcattaataaagggttaaaagtctcctagtcattcaacatagtgtcacaagagtgtaagtttggaacatcgtggaattacgtgaaatgcaattaaaaaaatatgacc

SEQ ID NO: 7864 - DNA, 681 bp, Homo sapiens
atgaagaggaaacagaagagatttctgcagatgactttgttgttcacggtggctttaattttcctgcctaacgttggtctctggtctctgtacaaggataagcacctggtgaagtcagcggagcccggggagcagcagacatttccactgggcctgggagatgggcaattctattcatggacagatggtttgagaagaaaggactggcatgactatgaaagcattcagaaagaggctatgcgctcagggaaaggtgaacatgggaaaccttacccccttactgaagaggaccatgatgactcagcttacagggaaaatggttttaatattttcgtcagcaacaatattgctctagagaggtctctgccagatattcgtcatgctaactgtaagcataagatgtatctggaaaggctgccaaacaccagcatcattatcccatttcataatgaaggttggacttcactcctgcggaccatacacagtataattaaccgaaccccagggagtctgatagcagaaatcattctagtagatgacttcagtgagagagaacacctgaaggataaattggaagaatacatggcccgattttccaaagtgaggattgttcgcaccaagaaaagagaaggatccggacccgtctcctgggggcatctatggccagaggagaagtcctga

SEQ ID NO: 7865 - DNA, 3922 bp, Homo sapiens
gcagcgccctcgtccgcttccaagcccagcacagacttcggtttctccgcctccatcccctttacgagaagaggagatcaaaaaatattgccctttaggtgctcgtgatggtcctgtgggttcgttcagttgccagaaaagaatggtaacatgaacagcggagcgtgagagcgtcaccgggggaagggacgagattgatgggcagagcgctcacttctcagaggatcgcattccgaggaccgcgcgaggaagggacgtcgcggcgccaccacttcctggctggactccgctgacatctgtagcctcctttccaccaggttcccggggctcccagccgctgcctgcagaggagcgtgtagacagcgcgcgagggtccggcacttcgtggacctccatccgaaccggagttctgcccggatcccgagtccctggatcccggtggagcccgccggcaagctggctccggagggagttgaacttgagttcagatggccaactccctctgaatcctgcagattggtgctgagcacgcaacaaaagtttgtagcttctcagtttctggtgcttcgcaggggagaggaaaggaatttgacattaaacacaagaagcagtcagggagccatctcctttaacttttcttctctgttaccatttgcaatgaagaggaaacagaagagatttctgcagatgactttgttgttcacggtggctttaattttcctgcctaacgttggtctctggtctctgtacaaggataagcacctggtgaagtcagcggagcccggggagcagcagacatttccactgggcctgggagatgggcaattctattcatggacagatggtttgagaagaaaggactggcatgactatgaaagcattcagaaagaggctatgcgctcagggaaaggtgaacatgggaaaccttacccccttactgaagaggaccatgatgactcagcttacagggaaaatggttttaatattttcgtcagcaacaatattgctctagagaggtctctgccagatattcgtcatgctaactgtaagcataagatgtatctggaaaggctgccaaacaccagcatcattatcccatttcataatgaaggttggacttcactcctgcggaccatacacagtataattaaccgaaccccagggagtctgatagcagaaatcattctagtagatgacttcagtgagagagaacacctgaaggataaattggaagaatacatggcccgattttccaaagtgaggattgttcgcaccaagaaaagagaaggactcatccggacccgtctcctgggggcatctatggccagaggagaagtcctgacattcctggactcccactgcgaggtcaatgtgaactggctgcccccactcctcaaccaaattgcactaaaccacaaaaccatcgtgtgtcccatgatcgatgtcattgaccacaatcacttcgggtatgaggcacaagctggggatgccatgcgaggagccttcgactgggaaatgtactacaaaagaatccccatccctccagagctccagagggcagatcccagcgacccttttgagtctcctgttatggctggaggtctctttgctgtggatcggaaatggttttgggaattgggtggctatgatccaggtttagaaatctggggaggagaacagtatgaaatctcttttaaggtttggatgtgtggaggagaaatgtttgatgttccatgttctagagttggtcatatctacaggaagtacgttccatacaaagttccatctgggacaagcctggcaagaaacctgaagcgggtagctgagacctggatggatgaatttgccgagtacatttaccagcggcggccggagtacaggcatctctccacgggggacatctctgcccagaaggagctgcgcaagcagctcaagtgcaaggacttcaaatggttcatggctgctgtggcctgggacgtgcctaaatactaccctccagtggagcccccgcctgctgcctggggggagatccgaaatgtggcagcaaatctctgtgtggacagcaagcatggagccaccggaacagagctgaggctggacatctgtgtcaaggatggttctgaaagaacatggtctcatgaacagctttttacctttggatggagagaagatattcgacccggtgagccactgcatacccggaaattctgctttgatgcgatctcacacaacagccccgttacactctatgactgtcatggcatgaaggggaaccagctctggggataccggaaggacagaacattattccatcctgtgagcaacagctgcatggattgcaaccccgcagagaagaagattttcatggccagatgtgaccctctctctgagactcagcagtggatttttgaacacattaatatgactgttttagaaaaatttaaccaccatgccaactcctagaaagaagaaaggaagaaagagtgattacctacaggttataaattaaattttagccagcatctgggtcgaaggagtcaggaataacatttcctcgatccaggaaggctggtttaaaaatttgcaaatgccatgtcaaagtaggttgttttgaagaacttcctgcatctgaagaacttggctgagaatctcaccagctgcttctgagaactcgagactagcagttcccttgctggccaagggcaaagataatttagggacttttcaaaacaactgctgagctaataaatcctagcatttctcaggtcaaatcctgcagtagtgagtagctatgaatggatcctattaactgggtgggaggggggtgaaaatggagtgcatgactgctctgacaacctgaggatatcacaggtttagaactagccaagcttaaggggtgagctgtactctttggtgccattctctgactaagaatgggttcagcaggtttaacccttaaaagtgctgcagatgatttcagagtgctcacactattctgttttttttatttttatttttaaatgagggtgcaatatctaatgtaagacttaaattacataatgaaatggacatccagtgttcccattctttcgtttatatttgccatttttttttcagagcaaagtttcttttttatgaaagttcatgctccatgaatccactgaatttctaattcagtgcccttctatgaatccagttaaaaacaaaagcaaaagcaaaaatctatgctatcaagttactccaaagaaagatttcacagaagcagcaaaaccatataagatttaggagagggacttccctgggaaatctatttttacttttctattatttttaaaatcttaaaagtctgatatttgtccagtcataatttttattaagcaaggaaatggagtgagtttgatgtaatttgtttaggagattcttaaacccaaataaatctacactccaagtgatatgtgaaaatggcttagttcacttcaattctgtttagtcagtggtgggagcttagaagtggttttatttgttcgtttgtttgggttttgcttttgttttttatttttttcttgttttttttttgtagtgttgaattaatgatgttcttttatttggaagctcataaaaggaattaccattaataaagtgtttctgacaccattttctgttaatgggacaatatttcggggatgaagaaaggaatgctccgaaaactaaatggaacacttaatccttaaagcaattttttactgttcaataatatcacattgggggaagaaaacacaggtatcaaggtggttcttgggaaaaaagaatcatgtttattatatatctctcaagtttttttggtataaaaatgttttaactttgctttctttttggtttttgtttgaagttggttttcctgttaataaaaatttatataaca

SEQ ID NO: 7866 - DNA, 2344 bp, Homo sapiens
ctgtgctcccggcgctgacgtgtctgggcggtcggcttccactccttcaggcgtcggcagccactagtcgtggcgagaggggcggggtggccggggctggcgctccacttggcccccgctcccggcccgccccgccgccgcggccccccggatgagggtatatattcggagcgagcgcgggacgccgatgagtggccgcgcggaaggagctggagacggtcgtagctgcggtcgcgccgagaaaggtttacaggtacatacattacacccctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcagtgctacaaatgggaagtcagagaccatcacagctgatgtcaatcacaacttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctgg

SEQ ID NO: 7867 - DNA, 2066 bp, Homo sapiens
ctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgtgctacaaatgggaagtcagagaccatcacagctgatgtcaatcacaacttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtc

SEQ ID NO: 7868 - DNA, 2069 bp, Homo sapiens
ctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcagtgctacaaatgggaagtcagagaccatcacagctgatgtcaatcacaacttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtc

SEQ ID NO: 7869 - DNA, 2294 bp, Homo sapiens
ctgtgctcccggcgctgacgtgtctgggcggtcggcttccactccttcaggcgtcggcagccactagtcgtggcgagaggggcggggtggccggggctggcgctccacttggcccccgctcccggcccgccccgccgccgcggccccccggatgagggtatatattcggagcgagcgcgggacgccgatgagtggccgcgcggaaggagctggagacggtcgtagctgcggtcgcgccgagaaaggtttacaggtacatacattacacccctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctccagatgggaatggtggtctttatcgggcacttgcagcccagaatattgtggaggatatggagcaaagaggcatttggagcattcatgtctattgtgttgacaacatattagtaaaagtggcagacccacggttcattggattttgcattcagaaaggagcagactgtggagcaaaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaatgtttatgaacctcagttgcagcaccatgtggctcaaaagaagattccttatgtggatacccaaggacagttaattaagccagacaaacccaatggaataaagatggaaaaatttgtctttgacatcttccagtttgcaaagaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccgcttgaaggatgccaatgatgtaccaatccaatgtgaaatctctcctcttatctcctatgctggagaaggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctgga

SEQ ID NO: 7870 - DNA, 776 bp, Homo sapiens
gtctgtgctcccggcgctgacgtgtctgggcggtcgtagctgcggtcgcgccgagaaaggtttacaggtacatacattacacccctatttctacaaagcttggctattagagcattatgaacattaatgacctcaaactcacgttgtccaaagctgggcaagagcacctactacgtttctggaatgagcttgaagaagcccaacaggtagaactttatgcagagctccaggccatgaactttgaggagctgaacttctttttccaaaaggccattgaaggttttaaccagtcttctcaccaaaagaatgtggatgcacgaatggaacctgtgcctcgagaggtattaggcagtgctacaagggatcaagatcagctccaggcctgggaaagtgaaggacttttccagatttctcagaataaagtagcagttcttcttctagctggtgggcaggggacaagactcggcgttgcatatcctaaggggatgtatgatgttggtttgccatcccgtaagacactttttcagattcaagcagagcgtatcctgaagctacagcaggttgctgaaaaatattatggcaacaaatgcattattccatggtatataatgaccagtggcagaacaatggaatctacaaaggagttcttcaccaagcacaagtactttggtttaaaaaaagagaatgtaatcttttttcagcaaggaatgctccccgccatgagttttgatgggaaaattattttggaagagaagaacaaagtttctatggctcca

SEQ ID NO: 7871 - DNA, 6303 bp, Homo sapiens
cccagcctgccggccggtactcaccgctacccggagttcgctcagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcgttaaaagggccaaattccagggttcaccagataaatttaacacatatgtgaccctgaaagtacagaatgtgaagagcacaactgtagcagttcgtggtgatcagccttcctgggaacaggatttcatgtttgagattagtcgcctggacctgggtctaagtgtggaggtatggaacaaaggactgatctgggacaccatggtggggactgtgtggattgcgctgaagactattcgtcagtcggatgaggaagggcctggggaatggtccacattagaggcagagacgttaatgaaagacgatgagatctgtggaactagaaacccaactcctcataaaattttgcttgatacaagatttgagttgccttttgatatcccagaggaggaagccagatattggacctacaaatgggagcaaatcaatgccttgggagctgacaatgagtattctagtcaagaagaaagccagaggaagccattgcccactgctgccgcccagtgttcttttgaagaccctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatgcaaagttatgaccttgattatccagagcggcgggctatcagccccaccagcagcagtaggtatggctcctcctgtaatgtgagtcaaggaagctctcagctaagtgaactagaccagtatcacgaacaagatgacgaccatcgggagacggactcgattcattcttgccacagctctcacagcctgtccagagatggccaagcaggttttggagaacaagagaaacccttggaggtgacaggtcaagcagagaaggaggcagcatgtgaacccaaggagatgaaagaagatgccacaacccaccctcccccagatctggtgctgcaaaaagaccacttcctaggtccccaggagagttttcctgaggagaatgcatcttcaccatttacccaagccagagcacattggatccgagcagttaccaaggttcgactccagctgcaggagattccagatgatggtgacccctctctgcctcagtggctcccggaagggccagccggagggctctatggcattgacagcatgccagatttacgcagaaagaagccactgccacttgtcagtgatctgtcactggtccagtctcggaaggcaggaatcacttctgcaatggctacacgcacttctcttaaggacgaagagctgaaatcccacgtgtataagaaaaccctgcaggccttaatctaccccatttcgtgcaccactcctcataactttgaggtctggacggccactaccccaacctactgctatgagtgtgaaggcctgctctggggcattgcccggcagggcatgcgctgcagcgaatgtggagtcaagtgccatgagaagtgccaggatctgctcaatgctgactgcctgcagcgggctgcagaaaagagctgtaaacatggagctgaggaccggacccagaacattatcatggccatgaaggaccgcatgaagatccgagagcgaaataagccagagatctttgaagttatccgggacgtcttcacagtgaacaaagctgcccatgtgcagcagatgaaaacagtgaagcagagtgtactggatggcacctccaaatggtcagccaagatcaccattactgtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccattttgagtgccacaactcctctgaccgcattaaggtgcgtgtatgggatgaggatgatgacatcaagtcaagagtaaagcaacgcctaaagcgagagtctgatgatttccttggccaaaccatcattgaggttcggaccctaagtggcgagatggacgtctggtacaacttggagaagaggacagacaaatcagccgtctcaggggctatccgactacaaatcagtgtggagatcaagggggaggagaaagtagccccataccacgtgcagtatacatgtctccatgagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttgggaaagagagatttgtaaaactgctggaccagctacacaactcactgaggatcgacctctctacatacaggaataatttccctgctgggagtcctgaacggcttcaggacttaaaatccacagtggatttgctgaccagcattactttcttcagaatgaaggtacaagaactgcaaagccctccaagagccagccaggtggtaaaggattgtgtgaaggcctgtttgaactccacatatgaatatatcttcaacaactgccacgacttatacagccgccagtaccagctgaagcaggagctacctccagaggaacaagggcccagcattcggaacctggatttctggcccaagctcatcacactcatcgtgtcaatcatagaggaagataagaattcctacacacctgttctgaaccagtttcctcaggagttgaatgtgggaaaagtcagcgcagaagtgatgtggcatttgtttgcccaagacatgaaatatgcattggaggagcatgagaaagaccacctgtgtaaaagtgctgactacatgaacctgcacttcaaggtgaagtggctccacaatgaatacgtgcgggatctgcctgtcctccaggggcaggtgcctgagtacccagcgtggtttgagcagttcgtgctacaatggctggatgagaatgaggatgtatccctggaattcctgcgtggggccctggaacgagataagaaggatggattccagcagacatcagagcatgcactcttttcctgctctgtggtggatgtcttcacacaactcaatcagagctttgagatcatccggaagctggaatgcccagaccccagcatccttgcccactacatgaggaggtttgctaagaccatcgggaaggtgctgatgcagtatgcagacatcttgtcaaaggacttcccagcctattgcacaaaggagaaactgccctgcatcctgatgaacaacgtgcagcaactgagggtccagctggagaaaatgtttgaggccatgggaggcaaggagctggaccttgaagctgcagacagtctgaaggagctgcaggtgaaactgaatacggttctggatgagctcagcatggtgtttggaaacagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaacctcaccctctttgccactgtgtgtgagaagacggttctgaagcgtgtactgaaggagctctggcgcgtggtgatgaacacaatggagaggatgattgttctgcccccactcactgaccagacgggcacccagctgatcttcactgctgccaaggagctgagccatctttccaaactcaaggatcacatggtacgagaggaaacacggaatctcactccaaagcagtgtgcagtccttgacctcgccctggacaccatcaagcaatacttccatgcaggaggcaatgggctgaagaaaaccttcctggagaagagcccagatctgcagtctctacgctatgccctgtctctgtacacacagactactgacactctcatcaagacctttgtgcgctcgcagaccacccaagggtctggtgtggacgatcctgtgggagaagtctctattcaggtggacttgtttacacaccctggtactggggagcacaaggtcacagtgaaagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttcctcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaacaccttcgactcctgtgccaatcaggcagcagcaatttcacaaatcagggccagtgggagttagctgtgtaaccggcttagggtctttgcagtcaagaggctgaccccttcagttaaagatatttaaggaaaaatttggggtggtgataatatggcttttcacagaaagggtcatgaagccctggcccaacaggactgtggtactaggggctgggatgtggggttaccacatggagagattttccattaagagagaaggacaaacatttctgagagtgtcagccattcttggtagacacctctccactcctcatcccacctctacccatctccatgccacaccttatccagttagacacatacataccaatcattagaagaacaagtttagaaggtgtggaacttgtgcctggctggctgggtagtcagctgagcctgttgctgagcccggtggtctggattggagtatggccagggcaggagtacacagaatagaatttagactgtcccttgagtagaatccactgattttctgtggctccagtgagaacaaggctttgaaactgaacaagataacttctagaaatgaactgtactaatccctttccccagattgtatcatgagtagaatcaggttcacgtggtgcttcaaagccctgagaagaatatttctttggaccccaggcactaggggccacctgcctgggagtctccctgcctcactcctctaggcaggggagtgatgcttcaggacgtgacaggctgttctaacatgtgtctacctgagggctagttgaaggatccaggagtattttcttcttgggtgggccctgaacaaagccaaaaattgtagaaaccagtctagaaaaagtcctgctcatctgtggccactgccttctagccgtcctccaccttgcagaaagaatctagcctttggtctctctctctctcatcggggtcatttgctattcccctctgatattcaaccctatagaaggagcctggactctgatccctctgtacaggctggatggaaggggccctccacacttcctgggaggtcagagacaaactgtttcagagagtcagatggacttcccaagacttgttgagagatgtgacatggttcttggatttcctctgtagcagcctcctggacttcctgaggactcgacattgtccacagatgtactggccattacatgaaacaagaaaccaagcatctttgctgttgttaattattatatgtgccattgttacaggagattataggctagtctgtaataaattatcttatagcagcc

SEQ ID NO: 7872 - DNA, 5034 bp, Homo sapiens
cagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcgttaaaagggccaaattccagggttcaccagataaatttaacacatatgtgaccctgaaagtacagaatgtgaagagcacaactgtagcagttcgtggtgatcagccttcctgggaacaggatttcatgtttgagattagtcgcctggacctgggtctaagtgtggaggtatggaacaaaggactgatctgggacaccatggtggggactgtgtggattgcgctgaagactattcgtcagtcggatgaggaagggcctggggaatggtccacattagaggcagagacgttaatgaaagacgatgagatctgtggaactagaaacccaactcctcataaaattttgcttgatacaagatttgagttgccttttgatatcccagaggaggaagccagatattggacctacaaatgggagcaaatcaatgccttgggagctgacaatgagtattctagtcaagaagaaagccagaggaagccattgcccactgctgccgcccagtgttcttttgaagaccctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatgcaaagttatgaccttgattatccagagcggcgggctatcagccccaccagcagcagtaggtatggctcctcctgtaatgtgagtcaaggaagctctcagctaagtgaactagaccagtatcacgaacaagatgacgaccatcgggagacggactcgattcattcttgccacagctctcacagcctgtccagagatggccaagcaggttttggagaacaagagaaacccttggaggtgacaggtcaagcagagaaggaggcagcatgtgaacccaaggagatgaaagaagatgccacaacccaccctcccccagatctggtgctgcaaaaagaccacttcctaggtccccaggagagttttcctgaggagaatgcatcttcaccatttacccaagccagagcacattggatccgagcagttaccaaggttcgactccagctgcaggagattccagatgatggtgacccctctctgcctcagtggctcccggaagggccagccggagggctctatggcattgacagcatgccagatttacgcagaaagaagccactgccacttgtcagtgatctgtcactggtccagtctcggaaggcaggaatcacttctgcaatggctacacgcacttctcttaaggacgaagagctgaaatcccacgtgtataagaaaaccctgcaggccttaatctaccccatttcgtgcaccactcctcataactttgaggtctggacggccactaccccaacctactgctatgagtgtgaaggcctgctctggggcattgcccggcagggcatgcgctgcagcgaatgtggagtcaagtgccatgagaagtgccaggatctgctcaatgctgactgcctgcagcgggctgcagaaaagagctgtaaacatggagctgaggaccggacccagaacattatcatggccatgaaggaccgcatgaagatccgagagcgaaataagccagagatctttgaagttatccgggacgtcttcacagtgaacaaagctgcccatgtgcagcagatgaaaacagtgaagcagagtgtactggatggcacctccaaatggtcagccaagatcaccattactgtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccattttgagtgccacaactcctctgaccgcattaaggtgcgtgtatgggatgaggatgatgacatcaagtcaagagtaaagcaacgcctaaagcgagagtctgatgatttccttggccaaaccatcattgaggttcggaccctaagtggcgagatggacgtctggtacaacttggagaagaggacagacaaatcagccgtctcaggggctatccgactacaaatcagtgtggagatcaagggggaggagaaagtagccccataccacgtgcagtatacatgtctccatgagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttgggaaagagagatttgtaaaactgctggaccagctacacaactcactgaggatcgacctctctacatacaggaataatttccctgctgggagtcctgaacggcttcaggacttaaaatccacagtggatttgctgaccagcattactttcttcagaatgaaggtacaagaactgcaaagccctccaagagccagccaggtggtaaaggattgtgtgaaggcctgtttgaactccacatatgaatatatcttcaacaactgccacgacttatacagccgccagtaccagctgaagcaggagctacctccagaggaacaagggcccagcattcggaacctggatttctggcccaagctcatcacactcatcgtgtcaatcatagaggaagataagaattcctacacacctgttctgaaccagtttcctcaggagttgaatgtgggaaaagtcagcgcagaagtgatgtggcatttgtttgcccaagacatgaaatatgcattggaggagcatgagaaagaccacctgtgtaaaagtgctgactacatgaacctgcacttcaaggtgaagtggctccacaatgaatacgtgcgggatctgcctgtcctccaggggcaggtgcctgagtacccagcgtggtttgagcagttcgtgctacaatggctggatgagaatgaggatgtatccctggaattcctgcgtggggccctggaacgagataagaaggatggattccagcagacatcagagcatgcactcttttcctgctctgtggtggatgtcttcacacaactcaatcagagctttgagatcatccggaagctggaatgcccagaccccagcatccttgcccactacatgaggaggtttgctaagaccatcgggaaggtgctgatgcagtatgcagacatcttgtcaaaggacttcccagcctattgcacaaaggagaaactgccctgcatcctgatgaacaacgtgcagcaactgagggtccagctggagaaaatgtttgaggccatgggaggcaaggagctggaccttgaagctgcagacagtctgaaggagctgcaggtgaaactgaatacggttctggatgagctcagcatggtgtttggaaacagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaacctcaccctctttgccactgtgtgtgagaagacggttctgaagcgtgtactgaaggagctctggcgcgtggtgatgaacacaatggagaggatgattgttctgcccccactcactgaccagacgggcacccagctgatcttcactgctgccaaggagctgagccatctttccaaactcaaggatcacatggtacgagaggaaacacggaatctcactccaaagcagtgtgcagtccttgacctcgccctggacaccatcaagcaatacttccatgcaggaggcaatgggctgaagaaaaccttcctggagaagagcccagatctgcagtctctacgctatgccctgtctctgtacacacagactactgacactctcatcaagacctttgtgcgctcgcagaccacccaagtgcatgatgggaaaggtattagatttactgctaatgaggacattcgtccggaaaaggggtctggtgtggacgatcctgtgggagaagtctctattcaggtggacttgtttacacaccctggtactggggagcacaaggtcacagtgaaagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttcctcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaacaccttcgactcctgtgcca

SEQ ID NO: 7873 - DNA, 5293 bp, Homo sapiens
gggagggagtcccggcagctcctacctcccagcgatggcgtcgctgtgccgcgcccagtccccagcctgccggccggtactcaccgctacccggagttcgctcagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcgttaaaagggccaaattccagggttcaccagataaatttaacacatatgtgaccctgaaagtacagaatgtgaagagcacaactgtagcagttcgtggtgatcagccttcctgggaacaggatttcatgtttgagattagtcgcctggacctgggtctaagtgtggaggtatggaacaaaggactgatctgggacaccatggtggggactgtgtggattgcgctgaagactattcgtcagtcggatgaggaagggcctggggaatggtccacattagaggcagagacgttaatgaaagacgatgagatctgtggaactagaaacccaactcctcataaaattttgcttgatacaagatttgagttgccttttgatatcccagaggaggaagccagatattggacctacaaatgggagcaaatcaatgccttgggagctgacaatgagtattctagtcaagaagaaagccagaggaagccattgcccactgctgccgcccagtgttgtcactggacctatttgggctggggagaacaacagacttttgaagaccctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatgcaaagttatgaccttgattatccagagcggcgggctatcagccccaccagcagcagtaggtatggctcctcctgtaatgtgagtcaaggaagctctcagctaagtgaactagaccagtatcacgaacaagatgacgaccatcgggagacggactcgattcattcttgccacagctctcacagcctgtccagagatggccaagcaggttttggagaacaagagaaacccttggaggtgacaggtcaagcagagaaggaggcagcatgtgaacccaaggagatgaaagaagatgccacaacccaccctcccccagatctggtgctgcaaaaagaccacttcctaggtccccaggagagttttcctgaggagaatgcatcttcaccatttacccaagccagagcacattggatccgagcagttaccaaggttcgactccagctgcaggagattccagatgatggtgacccctctctgcctcagtggctcccggaagggccagccggagggctctatggcattgacagcatgccagatttacgcagaaagaagccactgccacttgtcagtgatctgtcactggtccagtctcggaaggcaggaatcacttctgcaatggctacacgcacttctcttaaggacgaagagctgaaatcccacgtgtataagaaaaccctgcaggccttaatctaccccatttcgtgcaccactcctcataactttgaggtctggacggccactaccccaacctactgctatgagtgtgaaggcctgctctggggcattgcccggcagggcatgcgctgcagcgaatgtggagtcaagtgccatgagaagtgccaggatctgctcaatgctgactgcctgcagcgggctgcagaaaagagctgtaaacatggagctgaggaccggacccagaacattatcatggccatgaaggaccgcatgaagatccgagagcgaaataagccagagatctttgaagttatccgggacgtcttcacagtgaacaaagctgcccatgtgcagcagatgaaaacagtgaagcagagtgtactggatggcacctccaaatggtcagccaagatcaccattactgtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccattttgagtgccacaactcctctgaccgcattaaggtgcgtgtatgggatgaggatgatgacatcaagtcaagagtaaagcaacgcctaaagcgagagtctgatgatttccttggccaaaccatcattgaggttcggaccctaagtggcgagatggacgtctggtacaacttggagaagaggacagacaaatcagccgtctcaggggctatccgactacaaatcagtgtggagatcaagggggaggagaaagtagccccataccacgtgcagtatacatgtctccatgagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttgggaaagagagatttgtaaaactgctggaccagctacacaactcactgaggatcgacctctctacatacaggaataatttccctgctgggagtcctgaacggcttcaggacttaaaatccacagtggatttgctgaccagcattactttcttcagaatgaaggtacaagaactgcaaagccctccaagagccagccaggtggtaaaggattgtgtgaaggcctgtttgaactccacatatgaatatatcttcaacaactgccacgacttatacagccgccagtaccagctgaagcaggagctacctccagaggaacaagggcccagcattcggaacctggatttctggcccaagctcatcacactcatcgtgtcaatcatagaggaagataagaattcctacacacctgttctgaaccagtttcctcaggagttgaatgtgggaaaagtcagcgcagaagtgatgtggcatttgtttgcccaagacatgaaatatgcattggaggagcatgagaaagaccacctgtgtaaaagtgctgactacatgaacctgcacttcaaggtgaagtggctccacaatgaatacgtgcgggatctgcctgtcctccaggggcaggtgcctgagtacccagcgtggtttgagcagttcgtgctacaatggctggatgagaatgaggatgtatccctggaattcctgcgtggggccctggaacgagataagaaggatggattccagcagacatcagagcatgcactcttttcctgctctgtggtggatgtcttcacacaactcaatcagagctttgagatcatccggaagctggaatgcccagaccccagcatccttgcccactacatgaggaggtttgctaagaccatcgggaaggtgctgatgcagtatgcagacatcttgtcaaaggacttcccagcctattgcacaaaggagaaactgccctgcatcctgatgaacaacgtgcagcaactgagggtccagctggagaaaatgtttgaggccatgggaggcaaggagctggaccttgaagctgcagacagtctgaaggagctgcaggtgaaactgaatacggttctggatgagctcagcatggtgtttggaaacagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaacctcaccctctttgccactgtgtgtgagaagacggttctgaagcgtgtactgaaggagctctggcgcgtggtgatgaacacaatggagaggatgattgttctgcccccactcactgaccagacgggcacccagctgatcttcactgctgccaaggagctgagccatctttccaaactcaaggatcacatggtacgagaggaaacacggaatctcactccaaagcagtgtgcagtccttgacctcgccctggacaccatcaagcaatacttccatgcaggaggcaatgggctgaagaaaaccttcctggagaagagcccagatctgcagtctctacgctatgccctgtctctgtacacacagactactgacactctcatcaagacctttgtgcgctcgcagaccacccaagtgcatgatgggaaaggtattagatttactgctaatgaggacattcgtccggaaaaggggtctggtgtggacgatcctgtgggagaagtctctattcaggtggacttgtttacacaccctggtactggggagcacaaggtcacagtgaaagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttcctcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaacaccttcgactcctgtgccaatcaggcagcagcaatttcacaaatcagggccagtgggagttagctgtgtaaccggcttagggtctttgcagtcaagaggctgaccccttcagttaaagatatttaaggaaaaatttgggg

SEQ ID NO: 7874 - DNA, 5063 bp, Homo sapiens
cagacggtgagatttggggcgggtccgaggcagcggcgggacgctacctgcgaccgggaccatgaggagctgccagacccgtggggccggtaacgagagcagtcgcggcacctgctgagaggaaagagggagcggtccggcgcggctggggcgcggcagaggcttgcccgatcctcggccatgtcactgctctgcgtgcgcgttaaaagggccaaattccagggttcaccagataaatttaacacatatgtgaccctgaaagtacagaatgtgaagagcacaactgtagcagttcgtggtgatcagccttcctgggaacaggatttcatgtttgagattagtcgcctggacctgggtctaagtgtggaggtatggaacaaaggactgatctgggacaccatggtggggactgtgtggattgcgctgaagactattcgtcagtcggatgaggaagggcctggggaatggtccacattagaggcagagacgttaatgaaagacgatgagatctgtggaactagaaacccaactcctcataaaattttgcttgatacaagatttgagttgccttttgatatcccagaggaggaagccagatattggacctacaaatgggagcaaatcaatgccttgggagctgacaatgagtattctagtcaagaagaaagccagaggaagccattgcccactgctgccgcccagtgttcttttgaagaccctgatagtgccgtcgatgaccgagatagtgactatcgcagtgagaccagcaacagcttcccacctccttaccatacagcttcccagcccaacgcttctgtgcaccagttccctgtgccggtgcgatcgccacagcagctgctacttcaaggcagttcccgggactcttgtaatgactctatgcaaagttatgaccttgattatccagagcggcgggctatcagccccaccagcagcagtaggtatggctcctcctgtaatgtgagtcaaggaagctctcagctaagtgaactagaccagtatcacgaacaagatgacgaccatcgggagacggactcgattcattcttgccacagctctcacagcctgtccagagatggccaagcaggttttggagaacaagagaaacccttggaggtgacaggtcaagcagagaaggaggcagcatgtgaacccaaggagatgaaagaagatgccacaacccaccctcccccagatctggtgctgcaaaaagaccacttcctaggtccccaggagagttttcctgaggagaatgcatcttcaccatttacccaagccagagcacattggatccgagcagttaccaaggttcgactccagctgcaggagaagaaaagcgaggagcccttcagattccagatgatggtgacccctctctgcctcagtggctcccggaagggccagccggagggctctatggcattgacagcatgccagatttacgcagaaagaagccactgccacttgtcagtgatctggtgaagtcactggtccagtctcggaaggcaggaatcacttctgcaatggctacacgcacttctcttaaggacgaagagctgaaatcccacgtgtataagaaaaccctgcaggccttaatctaccccatttcgtgcaccactcctcataactttgaggtctggacggccactaccccaacctactgctatgagtgtgaaggcctgctctggggcattgcccggcagggcatgcgctgcagcgaatgtggagtcaagtgccatgagaagtgccaggatctgctcaatgctgactgcctgcagcgggctgcagaaaagagctgtaaacatggagctgaggaccggacccagaacattatcatggccatgaaggaccgcatgaagatccgagagcgaaataagccagagatctttgaagttatccgggacgtcttcacagtgaacaaagctgcccatgtgcagcagatgaaaacagtgaagcagagtgtactggatggcacctccaaatggtcagccaagatcaccattactgtggtgtgtgcccagggcctacaagccaaggacaaaacaggatccagtgacccttacgtgactgtgcaagtcagcaaaactaagaagcgtaccaagaccatttttggaaacttgaatcctgtttgggaggagaagttccattttgagtgccacaactcctctgaccgcattaaggtgcgtgtatgggatgaggatgatgacatcaagtcaagagtaaagcaacgcctaaagcgagagtctgatgatttccttggccaaaccatcattgaggttcggaccctaagtggcgagatggacgtctggtacaacttggagaagaggacagacaaatcagccgtctcaggggctatccgactacaaatcagtgtggagatcaagggggaggagaaagtagccccataccacgtgcagtatacatgtctccatgagaatcttttccattacctcacagacattcagggcagtggaggagtccgcatccctgaagctcgaggagacgatgcctggaaggtgtactttgatgagacagcccaagaaattgtggatgaatttgccatgcgttatggcattgagtccatatatcaggccatgacgcactttgcatgtttatcatccaagtacatgtgtcctggtgtgccagcagtgatgagcaccttactggccaacatcaacgcctactatgcccacacaactgcctctaccaatgtctctgcatctgatcgctttgcagcctccaactttgggaaagagagatttgtaaaactgctggaccagctacacaactcactgaggatcgacctctctacatacaggaataatttccctgctgggagtcctgaacggcttcaggacttaaaatccacagtggatttgctgaccagcattactttcttcagaatgaaggtacaagaactgcaaagccctccaagagccagccaggtggtaaaggattgtgtgaaggcctgtttgaactccacatatgaatatatcttcaacaactgccacgacttatacagccgccagtaccagctgaagcaggagctacctccagaggaacaagggcccagcattcggaacctggatttctggcccaagctcatcacactcatcgtgtcaatcatagaggaagataagaattcctacacacctgttctgaaccagtttcctcaggagttgaatgtgggaaaagtcagcgcagaagtgatgtggcatttgtttgcccaagacatgaaatatgcattggaggagcatgagaaagaccacctgtgtaaaagtgctgactacatgaacctgcacttcaaggtgaagtggctccacaatgaatacgtgcgggatctgcctgtcctccaggggcaggtgcctgagtacccagcgtggtttgagcagttcgtgctacaatggctggatgagaatgaggatgtatccctggaattcctgcgtggggccctggaacgagataagaaggatggattccagcagacatcagagcatgcactcttttcctgctctgtggtggatgtcttcacacaactcaatcagagctttgagatcatccggaagctggaatgcccagaccccagcatccttgcccactacatgaggaggtttgctaagaccatcgggaaggtgctgatgcagtatgcagacatcttgtcaaaggacttcccagcctattgcacaaaggagaaactgccctgcatcctgatgaacaacgtgcagcaactgagggtccagctggagaaaatgtttgaggccatgggaggcaaggagctggaccttgaagctgcagacagtctgaaggagctgcaggtgaaactgaatacggttctggatgagctcagcatggtgtttggaaacagtttccaggtacggattgatgagtgtgttcgacaaatggccgacatcctgggccaggttcggggcacagggaatgcatctccagacgccagggcctcagcggctcaggatgcagatagcgtactccggcctctcatggacttcctggatggcaacctcaccctctttgccactgtgtgtgagaagacggttctgaagcgtgtactgaaggagctctggcgcgtggtgatgaacacaatggagaggatgattgttctgcccccactcactgaccagacgggcacccagctgatcttcactgctgccaaggagctgagccatctttccaaactcaaggatcacatggtacgagaggaaacacggaatctcactccaaagcagtgtgcagtccttgacctcgccctggacaccatcaagcaatacttccatgcaggaggcaatgggctgaagaaaaccttcctggagaagagcccagatctgcagtctctacgctatgccctgtctctgtacacacagactactgacactctcatcaagacctttgtgcgctcgcagaccacccaagtgcatgatgggaaaggtattagatttactgctaatgaggacattcgtccggaaaaggggtctggtgtggacgatcctgtgggagaagtctctattcaggtggacttgtttacacaccctggtactggggagcacaaggtcacagtgaaagtggtggctgccaatgacctcaagtggcagacagcgggtatgttccggcctttcgtggaggtgactatggttggcccacaccaaagtgataagaagaggaagttcacaaccaaatccaaaagcaacaactgggcccccaagtacaatgagacattccacttcctcctgggaaatgaggaggggcccgagtcctatgagttgcagatatgcgtgaaggattactgctttgcccgggaagatcgcgtgctagggctggctgtgatgcctctgagggatgtcacagccaagggcagctgtgcctgctggtgccccttgggccggaagatccatatggatgagacaggcctgaccattctccggattttatctcagaggagcaatgacgaggtggcccgagaatttgtgaaactcaaatcagagtctcgttccacggaggaggggagctgaacaccttcgactcctgtgcca

SEQ ID NO: 7875 - DNA, 6930 bp, Homo sapiens
atggtggctaattttttcaagagcttgattttaccttacattcataagctttgcaaaggaatgtttacaaagaaattgggaaatacaaacaaaaacaaagagtatcgtcagcagaaaaaggatcaagacttccccactgctggccagaccaaatcccccaaattttcttacacttttaaaagcactgtaaagaagattgcaaagtgttcatccactcacaacttatccactgaggaagacgaggccagtaaagagttttccctctcaccaacattcagttaccgagtagctattgccaatggcctacaaaagaatgctaaagtaaccaacagtgataatgaggatctgcttcaagagctctcttcaatcgagagttcctactcagaatcattaaatgaactaaggagtagcacagaaaaccaggcacaatcaacacacacaatgccagttagacgcaacagaaagagttcaagcagccttgcaccctctgagggcagctctgacggggagcgtactctacatggcttaaaactgggagctttacgaaaactgagaaaatggaaaaagagtcaagaatgtgtctcctcagactcagagttaagcaccatgaaaaaatcctggggaataagaagtaagtctttggacagaactgtccgaaacccaaagacaaatgccctggagccagggttcagttcctctggctgcattagccaaacacatgatgtcatggaaatgatctttaaggaacttcagggaataagtcagattgaaacagaactttctgaactacgagggcacgtcaatgctctcaagcactccatcgatgagatctccagcagtgtggaggttgtacaaagtgaaattgagcagttgcgcacagggtttgtccagtctcggagggaaactagagacatccatgattatattaagcacttaggtcatatgggtagcaaggcaagcctgagatttttaaatgtgactgaagaaagatttgaatatgttgaaagcgtggtgtaccaaattctaatagataaaatgggtttttcagatgcaccaaatgctattaaaattgaatttgctcagaggataggacaccagagagactgcccaaatgcaaagcctcgacccatacttgtgtactttgaaacccctcaacaaagggattctgtcttaaaaaagtcatataaactcaaaggaacaggcattggaatctcaacagatattctaactcatgacatcagagaaagaaaagagaaagggataccatcctcccagacatatgagagcatggctataaagttgtctactccagagccaaaaatcaagaagaacaattggcagtcacctgatgacagtgatgaagatcttgaatctgacctcaatagaaacagttacgctgtgctttccaagtcagagcttctaacaaagggaagtacttccaagccaagctcaaaatcacacagtgctagatccaagaataaaactgctaatagcagcagaatttcaaataaatcagattatgataaaatctcctcacagttgccagaatcagatatcttggaaaagcaaaccacaacccattatgcagatgcaacacctctctggcactcacagagtgattttttcactgctaaacttagtcgttctgaatcagatttttccaaattgtgtcagtcttactcagaagatttttcagaaaatcagtttttcactagaactaatggaagctctctcctgtcatcttcggaccgggagctatggcagaggaaacaggaaggaacagcgaccctgtatgacagtcccaaggaccagcatttgaatggaggtgttcagggtatccaagggcagactgaaactgaaaacacagaaactgtggatagtggaatgagtaatggcatggtgtgtgcatctggagaccggagtcattacagtgattctcagctctctttacatgaggatctttctccatggaaggaatggaatcaaggagctgatttaggcttggattcatccacccaggaaggttttgattatgaaacaaacagtctttttgaccaacagcttgatgtttacaataaagacctagaatacttgggaaagtgccacagtgatcttcaagatgactcagagagctacgacttaactcaagatgacaattcttctccatgccctggcttggataatgaaccacaaggccagtgggttggccaatatgattcttatcagggagctaattctaatgagctataccaaaatcaaaaccagttgtccatgatgtatcgaagtcaaagtgaattgcaaagtgatgattcagaggatgccccacccaaatcatggcatagtcgattaagcattgacctttctgataagactttcagcttcccaaaatttggatctacactgcagagggctaaatcagccttggaagtagtatggaacaaaagcacacagagtctgagtgggtatgaggacagtggctcttcattaatggggagatttcggacattatctcaatcaactgcaaatgagtcaagtaccacacttgactctgatgtctacacggagccctattactataaagcagaggatgaggaagattatactgaaccagtggctgacaatgaaacagattatgttgaagtcatggaacaagtccttgctaaactagaaaacaggactagtattactgaaacagatgaacaaatgcaagcatatgatcacctttcatatgaaacaccttatgaaaccccacaagatgagggttatgatggtccagcagatgatatggttagtgaagaggggttagaacccttaaatgaaacatcagctgagatggaaataagagaagatgaaaaccaaaacattcctgaacagccagtggagatcacaaagccaaagagaattcgtccttctttcaaagaagcagctttaagggcctataaaaagcaaatggcagagttggaagagaagatcttggctggagatagcagttctgtggatgaaaaggctcgaatagtaagtggcaatgatttggatgcttccaaattttctgcactccaggtgtgtggtggggctggaggtggactttatggtattgacagcatgccggatcttcgcagaaaaaaaactttgcctattgtccgagatgtggccatgaccctggctgcccggaaatctggactctccctggctatggtgattaggacatccctaaataatgaggaactgaaaatgcacgtcttcaagaagaccttgcaggcactgatctaccctatgtcttctaccatcccacacaattttgaggtctggacggctaccacacccacctactgttatgagtgtgaagggctcctgtggggcattgcaaggcaaggcatgaagtgtctggagtgtggagtgaaatgccacgaaaagtgtcaggacctgctaaacgctgactgcttgcagagagcagcagaaaagagttctaaacatggtgccgaagacaagactcagaccattattacagcaatgaaagaaagaatgaagatcagggagaaaaaccggccagaagtatttgaagtaatccaggaaatgtttcagatttctaaagaagattttgtgcagtttacaaaggcggccaaacagagtgtactggatgggacatctaagtggtctgcaaaaataaccattacagtggtttctgcacagggtctacaggcaaaagataaaacagggtctagtgatccatatgttacagttcaagttggaaagaacaaaagaagaacaaaaaccatttttggaaatttgaatccagtatgggatgagaagttttattttgagtgtcataactccacagatcgaatcaaagtcagagtatgggatgaagatgatgatattaaatccagagtcaagcaacatttcaaaaaggagtcagatgattttctgggacaaacaattgtagaagtgaggaccttgagtggagaaatggatgtctggtacaacttagagaaaaggacagataagtcagctgtatctggggccatacgattgaaaatcaatgtggagataaaaggagaagagaaggttgctccatatcatattcaatatacatgtttacatgagaatctgttccattacttgactgaagtgaaatctaatggtggagtgaaaatcccagaagtcaaaggggatgaagcctggaaggttttctttgatgatgcttcccaagaaatagttgatgaatttgctatgcgttatggaattgaatccatttatcaagctatgacgcacttttcatgtctgtcttctaaatacatgtgccccggtgtccctgccgtcatgagcaccttgctggctaatataaatgctttttatgctcacacaacagtttcaacaaacatacaggtttctgcctcagatcgatttgctgctaccaactttggtagggaaaaattcataaaactactggaccagttacataactctttgaggattgatctgtcaaagtatagggaaaactttcctgcaagcaatactgaaagactgcaagacctgaaatcaactgttgacctgttaacaagtatcaccttttttaggatgaaggttctggagctgcaaagccccccaaaagcgagcatggtggtgaaggactgtgtaagggcttgcctggattctacatacaagtatatttttgacaactgccatgaactctactcccagctaacagacccgagtaagaaacaggatattcctcgtgaagatcagggaccaaccaccaagaatttggatttttggccccaacttattacactgatggttactattattgatgaggataaaactgcctacacacctgtcctgaatcagtttcctcaagagctgaacatgggaaaaataagtgccgaaattatgtggactctttttgctctggatatgaaatatgcattagaagaacatgaaaatcagcggttatgcaagagcaccgattatatgaatttgcatttcaaagttaaatggttttataatgaatatgtgcgtgaacttcctgccttcaaggatgctgttcctgaatactccttgtggtttgaaccttttgtcatgcaatggctagatgaaaacgaagatgtgtcaatggaattccttcatggagcactgggaagagacaaaaaagatggattccagcagacatctgagcatgctctcttttcttgctccgtggttgatgtctttgctcagctgaatcagagctttgaaattattaagaaactggaatgccctaatcctgaagcattatctcacttaatgagaagatttgcaaagactatcaataaagtgctgctccagtatgctgcaattgtatcaagtgatttcagttcacattgtgataaggaaaatgtgccctgtatcttgatgaacaatattcaacaattgcgggtccagctggaaaaaatgtttgaatccatgggagggaaggagctagattctgaagctagtactattctaaaagaacttcaggttaagctcagtggggtcctggatgagctcagcgtcacttatggtgaaagtttccaggttataattgaagagtgtataaaacagatgagtttcgaactaaatcaaatgagagcaaatggaaacaccacatctaataagaacagtgcagcaatggatgcagagattgtgttaagatctcttatggattttttggacaaaacattaagtctctcagcaaaaatctgtgagaaaacagtcctaaagcgagttttaaaagagttatggaagctagttctcaacaaaatagaaaaacaaattgttcttcctcctctgacagatcaaacaggaccccagatgattttcattgcagctaaagatcttggacaattatccaaactgaaggagcacatgattcgagaggatgccaggggtctgacgccaagacaatgcgctataatggaggtagtcctggctaccatcaagcaatactttcatgcaggaggaaatggcctgaaaaagaatttcttggagaaaagcccagatcttcagtctctgagatatgctctcagtctttatacccaaactactgatgccttgataaagaaattcatagatactcaaacctcacagagtcgttcctccaaagatgccgtgggtcagatatctgttcatgtggacatcactgccaccccaggaacgggagatcataaagtcactgtaaaagtgattgctattaatgacctaaactggcagaccacagcaatgttccgcccctttgtggaagtttgtatactgggacccaaccttggagacaagaagagaaaacaaggcacaaaaacaaaaagcaacacatggtcaccaaagtacaatgaaacatttcagttcattctcggaaaggaaaatcgaccaggggcttatgaacttcatctctcagttaaggattactgctttgccagagaagatcgaattatcggaatgacagtcattcagctacagaacatagcagaaaagggaagctatggggcatggtatcctcttctgaaaaatatctctatggatgaaactggtttgactatccttagaatactctctcagaggaccagtgatgatgtggctaaagaatttgtaagacttaaatctgaaacaagatctactgaagagagtgcttgaaacaaacactgcaagctaaatacataactataattgtttgactactgcatgcatgtgcaaatacatgggaatgtttagttcactacatttcaatgtttgccagtactcatgtacgatgtctacaaggtatgtaaaaaacctgctgaacttttataccaattctggtctttgggaaatcagtgttccatgaagtgccaaaattatgatgtaaagtgaaatatcaagaacaccttttaacatgtttattttgtttctttacccatttcacattcattaaacataatt

SEQ ID NO: 7876 - DNA, 8134 bp, Homo sapiens
atggtggctaattttttcaagagcttgattttaccttacattcataagctttgcaaaggaatgtttacaaagaaattgggaaatacaaacaaaaacaaagagtatcgtcagcagaaaaaggatcaagacttccccactgctggccagaccaaatcccccaaattttcttacacttttaaaagcactgtaaagaagattgcaaagtgttcatccactcacaacttatccactgaggaagacgaggccagtaaagagttttccctctcaccaacattcagttaccgagtagctattgccaatggcctacaaaagaatgctaaagtaaccaacagtgataatgaggatctgcttcaagagctctcttcaatcgagagttcctactcagaatcattaaatgaactaaggagtagcacagaaaaccaggcacaatcaacacacacaatgccagttagacgcaacagaaagagttcaagcagccttgcaccctctgagggcagctctgacggggagcgtactctacatggcttaaaactgggagctttacgaaaactgagaaaatggaaaaagagtcaagaatgtgtctcctcagactcagagttaagcaccatgaaaaaatcctggggaataagaagtaagtctttggacagaactgtccgaaacccaaagacaaatgccctggagccagggttcagttcctctggctgcattagccaaacacatgatgtcatggaaatgatctttaaggaacttcagggaataagtcagattgaaacagaactttctgaactacgagggcacgtcaatgctctcaagcactccatcgatgagatctccagcagtgtggaggttgtacaaagtgaaattgagcagttgcgcacagggtttgtccagtctcggagggaaactagagacatccatgattatattaagcacttaggtcatatgggtagcaaggcaagcctgagatttttaaatgtgactgaagaaagatttgaatatgttgaaagcgtggtgtaccaaattctaatagataaaatgggtttttcagatgcaccaaatgctattaaaattgaatttgctcagaggataggacaccagagagactgcccaaatgcaaagcctcgacccatacttgtgtactttgaaacccctcaacaaagggattctgtcttaaaaaagtcatataaactcaaaggaacaggcattggaatctcaacagatattctaactcatgacatcagagaaagaaaagagaaagggataccatcctcccagacatatgagagcatggctataaagttgtctactccagagccaaaaatcaagaagaacaattggcagtcacctgatgacagtgatgaagatcttgaatctgacctcaatagaaacagttacgctgtgctttccaagtcagagcttctaacaaagggaagtacttccaagccaagctcaaaatcacacagtgctagatccaagaataaaactgctaatagcagcagaatttcaaataaatcagattatgataaaatctcctcacagttgccagaatcagatatcttggaaaagcaaaccacaacccattatgcagatgcaacacctctctggcactcacagagtgattttttcactgctaaacttagtcgttctgaatcagatttttccaaattgtgtcagtcttactcagaagatttttcagaaaatcagtttttcactagaactaatggaagctctctcctgtcatcttcggaccgggagctatggcagaggaaacaggaaggaacagcgaccctgtatgacagtcccaaggaccagcatttgaatggaggtgttcagggtatccaagggcagactgaaactgaaaacacagaaactgtggatagtggaatgagtaatggcatggtgtgtgcatctggagaccggagtcattacagtgattctcagctctctttacatgaggatctttctccatggaaggaatggaatcaaggagctgatttaggcttggattcatccacccaggaaggttttgattatgaaacaaacagtctttttgaccaacagcttgatgtttacaataaagacctagaatacttgggaaagtgccacagtgatcttcaagatgactcagagagctacgacttaactcaagatgacaattcttctccatgccctggcttggataatgaaccacaaggccagtgggttggccaatatgattcttatcagggagctaattctaatgagctataccaaaatcaaaaccagttgtccatgatgtatcgaagtcaaagtgaattgcaaagtgatgattcagaggatgccccacccaaatcatggcatagtcgattaagcattgacctttctgataagactttcagcttcccaaaatttggatctacactgcagagggctaaatcagccttggaagtagtatggaacaaaagcacacagagtctgagtgggtatgaggacagtggctcttcattaatggggagatttcggacattatctcaatcaactgcaaatgagtcaagtaccacacttgactctgatgtctacacggagccctattactataaagcagaggatgaggaagattatactgaaccagtggctgacaatgaaacagattatgttgaagtcatggaacaagtccttgctaaactagaaaacaggactagtattactgaaacagatgaacaaatgcaagcatatgatcacctttcatatgaaacaccttatgaaaccccacaagatgagggttatgatggtccagcagatgatatggttagtgaagaggggttagaacccttaaatgaaacatcagctgagatggaaataagagaagatgaaaaccaaaacattcctgaacagccagtggagatcacaaagccaaagagaattcgtccttctttcaaagaagcagctttaagggcctataaaaagcaaatggcagagttggaagagaagatcttggctggagatagcagttctgtggatgaaaaggctcgaatagtaagtggcaatgatttggatgcttccaaattttctgcactccaggtgtgtggtggggctggaggtggactttatggtattgacagcatgccggatcttcgcagaaaaaaaactttgcctattgtccgagatgtgaccctggctgcccggaaatctggactctccctggctatggtgattaggacatccctaaataatgaggaactgaaaatgcacgtcttcaagaagaccttgcaggcactgatctaccctatgtcttctaccatcccacacaattttgaggtctggacggctaccacacccacctactgttatgagtgtgaagggctcctgtggggcattgcaaggcaaggcatgaagtgtctggagtgtggagtgaaatgccacgaaaagtgtcaggacctgctaaacgctgactgcttgcagagagcagcagaaaagagttctaaacatggtgccgaagacaagactcagaccattattacagcaatgaaagaaagaatgaagatcagggagaaaaaccggccagaagtatttgaagtaatccaggaaatgtttcagatttctaaagaagattttgtgcagtttacaaaggcggccaaacagagtgtactggatgggacatctaagtggtctgcaaaaataaccattacagtggtttctgcacagggtctacaggcaaaagataaaacagggtctagtgatccatatgttacagttcaagttggaaagaacaaaagaagaacaaaaaccatttttggaaatttgaatccagtatgggatgagaagttttattttgagtgtcataactccacagatcgaatcaaagtcagagtatgggatgaagatgatgatattaaatccagagtcaagcaacatttcaaaaaggagtcagatgattttctgggacaaacaattgtagaagtgaggaccttgagtggagaaatggatgtctggtacaacttagagaaaaggacagataagtcagctgtatctggggccatacgattgaaaatcaatgtggagataaaaggagaagagaaggttgctccatatcatattcaatatacatgtttacatgagaatctgttccattacttgactgaagtgaaatctaatggtggagtgaaaatcccagaagtcaaaggggatgaagcctggaaggttttctttgatgatgcttcccaagaaatagttgatgaatttgctatgcgttatggaattgaatccatttatcaagctatgacgcacttttcatgtctgtcttctaaatacatgtgccccggtgtccctgccgtcatgagcaccttgctggctaatataaatgctttttatgctcacacaacagtttcaacaaacatacaggtttctgcctcagatcgatttgctgctaccaactttggtagggaaaaattcataaaactactggaccagttacataactctttgaggattgatctgtcaaagtatagggaaaactttcctgcaagcaatactgaaagactgcaagacctgaaatcaactgttgacctgttaacaagtatcaccttttttaggatgaaggttctggagctgcaaagccccccaaaagcgagcatggtggtgaaggactgtgtaagggcttgcctggattctacatacaagtatatttttgacaactgccatgaactctactcccagctaacagacccgagtaagaaacaggatattcctcgtgaagatcagggaccaaccaccaagaatttggatttttggccccaacttattacactgatggttactattattgatgaggataaaactgcctacacacctgtcctgaatcagtttcctcaagagctgaacatgggaaaaataagtgccgaaattatgtggactctttttgctctggatatgaaatatgcattagaagaacatgaaaatcagcggttatgcaagagcaccgattatatgaatttgcatttcaaagttaaatggttttataatgaatatgtgcgtgaacttcctgccttcaaggatgctgttcctgaatactccttgtggtttgaaccttttgtcatgcaatggctagatgaaaacgaagatgtgtcaatggaattccttcatggagcactgggaagagacaaaaaagatggattccagcagacatctgagcatgctctcttttcttgctccgtggttgatgtctttgctcagctgaatcagagctttgaaattattaagaaactggaatgccctaatcctgaagcattatctcacttaatgagaagatttgcaaagactatcaataaagtgctgctccagtatgctgcaattgtatcaagtgatttcagttcacattgtgataaggaaaatgtgccctgtatcttgatgaacaatattcaacaattgcgggtccagctggaaaaaatgtttgaatccatgggagggaaggagctagattctgaagctagtactattctaaaagaacttcaggttaagctcagtggggtcctggatgagctcagcgtcacttatggtgaaagtttccaggttataattgaagagtgtataaaacagatgagtttcgaactaaatcaaatgagagcaaatggaaacaccacatctaataagaacagtgcagcaatggatgcagagattgtgttaagatctcttatggattttttggacaaaacattaagtctctcagcaaaaatctgtgagaaaacagtcctaaagcgagttttaaaagagttatggaagctagttctcaacaaaatagaaaaacaaattgttcttcctcctctgacagatcaaacaggaccccagatgattttcattgcagctaaagatcttggacaattatccaaactgaaggagcacatgattcgagaggatgccaggggtctgacgccaagacaatgcgctataatggaggtagtcctggctaccatcaagcaatactttcatgcaggaggaaatggcctgaaaaagaatttcttggagaaaagcccagatcttcagtctctgagatatgctctcagtctttatacccaaactactgatgccttgataaagaaattcatagatactcaaacctcacagagtcgttcctccaaagatgccgtgggtcagatatctgttcatgtggacatcactgccaccccaggaacgggagatcataaagtcactgtaaaagtgattgctattaatgacctaaactggcagaccacagcaatgttccgcccctttgtggaagtttgtatactgggacccaaccttggagacaagaagagaaaacaaggcacaaaaacaaaaagcaacacatggtcaccaaagtacaatgaaacatttcagttcattctcggaaaggaaaatcgaccaggggcttatgaacttcatctctcagttaaggattactgctttgccagagaagatcgaattatcggaatgacagtcattcagctacagaacatagcagaaaagggaagctatggggcatggtatcctcttctgaaaaatatctctatggatgaaactggtttgactatccttagaatactctctcagaggaccagtgatgatgtggctaaagaatttgtaagacttaaatctgaaacaagatctactgaagagagtgcttgaaacaaacactgcaagctaaatacataactataattgtttgactactgcatgcatgtgcaaatacatgggaatgtttagttcactacatttcaatgtttgccagtactcatgtacgatgtctacaaggtatgtaaaaaacctgctgaacttttataccaattctggtctttgggaaatcagtgttccatgaagtgccaaaattatgatgtaaagtgaaatatcaagaacaccttttaacatgtttattttgtttctttacccatttcacattcattaaacataatttttaaaaactagtcttttgagtttgcccatcagttgtctttgttaaatgagattatattgcccatagatcagaaaacatttattactcaatttccattttatttacttacctcattatagatgtcttacaaatacccttttctaccataactagaaatgcagtcacttctagaaagcatttgtaattttatagtcgcagatattgtgatttttgcatacacattaaaatagaaaaggtgggaaatattttctgctgaccagtttccaacctttctgaaatatcactgtgaagaaatgctgttaaagcaaacttacataaagcaatgctagagtttgttaacaatgtttgatatatattgacaaaactttgttctctaaaactgccaagatcacatcacatttgtaaaaatggtaagttaatgcatttgtcatatagtgttatgtcttggctttaccatatttcattctttaaaaagtcattaatggtttagaaatgggatggaaagtttactgaaaatacctgtaagtaactatattgttaatatcttccctctgacagttatgactctataatcagttcaatgctttatttttaaaaatattcaatgattagtattgaatgcagcattactatatattgtactgatgccaaaagtcatgttttcatccacttagtgaaaaaatagtaaaattaagtcggaagaaattgcttaaaattttgtaatttgtatttataagccccaaatgcatcaaatgcagtaggagaacaatgtaatacagcttggtacctaaaaatatagctaagttggtttttgaatataaaacagtttatgaatatgtgcattttctgtattgttatgatttgactttttagagtctatgccaaaatatatggctgtaaaacagtactttgtaattataacttatggtcataactgttagtggactacttacagaagcagaaacaagagcctgttatgattgtgctttgtgaacaagctgatctaatacgttaagtacagaagtgcttagtatcatgactgtcagaaccattctgcaactgagtatgaaatcacagaccagtgaggtgagctaattcatgttaaactgttaggccactgctttgttaatgactcctctaaatgcatagtgtgatgcgatcctctggcatatgctttaataaatggatgtatattgagcacatgcagca

SEQ ID NO: 7877 - DNA, 8140 bp, Homo sapiens
atggtggctaattttttcaagagcttgattttaccttacattcataagctttgcaaaggaatgtttacaaagaaattgggaaatacaaacaaaaacaaagagtatcgtcagcagaaaaaggatcaagacttccccactgctggccagaccaaatcccccaaattttcttacacttttaaaagcactgtaaagaagattgcaaagtgttcatccactcacaacttatccactgaggaagacgaggccagtaaagagttttccctctcaccaacattcagttaccgagtagctattgccaatggcctacaaaagaatgctaaagtaaccaacagtgataatgaggatctgcttcaagagctctcttcaatcgagagttcctactcagaatcattaaatgaactaaggagtagcacagaaaaccaggcacaatcaacacacacaatgccagttagacgcaacagaaagagttcaagcagccttgcaccctctgagggcagctctgacggggagcgtactctacatggcttaaaactgggagctttacgaaaactgagaaaatggaaaaagagtcaagaatgtgtctcctcagactcagagttaagcaccatgaaaaaatcctggggaataagaagtaagtctttggacagaactgtccgaaacccaaagacaaatgccctggagccagggttcagttcctctggctgcattagccaaacacatgatgtcatggaaatgatctttaaggaacttcagggaataagtcagattgaaacagaactttctgaactacgagggcacgtcaatgctctcaagcactccatcgatgagatctccagcagtgtggaggttgtacaaagtgaaattgagcagttgcgcacagggtttgtccagtctcggagggaaactagagacatccatgattatattaagcacttaggtcatatgggtagcaaggcaagcctgagatttttaaatgtgactgaagaaagatttgaatatgttgaaagcgtggtgtaccaaattctaatagataaaatgggtttttcagatgcaccaaatgctattaaaattgaatttgctcagaggataggacaccagagagactgcccaaatgcaaagcctcgacccatacttgtgtactttgaaacccctcaacaaagggattctgtcttaaaaaagtcatataaactcaaaggaacaggcattggaatctcaacagatattctaactcatgacatcagagaaagaaaagagaaagggataccatcctcccagacatatgagagcatggctataaagttgtctactccagagccaaaaatcaagaagaacaattggcagtcacctgatgacagtgatgaagatcttgaatctgacctcaatagaaacagttacgctgtgctttccaagtcagagcttctaacaaagggaagtacttccaagccaagctcaaaatcacacagtgctagatccaagaataaaactgctaatagcagcagaatttcaaataaatcagattatgataaaatctcctcacagttgccagaatcagatatcttggaaaagcaaaccacaacccattatgcagatgcaacacctctctggcactcacagagtgattttttcactgctaaacttagtcgttctgaatcagatttttccaaattgtgtcagtcttactcagaagatttttcagaaaatcagtttttcactagaactaatggaagctctctcctgtcatcttcggaccgggagctatggcagaggaaacaggaaggaacagcgaccctgtatgacagtcccaaggaccagcatttgaatggaggtgttcagggtatccaagggcagactgaaactgaaaacacagaaactgtggatagtggaatgagtaatggcatggtgtgtgcatctggagaccggagtcattacagtgattctcagctctctttacatgaggatctttctccatggaaggaatggaatcaaggagctgatttaggcttggattcatccacccaggaaggttttgattatgaaacaaacagtctttttgaccaacagcttgatgtttacaataaagacctagaatacttgggaaagtgccacagtgatcttcaagatgactcagagagctacgacttaactcaagatgacaattcttctccatgccctggcttggataatgaaccacaaggccagtgggttggccaatatgattcttatcagggagctaattctaatgagctataccaaaatcaaaaccagttgtccatgatgtatcgaagtcaaagtgaattgcaaagtgatgattcagaggatgccccacccaaatcatggcatagtcgattaagcattgacctttctgataagactttcagcttcccaaaatttggatctacactgcagagggctaaatcagccttggaagtagtatggaacaaaagcacacagagtctgagtgggtatgaggacagtggctcttcattaatggggagatttcggacattatctcaatcaactgcaaatgagtcaagtaccacacttgactctgatgtctacacggagccctattactataaagcagaggatgaggaagattatactgaaccagtggctgacaatgaaacagattatgttgaagtcatggaacaagtccttgctaaactagaaaacaggactagtattactgaaacagatgaacaaatgcaagcatatgatcacctttcatatgaaacaccttatgaaaccccacaagatgagggttatgatggtccagcagatgatatggttagtgaagaggggttagaacccttaaatgaaacatcagctgagatggaaataagagaagatgaaaaccaaaacattcctgaacagccagtggagatcacaaagccaaagagaattcgtccttctttcaaagaagcagctttaagggcctataaaaagcaaatggcagagttggaagagaagatcttggctggagtttccttggatgtagatctagaggctcgaatagtaagtggcaatgatttggatgcttccaaattttctgcactccaggtgtgtggtggggctggaggtggactttatggtattgacagcatgccggatcttcgcagaaaaaaaactttgcctattgtccgagatgtgcttctgaccctggctgcccggaaatctggactctccctggctatggtgattaggacatccctaaataatgaggaactgaaaatgcacgtcttcaagaagaccttgcaggcactgatctaccctatgtcttctaccatcccacacaattttgaggtctggacggctaccacacccacctactgttatgagtgtgaagggctcctgtggggcattgcaaggcaaggcatgaagtgtctggagtgtggagtgaaatgccacgaaaagtgtcaggacctgctaaacgctgactgcttgcagagagcagcagaaaagagttctaaacatggtgccgaagacaagactcagaccattattacagcaatgaaagaaagaatgaagatcagggagaaaaaccggccagaagtatttgaagtaatccaggaaatgtttcagatttctaaagaagattttgtgcagtttacaaaggcggccaaacagagtgtactggatgggacatctaagtggtctgcaaaaataaccattacagtggtttctgcacagggtctacaggcaaaagataaaacagggtctagtgatccatatgttacagttcaagttggaaagaacaaaagaagaacaaaaaccatttttggaaatttgaatccagtatgggatgagaagttttattttgagtgtcataactccacagatcgaatcaaagtcagagtatgggatgaagatgatgatattaaatccagagtcaagcaacatttcaaaaaggagtcagatgattttctgggacaaacaattgtagaagtgaggaccttgagtggagaaatggatgtctggtacaacttagagaaaaggacagataagtcagctgtatctggggccatacgattgaaaatcaatgtggagataaaaggagaagagaaggttgctccatatcatattcaatatacatgtttacatgagaatctgttccattacttgactgaagtgaaatctaatggtggagtgaaaatcccagaagtcaaaggggatgaagcctggaaggttttctttgatgatgcttcccaagaaatagttgatgaatttgctatgcgttatggaattgaatccatttatcaagctatgacgcacttttcatgtctgtcttctaaatacatgtgccccggtgtccctgccgtcatgagcaccttgctggctaatataaatgctttttatgctcacacaacagtttcaacaaacatacaggtttctgcctcagatcgatttgctgctaccaactttggtagggaaaaattcataaaactactggaccagttacataactctttgaggattgatctgtcaaagtatagggaaaactttcctgcaagcaatactgaaagactgcaagacctgaaatcaactgttgacctgttaacaagtatcaccttttttaggatgaaggttctggagctgcaaagccccccaaaagcgagcatggtggtgaaggactgtgtaagggcttgcctggattctacatacaagtatatttttgacaactgccatgaactctactcccagctaacagacccgagtaagaaacaggatattcctcgtgaagatcagggaccaaccaccaagaatttggatttttggccccaacttattacactgatggttactattattgatgaggataaaactgcctacacacctgtcctgaatcagtttcctcaagagctgaacatgggaaaaataagtgccgaaattatgtggactctttttgctctggatatgaaatatgcattagaagaacatgaaaatcagcggttatgcaagagcaccgattatatgaatttgcatttcaaagttaaatggttttataatgaatatgtgcgtgaacttcctgccttcaaggatgctgttcctgaatactccttgtggtttgaaccttttgtcatgcaatggctagatgaaaacgaagatgtgtcaatggaattccttcatggagcactgggaagagacaaaaaagatggattccagcagacatctgagcatgctctcttttcttgctccgtggttgatgtctttgctcagctgaatcagagctttgaaattattaagaaactggaatgccctaatcctgaagcattatctcacttaatgagaagatttgcaaagactatcaataaagtgctgctccagtatgctgcaattgtatcaagtgatttcagttcacattgtgataaggaaaatgtgccctgtatcttgatgaacaatattcaacaattgcgggtccagctggaaaaaatgtttgaatccatgggagggaaggagctagattctgaagctagtactattctaaaagaacttcaggttaagctcagtggggtcctggatgagctcagcgtcacttatggtgaaagtttccaggttataattgaagagtgtataaaacagatgagtttcgaactaaatcaaatgagagcaaatggaaacaccacatctaataagaacagtgcagcaatggatgcagagattgtgttaagatctcttatggattttttggacaaaacattaagtctctcagcaaaaatctgtgagaaaacagtcctaaagcgagttttaaaagagttatggaagctagttctcaacaaaatagaaaaacaaattgttcttcctcctctgacagatcaaacaggaccccagatgattttcattgcagctaaagatcttggacaattatccaaactgaaggagcacatgattcgagaggatgccaggggtctgacgccaagacaatgcgctataatggaggtagtcctggctaccatcaagcaatactttcatgcaggaggaaatggcctgaaaaagaatttcttggagaaaagcccagatcttcagtctctgagatatgctctcagtctttatacccaaactactgatgccttgataaagaaattcatagatactcaaacctcacagagtcgttcctccaaagatgccgtgggtcagatatctgttcatgtggacatcactgccaccccaggaacgggagatcataaagtcactgtaaaagtgattgctattaatgacctaaactggcagaccacagcaatgttccgcccctttgtggaagtttgtatactgggacccaaccttggagacaagaagagaaaacaaggcacaaaaacaaaaagcaacacatggtcaccaaagtacaatgaaacatttcagttcattctcggaaaggaaaatcgaccaggggcttatgaacttcatctctcagttaaggattactgctttgccagagaagatcgaattatcggaatgacagtcattcagctacagaacatagcagaaaagggaagctatggggcatggtatcctcttctgaaaaatatctctatggatgaaactggtttgactatccttagaatactctctcagaggaccagtgatgatgtggctaaagaatttgtaagacttaaatctgaaacaagatctactgaagagagtgcttgaaacaaacactgcaagctaaatacataactataattgtttgactactgcatgcatgtgcaaatacatgggaatgtttagttcactacatttcaatgtttgccagtactcatgtacgatgtctacaaggtatgtaaaaaacctgctgaacttttataccaattctggtctttgggaaatcagtgttccatgaagtgccaaaattatgatgtaaagtgaaatatcaagaacaccttttaacatgtttattttgtttctttacccatttcacattcattaaacataatttttaaaaactagtcttttgagtttgcccatcagttgtctttgttaaatgagattatattgcccatagatcagaaaacatttattactcaatttccattttatttacttacctcattatagatgtcttacaaatacccttttctaccataactagaaatgcagtcacttctagaaagcatttgtaattttatagtcgcagatattgtgatttttgcatacacattaaaatagaaaaggtgggaaatattttctgctgaccagtttccaacctttctgaaatatcactgtgaagaaatgctgttaaagcaaacttacataaagcaatgctagagtttgttaacaatgtttgatatatattgacaaaactttgttctctaaaactgccaagatcacatcacatttgtaaaaatggtaagttaatgcatttgtcatatagtgttatgtcttggctttaccatatttcattctttaaaaagtcattaatggtttagaaatgggatggaaagtttactgaaaatacctgtaagtaactatattgttaatatcttccctctgacagttatgactctataatcagttcaatgctttatttttaaaaatattcaatgattagtattgaatgcagcattactatatattgtactgatgccaaaagtcatgttttcatccacttagtgaaaaaatagtaaaattaagtcggaagaaattgcttaaaattttgtaatttgtatttataagccccaaatgcatcaaatgcagtaggagaacaatgtaatacagcttggtacctaaaaatatagctaagttggtttttgaatataaaacagtttatgaatatgtgcattttctgtattgttatgatttgactttttagagtctatgccaaaatatatggctgtaaaacagtactttgtaattataacttatggtcataactgttagtggactacttacagaagcagaaacaagagcctgttatgattgtgctttgtgaacaagctgatctaatacgttaagtacagaagtgcttagtatcatgactgtcagaaccattctgcaactgagtatgaaatcacagaccagtgaggtgagctaattcatgttaaactgttaggccactgctttgttaatgactcctctaaatgcatagtgtgatgcgatcctctggcatatgctttaataaatggatgtatattgagcacatgcagca

SEQ ID NO: 7878 - DNA, 2986 bp, Homo sapiens
gccagcagcctctaagagctcctagacggcctttggctttggctggcacaggggtgaaggagagccagcggcattgagtaaccaggcgaatgtgcccccaggagagttcattccaaccctcccagttcctactgctggtgggggtcccagtggcaagtgtcctccttctggcccaatgccttcgatggcactgccctagaaggctgctgggggcctgctggacactgaatggtcaagaggaaccagtgtcccagcctaccccccaactagaaaatgaggtctcaaggcagcacctgccagccacactgccagagatggttgccttctaccaggagctacacacacccactcaaggccagaccatggtccgccagttgatgcacaaactgttggtgttttcggctcgagaggtggatcaccgcggcggttgcctgatgctccaggatacaggcatctccttgctcatcccaccaggtgctgtggctgtgggccgccaggagcgggtgtctttgatcctggtgtgggacctgtcggacgccccatcgctgtcccaagcccaggggctggtaagccctgtggtggcatgtggcccccatggggcctccttcctgaagccttgcactctcacgttcaaacactgtgccgagcagcccagccatgctcgcacctacagcagcaacactaccctgctggatgccaaggtatggaggcccctggggcggccgggggcccacgcctcccgggatgagtgtcgcatccacctctcccacttcagcctctacacctgtgtgctggaggcacctgtggggcgcgaagcccgcaaatggctgcagctggccgtattctgctcaccgctggtgccaggacagtcccatctgcaactgcgtatctacttcctcaacaacacgccctgcgccctgcagtgggcactgaccaacgagcagccccatggtgggcgcctgcgtgggccctgccagctcttcgacttcaatggggctaggggcgaccagtgcctgaagctcacgtacatctcagagggttgggagaatgtggatgacagcagttgccagctggttccccatctccacatctggcatggaaagtgccccttccgctccttctgcttccggagaaaagcagccgatgagaatgaggactgttcagcactaaccaatgagatcattgtcaccatgcacaccttccaggatggcttggagaccaagtatatggaaatcctcagattccaggcatcagaggaggaatcctgggcagcgccaccacctgtttcccagccgcccccatgcaataggctgcccccagagctctttgagcagctgcggatgttattggagccaaacagcatcaccggcaatgactggcgcagactggcctcccacctggggctttgcggcatgaagatccggttcctgtcctgccagcgcagccccgcagcggccatcctggagttgtttgaggagcagaacggcagcctgcaggagctgcactacctcatgaccgtcatggagcggctagactgcgcctccgccatccagaactacctgagtgggacacacggcggcagcccaggccccgagcgcgggggcgcccgggataaccagggcctggagctggacgagaagctctgagcgcccagcgggcagggccggaggaggtgtaggggcgagaggggttgttctcctacgcctaagaggaacacagcagctgttcctggctgtgcccaccacccttcccagaaccctcggacggtgccagggccgcccgcgtcctcgccagcctcccagcagcaggcgcgcccttccggccgcgagctgtcccgcgtgcgggtcccctcctggccggcagagggcgcaggagcccaggagatggcctcagcgtggccagcctgccaaactgaccaggggacggccacggtccccgcgtgcactttagggccggtcaggccctaaagtattcactgagcacttaggaagaccgggcattgggctggtgtcatgaagaatactggaatataggaggtagggtctggagccctgacaagcacacagttcttttgcaggagtcaagatgtgctcataggagccaagggcaaactcgaaaacagccctgccctgtggttaggggaggtgggtgtggctttaggagttgagaggggaagagctgagtgcgggctggagcagcgagaatgcttcacggaggatgttggggagagaggatttgatttgccgagtggtttggagatctttaggggcgggtaggggaagagggtggctggacttaaggtaggagccgaaagtgggcatgggagcccatccccgtgggtgtgaggccggggtaggaccaggcttcccggctaggcacgcctggctggctgcctctgcctctactaacttcctttgtctctttatcctcctgcttaggccgtgtcttcctctctctctgccattttctctatcagaaaacattaaagctgagtagaaacttcaagatgatcattctggcccagcccttttatctctttatctccaatggtgtgcgttttaagtttctctgacttggtttttctgtccctgtctcccacagttgttcccgctctgcacctgtgtttcagttactctctctctctgtcttagatctttttgtttctgcctagtctctgtgccctgtctttgtgtgtttctttctctgcctgaaaccctccctcttttcccttcaggcatatgtctctaaaccaatgttatgtatcaaagactgttgaaagagacagggctactctaggaatggatgggtggggatattttccccatggatcaagatccagtttagggttgggaaataaaggatagggataaaagaggcaccccattcagtcagcagatacttattcagcacctactatgtgtttgatactgtatacaaaagacatgaatgggctgggtcctgaacagagaataaagggtttgactcc

SEQ ID NO: 7879 - DNA, 1620 bp, Homo sapiens
gcctttggctttggctggcacaggggtgaaggagagccagcggcattgagtaaccaggcgaatgtgcccccaggagagttcattccaaccctcccagttcctactgctggtgggggtcccagtggcaagtgtcctccttctggcccaatgccttcgatggcactgccctagaaggctgctgggggcctgctggacactgaatggtcaagaggaaccagtgtcccagcctaccccccaactagaaaatgaggtctcaaggcagcacctgccagccacactgccagagatggttgccttctaccaggagctacacacacccactcaaggccagaccatggtccgccagttgatgcacaaactgttggtgttttcggctcgagaggtggatcaccgcggcggttgcctgatgctccaggatacaggcatctccttgctcatcccaccaggtgctgtggctgtgggccgccaggagcgggtgtctttgatcctggtgtgggacctgtcggacgccccatcgctgtcccaagcccaggggctggtaagccctgtggtggcatgtggcccccatggggcctccttcctgaagccttgcactctcacgttcaaacactgtgccgagcagcccagccatgctcgcacctacagcagcaacactaccctgctggatgccaaggtatggaggcccctggggcggccgggggcccacgcctcccgggatgagtgtcgcatccacctctcccacttcagcctctacacctgtgtgctggaggcacctgtggggcgcgaagcccgcaaatggctgcagctggccgtattctgctcaccgctggtgccaggacagtcccatctgcaactgcgtatctacttcctcaacaacacgccctgcgccctgcagtgggcactgaccaacgagcagccccatggtgggcgcctgcgtgggccctgccagctcttcgacttcaatggggctaggggcgaccagtgcctgaagctcacgtacatctcagagggttgggagaatgtggatgacagcagttgccagctggttccccatctccacatctggcatggaaagtgccccttccgctccttctgcttccggagaaaagcagccgatgagaatgaggactgttcagcactaaccaatgagatcattgtcaccatgcacaccttccaggatggcttggagaccaagtatatggaaatcctcagattccaggcatcagaggaggaatcctgggcagcgccaccacctgtttcccagccgcccccatgcaataggctgcccccagagctctttgagcagctgcggatgttattggagccaaacagcatcaccggcaatgactggcgcagactggcctcccacctggggctttgcggcatgaagatccggttcctgtcctgccagcgcagccccgcagcggccatcctggagttgtttgaggagcagaacggcagcctgcaggagctgcactacctcatgaccgtcatggagcggctagactgcgcctccgccatccagaactacctgagtgggacacacggcggcagcccaggccccgagcgcgggggcgcccgggataaccagggcctggagctggacgagaagctctgagc

SEQ ID NO: 7880 - DNA, 3252 bp, Homo sapiens
cggactctcgcctccgctccgtagttcggggcccggcagcggcgcgagggctgggaactgcgcggcggggactgcgggcgactccggcatccgcgctggcggcagcggtcgccgcgccgtgggaagctatggggacgcgccctttctcggggtgcccattcagcggcggctcggagctccctgccccgctgctttaggaagcgatcgtggagcagagtcactctctgaagactcccgagacccattcgactcgggaccctcatcgccgaccctttcccgggctcccggagcgtgaagaagagccgccctccggaacgcggcgaggagcatggggagagcggcggccaccgcaggcggcggcggaggggcgcgccgctggctcccgtggctggggctgtgcttctgggcggcagggaccgcggctgcccgaggaactgacaatggcgaagcccttcccgaatccatcccatcagctcctgggacactgcctcatttcatagaggagccagatgatgcttatattatcaagagcaaccctattgcactcaggtgcaaagcgaggccagccatgcagatattcttcaaatgcaacggcgagtgggtccatcagaacgagcacgtctctgaagagactctggacgagagctcaggtttgaaggtccgcgaagtgttcatcaatgttactaggcaacaggtggaggacttccatgggcccgaggactattggtgccagtgtgtggcgtggagccacctgggtacctccaagagcaggaaggcctctgtgcgcatagcctatttacggaaaaactttgaacaagacccacaaggaagggaagttcccattgaaggcatgattgtactgcactgccgcccaccagagggagtccctgctgccgaggtggaatggctgaaaaatgaagagcccattgactctgaacaagacgagaacattgacaccagggctgaccataacctgatcatcaggcaggcacggctctcggactcaggaaattacacctgcatggcagccaacatcgtggctaagaggagaagcctgtcggccactgttgtggtctacgtgaatggaggctggtcttcctggacagagtggtcagcctgcaatgttcgctgtggtagaggatggcagaaacgttcccggacctgcaccaacccagctcctctcaatggtggggccttttgtgagggaatgtcagtgcagaaaataacctgcacttctctttgtcctgtggatgggagctgggaagtgtggagcgaatggtccgtctgcagtccagagtgtgaacatttgcggatccgggagtgcacagcaccacccccgagaaatgggggcaaattctgtgaaggtctaagccaggaatctgaaaactgcacagatggtctttgcatcctagataaaaaacctcttcatgaaataaaaccccaaagcattgagaatgccagcgacattgctttgtactcgggcttgggtgctgccgtcgtggccgttgcagtcctggtcattggtgtcaccctttacagacggagccagagtgactatggcgtggacgtcattgactcttctgcattgacaggtggcttccagaccttcaacttcaaaacagtccgtcaaggtaactccctgctcctgaattctgccatgcagccagatctgacagtgagccggacatacagcggacccatctgtctgcaggaccctctggacaaggagctcatgacagagtcctcactctttaaccctttgtcggacatcaaagtgaaagtccagagctcgttcatggtttccctgggagtgtctgagagagctgagtaccacggcaagaatcattccaggacttttccccatggaaacaaccacagctttagtacaatgcatcccagaaataaaatgccctacatccaaaatctgtcatcactccccacaaggacagaactgaggacaactggtgtctttggccatttaggggggcgcttagtaatgccaaatacaggggtgagcttactcataccacacggtgccatcccagaggagaattcttgggagatttatatgtccatcaaccaaggtgaacccagcctccagtcagatggctctgaggtgctcctgagtcctgaagtcacctgtggtcctccagacatgatcgtcaccactccctttgcattgaccatcccgcactgtgcagatgtcagttctgagcattggaatatccatttaaagaagaggacacagcagggcaaatgggaggaagtgatgtcagtggaagatgaatctacatcctgttactgccttttggacccctttgcgtgtcatgtgctcctggacagctttgggacctatgcgctcactggagagccaatcacagactgtgccgtgaagcaactgaaggtggcggtttttggctgcatgtcctgtaactccctggattacaacttgagagtttactgtgtggacaataccccttgtgcatttcaggaagtggtttcagatgaaaggcatcaaggtggacagctcctggaagaaccaaaattgctgcatttcaaagggaatacctttagtcttcagatttctgtccttgatattcccccattcctctggagaattaaaccattcactgcctgccaggaagtcccgttctcccgcgtgtggtgcagtaaccggcagcccctgcactgtgccttctccctggagcgttatacgcccactaccacccagctgtcctgcaaaatctgcattcggcagctcaaaggccatgaacagatcctccaagtgcagacatcaatcctagagagtgaacgagaaaccatcactttcttcgcacaagaggacagcactttccctgcacagactggccccaaagccttcaaaattccctactccatcagacagcggatttgtgctacatttgatacccccaatgccaaaggcaaggactggcagatgttagcacagaaaaacagcatcaacaggaatttatcttatttcgctacacaaagtagcccatctgctgtcattttgaacctgtgggaagctcgtcatcagcatgatggtgatcttgactccctggcctgtgcccttgaagagattgggaggacacacacgaaactctcaaacatttcagaatcccagcttgatgaagccgacttcaactacagcaggcaaaatggactctagtccacttcctcccatgagacagagtgatggccagcttggggacatttgctttaaatgggaaa

SEQ ID NO: 7881 - DNA, 7002 bp, Homo sapiens
ttaaataagtagggattgtttaaaaaaaaaagctgtaatatgttatctgggggtggatgatcctggtgttagttaaagctctcagtgatgtctgtgctgggacttccgggttcctgttggacttttcctcccaaacttcaccaggaactgacaatggcgaagcccttcccgaatccatcccatcagctcctgggacactgcctcatttcatagaggagccagatgatgcttatattatcaagagcaaccctattgcactcaggtgcaaagcgaggccagccatgcagatattcttcaaatgcaacggcgagtgggtccatcagaacgagcacgtctctgaagagactctggacgagagctcaggtttgaaggtccgcgaagtgttcatcaatgttactaggcaacaggtggaggacttccatgggcccgaggactattggtgccagtgtgtggcgtggagccacctgggtacctccaagagcaggaaggcctctgtgcgcatagcctatttacggaaaaactttgaacaagacccacaaggaagggaagttcccattgaaggcatgattgtactgcactgccgcccaccagagggagtccctgctgccgaggtggaatggctgaaaaatgaagagcccattgactctgaacaagacgagaacattgacaccagggctgaccataacctgatcatcaggcaggcacggctctcggactcaggaaattacacctgcatggcagccaacatcgtggctaagaggagaagcctgtcggccactgttgtggtctacgtgaatggaggctggtcttcctggacagagtggtcagcctgcaatgttcgctgtggtagaggatggcagaaacgttcccggacctgcaccaacccagctcctctcaatggtggggccttttgtgagggaatgtcagtgcagaaaataacctgcacttctctttgtcctgtggatgggagctgggaagtgtggagcgaatggtccgtctgcagtccagagtgtgaacatttgcggatccgggagtgcacagcaccacccccgagaaatgggggcaaattctgtgaaggtctaagccaggaatctgaaaactgcacagatggtctttgcatcctagataaaaaacctcttcatgaaataaaaccccaaagcattgagaatgccagcgacattgctttgtactcgggcttgggtgctgccgtcgtggccgttgcagtcctggtcattggtgtcaccctttacagacggagccagagtgactatggcgtggacgtcattgactcttctgcattgacaggtggcttccagaccttcaacttcaaaacagtccgtcaaggtaactccctgctcctgaattctgccatgcagccagatctgacagtgagccggacatacagcggacccatctgtctgcaggaccctctggacaaggagctcatgacagagtcctcactctttaaccctttgtcggacatcaaagtgaaagtccagagctcgttcatggtttccctgggagtgtctgagagagctgagtaccacggcaagaatcattccaggacttttccccatggaaacaaccacagctttagtacaatgcatcccagaaataaaatgccctacatccaaaatctgtcatcactccccacaaggacagaactgaggacaactggtgtctttggccatttaggggggcgcttagtaatgccaaatacaggggtgagcttactcataccacacggtgccatcccagaggagaattcttgggagatttatatgtccatcaaccaaggtgaacccagcctccagtcagatggctctgaggtgctcctgagtcctgaagtcacctgtggtcctccagacatgatcgtcaccactccctttgcattgaccatcccgcactgtgcagatgtcagttctgagcattggaatatccatttaaagaagaggacacagcagggcaaatgggaggaagtgatgtcagtggaagatgaatctacatcctgttactgccttttggacccctttgcgtgtcatgtgctcctggacagctttgggacctatgcgctcactggagagccaatcacagactgtgccgtgaagcaactgaaggtggcggtttttggctgcatgtcctgtaactccctggattacaacttgagagtttactgtgtggacaataccccttgtgcatttcaggaagtggtttcagatgaaaggcatcaaggtggacagctcctggaagaaccaaaattgctgcatttcaaagggaatacctttagtcttcagatttctgtccttgatattcccccattcctctggagaattaaaccattcactgcctgccaggaagtcccgttctcccgcgtgtggtgcagtaaccggcagcccctgcactgtgccttctccctggagcgttatacgcccactaccacccagctgtcctgcaaaatctgcattcggcagctcaaaggccatgaacagatcctccaagtgcagacatcaatcctagagagtgaacgagaaaccatcactttcttcgcacaagaggacagcactttccctgcacagactggccccaaagccttcaaaattccctactccatcagacagcggatttgtgctacatttgatacccccaatgccaaaggcaaggactggcagatgttagcacagaaaaacagcatcaacaggaatttatcttatttcgctacacaaagtagcccatctgctgtcattttgaacctgtgggaagctcgtcatcagcatgatggtgatcttgactccctggcctgtgcccttgaagagattgggaggacacacacgaaactctcaaacatttcagaatcccagcttgatgaagccgacttcaactacagcaggcaaaatggactctagtccacttcctcccatgagacagagtgatggccagcttggggacatttgctttaaatgggaaagaggccgctttctgcccagtggcgttgggggaattcagccttcatttataatcagtgagattcccctgttgaagaaactaaattttatataggtaaaacatgttaatagggaagagtacaagctctcttacatataagagggctctactatctccttggaatccacatttgggttaactcctcagatttggagtggcaaggataaaagtgagggcagaagtagctgtgggaaaagatgagctatgataatgctgggaaggcagagattgattaagtgcatgctttgaaataggtttttaatgatgtgccccaaagggccagctgattctggtactagattgtcagagttttctaccaactggcatctgtgatgtcagagatcattgtaaaaatggcttttagacgtgaaacagggttgccaacccatttgtatgacttcaacaacgtcaaggagggcatttagaatttagaatctgagcacatcacaccagcaccagctccctgtctcttctagccacttaatggagacacaatggagaggtaagacagaccacaaactagttcttatagtgtactccaccttttacttttttcctgagacaaatctacccttattctttcttcctcttccttaccccttgcagtagggaggtatcaaggagcataattaaacttgtcaatacggaaagttgttttttctaacacaacaaagtgggaccatctctattcccatctaagccactcaaattgctgagtgctattagaacacagcttattacatggatatggggacaggagagattaaagcaggttcaaaaacacatgaactgcagatgccataggcctcaaatcagctgtaattctaggagacacgtgttgatctagttatctaacattgttgttataagaaaatgagtttactgcatttttcaatccagattcttgaaattgtctaacatgtgggtactgtgtcatcacaaaatctctcagtaaggctatatgtgatcctcattttgcctcttgggaaattagcagatagtctttgctctaaatgatatctgagtaaatagacttgaggaatcctctaccacagtgtccctgaaaccacatgcatcattcaggaagccttcaccctgtgactattcagcctccctgaatatgctttctctatagaaccactaacatatggctattgctctatgatttttttttttacattaggaggcagtgatattgtggaagattgaaatccacagataattcatgaccctcatcttatcactttactccatctttttatcctattaaattatttttgacaagatgtcctggtagactaaaggtgaacagatttgctcttgctcatcttctggtggatattttaacttgctattcacaatcaggacaaccaaagtcaaggacccagatgaaccacaaggcagctagtcagctacttagaggttggttacattcgaataaaaagtagtcagggaatgggggaggtggggagttggggagtacttggcagttgggatatgatccatttttttaaacaagttttttgtagatcccttgtaaaataataataataatgttgtgaatctccatgccaagtgaaaaaggcctaaagatgagttgaatttgtgataccatgggtaaggcatggaagaactcttgaatgtgttggccattttctctaactaacatgtggtatgtatggtcccctatattagatagaagtctttgctacatgtaattcaaaagcatctcgcttttctcaggaaccaaaggcttatgatgtaggacaaagaaatcatcttagaactgtcaagcatattttcacaataccatgtcaagatcaggaaaacacccttttgctagtgtgcttaacttatttatttcttctaggaaacaatagataaacagcatgaaaatgtaaatcatctggcatcactgatagaatttctgaaagagaaagagaagtagatggtcaaccagtcactagttggttggcatgaggtggtgtgcagaggaaagctgcattcactattgagtaaaaacttgtagaaagcacattatagagcttatgttggaatccatcttggaggatttttgttttaaactgtctttagcattttccctcttcccttctaatgggcattataattgtttcatctactctgtgaatctacataggtctttttttttagatgtttgatacattttaagtatttttaaatagatgaaaattctaaatgattttccctcaaatctatctagattattttaagatgagacaagattattgtcaatccctgaatgtctggagttacctcccatggatttttttttcctttggcctgggttttataaacaacttgaacatcatatcatataggataacaaaggaggaagttaacttaattcacctcagacttcagcctaagattcaatcaaattcatccttcagcctgtcttgtttcttctttatgtttcttttacttattgctgctaggatcctacataggatttctatagaaatgtatgaaattctgtggtcactgcatgtcaggattgcacagtatgttacaatacaatttcaaagagaacccacatttgtgagatttacagaccaaggtgtggtggaggaggtagaattgcagatcagataaaaagtgagcttacacttgaacttagttattcactgtgacctaaatttagtcctattgtaatatgtgcctgtcacaacacaaatacccctcttgaaagagatttactcatctatccaagcacttaatttggaaattttattgtcctattgcaaaatgaaacaaaattaaaagtggcctcgagtacttggtaagttacttaaaatttttacaaaaatatcccactcaatgccaaatctttcagtcctcaaaggcatttaagtccaatagtcatgctttaaatatggctttaaattatgccaccaaaatggtgcacttcacagattcaccagactgtagcatcataaagttaatttacagtttttacaacattgcttctacattcttactggtttacattaaaatcctttaagccaaaaggaagcttgctctatggatttaaatgcaaacttcatttaccagtgcaggaagtctcataaaactcagatgtactcccacaaaaattttattggcctttttgtaagagatgaaaaagaattgacacagttctctttaaagagaagaacttttttattattatttttatctccaactgcaggtggtgtcttttgccaaggtctctgtatttttctttcagttgtctttgggaggggatgttaagtcaaatcactaaaacagggttctctttggattaaaagttctggatttattgcaactattttccttgagaaacattctcagcatcaggattgataaacaaatgtagatgattaaaataggataattggttttagataatatcttctactgccaaacttctggcaaatttacctgtgaatttcaaaatgttataaaatctcttgatatgcttttgtttttccttttagccattttctcttcaatttcttagtccctctgccctctgtaaatgtgttgagtgatatagctatcagatgtattgaaggcaaagttctcgcagaggtctctgttccagctctgtaaaggtcacaggaatcgtgaaggagctgagaaatcttcctctccggcccactgtctgtggcccattgtcattgtttcctcatgaaacattgcagagtttgaatcctcagtaactctcattgactggattagaggtgatggccacagcaaatgggagagcaaaatgttggcctacagagaatgacacaattttattcgcctttggtgttagttgccatagtgctgtatttgaaaatcgatgctttagccaaaagctgaatgaccaccgtttccgtagtttccactgttttgtctgcatagaattttcctgaactacaagcaaaaatgtattttgtccaatgtcacaaaagtgaaaatgttactaatctt

SEQ ID NO: 7882 - DNA, 1143 bp, Homo sapiens
ggcggaagtcggttcccgtgacgcggcgcgccccaagggccggctccgttgagggaagggaagcccgcccggtggcggctggggtcggctgctgggaggaggtggtgggctggttcggacgtgggtcgaggctgtagcaggactccaggaagatgttaccgagtacttcagtgaattccttagtgcaggggaacggagtcttgaattccagggatgcggcaagacacacagccggagcgaaacgctacaaatatctgagaaggcttttccgctttcggcaaatggactttgaatttgctgcctggcagatgctctacctgttcacatccccacagagagtttacagaaattttcattatcgaaaacagacgaaggaccagtgggccagagatgaccctgctttcttggtcctgttaagtatctggctctgtgtgtccactataggatttggctttgtgctggacatgggattctttgagacaataaagcttctcctttgggttgtactcatagattgtgtaggcgttggtcttctgatagcaactttaatgtggttcatctctaacaagtatttagtgaaacgacagagcagagactatgatgtggaatggggctatgcttttgatgtgcatctcaatgctttttatccactcctggtcattttgcattttatccagctttttttcatcaaccatgttatcctgacagacacatttattggatatttagttggaaataccttatggttggttgcagttggctattatatctatgtaactttcctgggatacagtgcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactaaa

SEQ ID NO: 7883 - DNA, 1276 bp, Homo sapiens
ggcccctcggccggcgatagagttgcggctaaaatgaaaggacgcccagttacatttgcatcgtagataaagaaagagcatttagtataagcatgtccgaaatgttgcgtgggatgtaggcatactaaaaccttattcgtggcctgtctgaaatccaaatggagctggggttgggaagaacatggaaagtgacctccctgccaaataactcagaagaggagtgtcggtagccaaatgtttcttcagaatacgtgtaaaagaaatgtttttcttccatctaggaagatgttaccgagtacttcagtgaattccttagtgcaggggaacggagtcttgaattccagggatgcggcaagacacacagccggagcgaaacgctacaaatatctgagaaggcttttccgctttcggcaaatggactttgaatttgctgcctggcagatgctctacctgttcacatccccacagagagtttacagaaattttcattatcgaaaacagacgaaggaccagtgggccagagatgaccctgctttcttggtcctgttaagtatctggctctgtgtgtccactataggatttggctttgtgctggacatgggattctttgagacaataaagcttctcctttgggttgtactcatagattgtgtaggcgttggtcttctgatagcaactttaatgtggttcatctctaacaagtatttagtgaaacgacagagcagagactatgatgtggaatggggctatgcttttgatgtgcatctcaatgctttttatccactcctggtcattttgcattttatccagctttttttcatcaaccatgttatcctgacagacacatttattggatatttagttggaaataccttatggttggttgcagttggctattatatctatgtaactttcctgggatacagtgcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactaaa

SEQ ID NO: 7884 - DNA, 2172 bp, Homo sapiens
ggcggaagtcggttcccgtgacgcggcgcgccccaagggccggctccgttgagggaagggaagcccgcccggtggcggctggggtcggctgctgggaggaggtggtgggctggttcggacgtgggtcgaggctgtagcaggactccaggtgaggcctgaggaccactctgccctcccgcggcccgggctcgcgccgggggccatttaatcccgacagcttgcggcctgacgtcgctgcggcctggcagtgaccatgtcggcgtccggcccctcggccggcgatagagttgcggctaaaatgaaaggacgcccagttacatttgcatcgtagataaagaaagagcatttagtataagcatgtccgaaatgttgcgtgggatgtaggcatactaaaaccttattcgtggcctgtctgaaatccaaatggagctgggtattctgtgtttttatttgctaaatctggcagccgtacccgcggccccgggcagggagggagcagctgggctcggccagaccctgccggcgtctggggggcctgcgaagtggaggggagacgggcagccgggcagtggccggcgttccccggagctcggaccggttggattggactccgacgctaccgctccctctgctgaactattccggatgtaaaacactagggatcggagtttttcttggttttttaatctcattctagtgaccgagaagcttgctggcagtgcgctgatggatctgtgtgaataggccatttatttgacctcttcagtaacactgttctaaccggctgaaactgctttcttaggcattttcttaaaagcttggtggttaagagcacggaatttcgagtcagatttccaatcttggctctatcactatcctcggagtcatggggcagtcacatcatccctgtctctgtaatggtagctgcccctggataagtgttattaggtgattcagaagggtgggctgttgcccttgcctgaggttgcagtctgcggttcccaagccccaagacccgcctcagaactaactgcatttgcttttgactcctggcctttctctagggttgggaagaacatggaaagtgacctccctgccaaataactcagaagaggagtgtcggtagccaaatgtttcttcagaatacgtgtaaaagaaatgtttttcttccatctaggaagatgttaccgagtacttcagtgaattccttagtgcaggggaacggagtcttgaattccagggatgcggcaagacacacagccggagcgaaacgctacaaatatctgagaaggcttttccgctttcggcaaatggactttgaatttgctgcctggcagatgctctacctgttcacatccccacagagagtttacagaaattttcattatcgaaaacagacgaaggaccagtgggccagagatgaccctgctttcttggtcctgttaagtatctggctctgtgtgtccactataggatttggctttgtgctggacatgggattctttgagacaataaagcttctcctttgggttgtactcatagattgtgtaggcgttggtcttctgatagcaactttaatgtggttcatctctaacaagtatttagtgaaacgacagagcagagactatgatgtggaatggggctatgcttttgatgtgcatctcaatgctttttatccactcctggtcattttgcattttatccagctttttttcatcaaccatgttatcctgacagacacatttattggatatttagttggaaataccttatggttggttgcagttggctattatatctatgtaactttcctgggatacagtgcattgccatttttgaaaaatacagtaattcttctgtatccatttgcacctctgattctgctctacgggctttccctggcactgggatggaacttcacccatactctctgttctttctataagtacagagtgaaataaaaagtgagaagaagattcaatcgtaactgtgtcaacagtattgtgaagtgatcatttcttgtaaaacttgtaaataaactatcatctttgtagatatcttaaaggtgtaaagtttgcaaatttgaagaaatatatattaacactgtggtcaggtacattccttaaaactaattaaatgtacatttctataataaatattttttaaactaaa

SEQ ID NO: 7885 - DNA, 3908 bp, Homo sapiens
agtcgcgcgggagcgggtagcgcgcgcgagggcgttgggcgccgccgcgaggcggggaagcgcggggccgcggcggtgcgggttctagggcggcggccgtcgccgtcgcagcagcgccccgagcggggagggccgaggaggcccgacgagctggggatggagagtaccgggcccctcactgcctcagagcgcgtgtgcggctctgggcgcgcacagtgacggtgacggcacccctggcccggcagcgccgaggccgcttcgccagacagccagcggccggcggcaggccgggccatgagcggcaggggccgggccgggcctcgctgaccctggctccgcgcggcagcttccccagtttccgctccggtctctcggcatgagagtccgcccgggcccggggctgcggctgccccagacccgccgcacgctggcgcgctccgggcccgcggagccgcggtgctgatacctgcgccgcactgcgccgcccgcccgtccgctgtgtgccccgggggcgcggccatggaggtggtgggtgacttcgagtacagcaagagggatctcgtgggacacggggccttcgccgtggtcttccgggggcggcaccgccagaaaactgattgggaggtagctattaaaagtattaataaaaagaacttgtcaaaatcacaaatactgcttggaaaggaaattaaaatcttaaaggaacttcagcatgaaaatattgtagcactctatgatgttcaggaattacccaactctgtctttttggtgatggagtattgcaatggtggagacctcgcagattatttgcaagcgaaagggactctcagtgaagacacgatcagagtgtttctgcatcagattgctgctgccatgcgaatcctgcacagcaaaggaatcatccacagagatctcaaaccacagaacatcttgctgtcctatgccaatcgcagaaaatcaagtgtcagtggtattcgcatcaaaatagcggattttggttttgctcgttacctacatagtaacatgatggctgcaacactgtgtggatccccgatgtacatggctcctgaggttattatgtctcaacattatgatgctaaggctgacttgtggagcataggaacagtgatataccaatgcctagttggaaaaccaccttttcaggccaatagtcctcaagacttaaggatgttttatgaaaaaaacaggagcttaatgcctagtattcccagagaaacatcaccttatttggctaatctccttttgggtttgcttcagagaaaccaaaaagatagaatggactttgaagcattttttagccatccttttcttgagcaaggtccagtaaaaaaatcttgcccagttccagtgcccatgtattctggttctgtctctggaagctcctgtggcagctctccatcttgtcgttttgcttctccaccatcccttccagatatgcagcatattcaggaagaaaacttatcttccccaccattgggtcctcccaactatctacaagtttccaaagattctgccagtactagtagcaagaactcttcttgtgacacggatgactttgttttggtgccacacaacatctcgtcagaccactcatgtgatatgccagtggggactgctggcagacgtgcttcaaatgaattcttggtgtgtggagggcagtgtcagcctactgtgtcacctcacagcgaaacagcaccaattccagttcctactcaaataaggaattatcagcgcatagagcagaatcttacatctactgccagctcaggcacaaatgtacatggttctccaagatctgcagtggtacgaaggtccaacaccagccccatgggcttcctccggccgggatcatgctccccagtaccagcagacacagcacagacagttggacgaaggctctccactgggtcttctaggccttactcaccttcccctttggttggtaccattcctgagcaattcagtcagtgctgctgtgggcatcctcagggccatgactccaggagtagaaactcctcaggttctccagtgccacaagctcagtccccacagtctctcttatcgggtgctagactgcagagcgcccccaccctcactgacatctatcagaacaagcagaagctcagaaaacagcactctgaccccgtgtgcccatcccatactggggctgggtacagctactcgcctcagcccagtcggcctggcagccttggaacttctcccaccaagcacttggggtcctctccacggagttctgactggttctttaaaactcctttgccaacaatcattggctctcctactaagaccacagctcctttcaaaatccctaaaactcaagcatcttccaacctgttagccttggttactcgtcatgggcctgctgaagaacagtcgaaagatgggaatgagccacgggaatgtgcccattgcctcttagtgcaaggaagtgagaggcagcgggccgagcagcagagcaaggcagtgtttggcagatctgtcagtaccgggaagttatcagatcaacaaggaaagactcctatatgtcgacatcagggcagcacagacagtttaaatacagaacgaccaatggatatagctccggcaggagcctgtggtggtgttctggcacctcctgcaggtacagcagcaagttccaaggctgtcctcttcactgtagggtctcctccacacagtgcggcagcccccacttgtacccacatgttccttcgaacaagaacaacctcagtggggcccagcaactccgggggctctctttgtgccatgagtggccgcgtgtgcgtggggtccccgcctggcccaggcttcggctcttcccctccaggagcagaggcagctcccagcctgagatacgtgccttacggtgcttcaccccccagcctagaggggctcatcacctttgaagcccctgaactgccggaggagacgctgatggagcgggaacacacagacaccttacgccatctgaatgtgatgctgatgttcactgagtgtgtgctggacctgacagccatgaggggaggaaaccctgagctgtgcacatctgctgtgtccttgtaccagatccaggagagtgtggtggtggaccagatcagtcagctgagcaaagactgggggcgggtggagcagctggtgttgtacatgaaagcagcacagctgcttgcggcttctctgcatcttgccaaagcccagatcaagtccgggaaactgagcccatccacagctgtgaaacaagttgtcaagaatctgaacgaacgatataaattctgcatcaccatgtgcaagaaacttacagaaaagctgaatcgattcttctctgacaaacagaggtttattgatgaaatcaacagtgtgactgcagagaaactcatctataattgtgctgtagaaatggttcagtctgcagccctggatgagatgtttcagcagaccgaagatattgtttatcgctatcataaggcagcccttcttttggaaggcctaagtaggattctacaggaccctgcagatattgaaaatgtgcataaatataaatgtagtattgagagaagactgtcggcgctctgccatagcaccgcaaccgtgtgagcagcaggctcatcccgtggaccggtggtgggaacgtgaggaagaggggaaggaaggaagagcttttccatttggtgctccaatgtctcctgctggacccatctgcctagtggaaggcagcaaaatttcaagaaacaggtgaggttgagcagcttggtgcaaccccatggggcctggagttggagctcaacagcaatggatttcagagaccaccctgaaactcccagtaaaaaagacttgggagacatgttaataaactcaagcatttgatcgaccca

SEQ ID NO: 7886 - DNA, 5809 bp, Homo sapiens
gcgcgcgcgagggcgttgggcgccgccgcgaggcggggaagcgcggggccgcggcggtgcgggttctagggcggcggccgtcgccgtcgcagcagcgccccgagcggggagggccgaggaggcccgacgagctggggatggagagtaccgggcccctcactgcctcagagcgcgtgtgcggctctgggcgcgcacagtgacggtgacggcacccctggcccggcagcgccgaggccgcttcgccagacagccagcggccggcggcaggccgggccatgagcggcaggggccgggccgggcctcgctgaccctggctccgcgcggcagcttccccagtttccgctccggtctctcggcatgagagtccgcccgggcccggggctgcggctgccccagacccgccgcacgctggcgcgctccgggcccgcggagccgcggtgctgatacctgcgccgcactgcgccgcccgcccgtccgctgtgtgccccgggggcgcggccatggaggtggtgggtgacttcgagtacagcaagagggatctcgtgggacacggggccttcgccgtggtcttccgggggcggcaccgccagaaaactgattgggaggtagctattaaaagtattaataaaaagaacttgtcaaaatcacaaatactgcttggaaaggaaattaaaatcttaaaggaacttcagcatgaaaatattgtagcactctatgatgttcaggaattacccaactctgtctttttggtgatggagtattgcaatggtggagacctcgcagattatttgcaagcgaaagggactctcagtgaagacacgatcagagtgtttctgcatcagattgctgctgccatgcgaatcctgcacagcaaaggaatcatccacagagatctcaaaccacagaacatcttgctgtcctatgccaatcgcagaaaatcaagtgtcagtggtattcgcatcaaaatagcggattttggttttgctcgttacctacatagtaacatgatggctgcaacactgtgtggatccccgatgtacatggctcctgaggttattatgtctcaacattatgatgctaaggctgacttgtggagcataggaacagtgatataccaatgcctagttggaaaaccaccttttcaggccaatagtcctcaagacttaaggatgttttatgaaaaaaacaggagcttaatgcctagtattcccagagaaacatcaccttatttggctaatctccttttgggtttgcttcagagaaaccaaaaagatagaatggactttgaagcattttttagccatccttttcttgagcaaggtccagtaaaaaaatcttgcccagttccagtgcccatgtattctggttctgtctctggaagctcctgtggcagctctccatcttgtcgttttgcttctccaccatcccttccagatatgcagcatattcaggaagaaaacttatcttccccaccattgggtcctcccaactatctacaagtttccaaagattctgccagtactagtagcaagaactcttcttgtgacacggatgactttgttttggtgccacacaacatctcgtcagaccactcatgtgatatgccagtggggactgctggcagacgtgcttcaaatgaattcttggtgtgtggagggcagtgtcagcctactgtgtcacctcacagcgaaacagcaccaattccagttcctactcaaataaggaattatcagcgcatagagcagaatcttacatctactgccagctcaggcacaaatgtacatggttctccaagatctgcagtggtacgaaggtccaacaccagccccatgggcttcctccggccgggatcatgctccccagtaccagcagacacagcacagacagttggacgaaggctctccactgggtcttctaggccttactcaccttcccctttggttggtaccattcctgagcaattcagtcagtgctgctgtgggcatcctcagggccatgactccaggagtagaaactcctcaggttctccagtgccacaagctcagtccccacagtctctcttatcgggtgctagactgcagagcgcccccaccctcactgacatctatcagaacaagcagaagctcagaaaacagcactctgaccccgtgtgcccatcccatactggggctgggtacagctactcgcctcagcccagtcggcctggcagccttggaacttctcccaccaagcacttggggtcctctccacggagttctgactggttctttaaaactcctttgccaacaatcattggctctcctactaagaccacagctcctttcaaaatccctaaaactcaagcatcttccaacctgttagccttggttactcgtcatgggcctgctgaagaacagtcgaaagatgggaatgagccacgggaatgtgcccattgcctcttagtgcaaggaagtgagaggcagcgggccgagcagcagagcaaggcagtgtttggcagatctgtcagtaccgggaagttatcagatcaacaaggaaagactcctatatgtcgacatcagggcagcacagacagtttaaatacagaacgaccaatggatatagctccggcaggagcctgtggtggtgttctggcacctcctgcaggtacagcagcaagttccaaggctgtcctcttcactgtagggtctcctccacacagtgcggcagcccccacttgtacccacatgttccttcgaacaagaacaacctcagtggggcccagcaactccgggggctctctttgtgccatgagtggccgcgtgtgcgtggggtccccgcctggcccaggcttcggctcttcccctccaggagcagaggcagctcccagcctgagatacgtgccttacggtgcttcaccccccagcctagaggggctcatcacctttgaagcccctgaactgccggaggagacgctgatggagcgggaacacacagacaccttacgccatctgaatgtgatgctgatgttcactgagtgtgtgctggacctgacagccatgaggggaggaaaccctgagctgtgcacatctgctgtgtccttgtaccagatccaggagagtgtggtggtggaccagatcagtcagctgagcaaagactgggggcgggtggagcagctggtgttgtacatgaaagcagcacagctgcttgcggcttctctgcatcttgccaaagcccagatcaagtccgggaaactgagcccatccacagctgtgaaacaagttgtcaagaatctgaacgaacgatataaattctgcatcaccatgtgcaagaaacttacagaaaagctgaatcgattcttctctgacaaacagaggtttattgatgaaatcaacagtgtgactgcagagaaactcatctataattgtgctgtagaaatggttcagtctgcagccctggatgagatgtttcagcagaccgaagatattgtttatcgctatcataaggcagcccttcttttggaaggcctaagtaggattctacaggaccctgcagatattgaaaatgtgcataaatataaatgtagtattgagagaagactgtcggcgctctgccatagcaccgcaaccgtgtgagcagcaggctcatcccgtggaccggtggtgggaacgtgaggtgatgcctttgggattacagcttgagttctgtcaccccatccccaggaaactgtagcttcttaactggtgactaccaaagaacaagcagtgatttgaaaaaggaaaaacaatccaaaaactacatatttgtaggaaatctgccttattggagaaaatcaccctttccctttttctttgtagaagcaggagcaagagtgtttggctcccagtttggacttggtgaataaatgtaccttagaactaggataatcggtacagttattcttaaagataattaaaaatgaaacaaagtgagtgctcgtcactgggttcatcagagcagtgtgtgaaattccatgtgtttgctgaggtgtaaaggtaaatgtattcacccctcatccaggcagtttgatatttggagtaagtttgtttaaatctgagcatgcatctttaaacagctcaggaagaaatagcttaagaagaagtgaaacatggatcttggaagaaattttgaaatcttcaatttgatcctaatatggatacatgttaatcttccaaaatctttcatattgcactaatttattaaaacaactgtgtattggattttgtaatttaactaaggcacaatggacttgtttaaaatattttacttgattgtatacatagaccctttccagaattcacatgtaatctccagtgaacttttaagtggttaaaacttgtattcatgtgaacctttgcacattttttttttttacttctttatctacacctacagattttctcagtaatgtttttgttagcttttggttccattttttattgtgcatgcagaatgtacattgatgcctgtgaccttaggtttattaaaggctaggtttatttgggcagtattagaaacaaaatcatggatcaagagatactcttgataatttgaatagggccaaaacaaagttggtgacctaaaggcttgttagtgatgtggagttcctacatgcagtgagtggaaaatgaagttcgttttctcttaggaaaatgggcagctgtcttctgcctaatgtgtatttttcatgttaattctgacagttcaccaaatagctagtcatggagaatgcaggcagttaacttaatatccctccaggaatggttcctacgttgtgtattacttggtttcttttacttacctgcttgaatacttgaataaaccattcaccaattttaatccttttattttaatccttttacataaaataatctgaactctttgacaaattgcacagagctctttggcattaatctaattttaatgtactgataaaaacaaacatggttttcctttactttgacaaagtaatgtaatttttaccttatttatctgtatgaaattccagtagttaatttgaacatttatttatatgacgtttgtatttttaggtctttaatacagtgtttctacctctcatttgtaactgcatgcattattcttgaaactaggtaaaactcactgaattgttgtgtaatagcctttttattattgcctgtacaaatgtatattaaggtaaaataaaactgacaaagtgtttctagggtgtagctgggtacatattaagtggcttgttgagccaggtacttccttagtgagtttagagacttggccatgaatatcctttgtcctgccccaggatttagatcttggctactgtcatgcaggcttccaggaacatagactgttttacctccacaaccctatttgttattagtgatactttattttatataatattttttattcacagtgaaatttcattcatgttctttcagttatcacctgtgttatctcagttgtaggtttattctatcctctcctcttcctctcccatttcttttttaagacaggatgaaacaggttcagagaggggaagtgattggcctaaagtcaggaactaggcaagtggtcaagccatgctttgtgactttcaagttaattcttcttgttcttgtatattaaaggtcttggggtagatggtgtgtgtgaaacagtgaagtctcaacagcagaaaagaacaaaatgtaaattcatgaataatggttctggttatacttccattatcaaggctaattaagagattttgccttgagtatagcaataataaacaaatgctttatgtttccctgag

SEQ ID NO: 7887 - DNA, 2705 bp, Homo sapiens
gaatgaaggccttggctggggaagcgaaagcgaaagctgcccgagccctgacgcccgccctggccgagcgtagctggcggaccagagccggtagcgaggttgggagagacggagcggacctcagcgctgaagcagaagtccccggagctgcggtctccccgccgcggctgagccatgcggctccctgacctgagaccctggacctccctgctgctggtggacgcggctttactgtggctgcttcagggccctctggggactttgcttcctcaagggctgccaggactatggctggaggggaccctgcggctgggagggctgtgggggctgctaaagctaagagggctgctgggatttgtggggacactgctgctcccgctctgtctggccacccccctgactgtctccctgagagccctggtcgcgggggcctcacgtgctcccccagccagagtcgcttcagccccttggagctggctgctggtggggtacggggctgcggggctcagctggtcactgtgggctgttctgagccctcctggagcccaggagaaggagcaggaccaggtgaacaacaaagtcttgatgtggaggctgctgaagctctccaggccggacctgcctctcctcgttgccgccttcttcttccttgtccttgctgttttgggtgagacattaatccctcactattctggtcgtgtgattgacatcctgggaggtgattttgacccccatgcctttgccagtgccatcttcttcatgtgcctcttctcctttggcagctcactgtctgcaggctgccgaggaggctgcttcacctacaccatgtctcgaatcaacttgcggatccgggagcagcttttctcctccctgctgcgccaggacctcggtttcttccaggagactaagacaggggagctgaactcacggctgagctcggataccaccctgatgagtaactggcttcctttaaatgccaatgtgctcttgcgaagcctggtgaaagtggtggggctgtatggcttcatgctcagcatatcgcctcgactcaccctcctttctctgctgcacatgcccttcacaatagcagcggagaaggtgtacaacacccgccatcaggaagtgcttcgggagatccaggatgcagtggccagggcggggcaggtggtgcgggaagccgttggagggctgcagaccgttcgcagttttggggccgaggagcatgaagtctgtcgctataaagaggcccttgaacaatgtcggcagctgtattggcggagagacctggaacgcgccttgtacctgctcgtaaggagggtgctgcacttgggggtgcagatgctgatgctgagctgtgggctgcagcagatgcaggatggggagctcacccagggcagcctgctttcctttatgatctaccaggagagcgtggggagctatgtgcagaccctggtatacatatatggggatatgctcagcaacgtgggagctgcagagaaggttttctcctacatggaccgacagccaaatctgccttcacctggcacgcttgcccccaccactctgcagggggttgtgaaattccaagacgtctcctttgcatatcccaatcgccctgacaggcctgtgctcaaggggctgacgtttaccctacgtcctggtgaggtgacggcgctggtgggacccaatgggtctgggaagagcacagtggctgccctgctgcagaatctgtaccagcccacagggggacaggtgctgctggatgaaaagcccatctcacagtatgaacactgctacctgcacagccaggtggtttcagttgggcaggagcctgtgctgttctccggttctgtgaggaacaacattgcttatgggctgcagagctgcgaagatgataaggtgatggcggctgcccaggctgcccacgcagatgacttcatccaggaaatggagcatggaatatacacagatgtaggggagaagggaagccagctggctgcgggacagaaacaacgtctggccattgcccgggcccttgtacgagacccgcgggtcctcatcctggatgaggctactagtgccctagatgtgcagtgcgagcaggccaatgggttctgggtgggtcccctgggtggtggctctgctagtgaatctgacccgactggattcctccatgactcaaggcacagactctccagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaat

SEQ ID NO: 7888 - DNA, 2451 bp, Homo sapiens
gtgatcatttcaaaccaagcatcagcaacaattaaaaatattcacttggtatctgtagtttaataatggaccaacatcaacatttgaataaaacagcagagtcagcatcttcagagaaaaagaaaacaagacgctgcaatggattcaagatgttcttggcagccctgtcattcagctatattgctaaagcactaggtggaatcattatgaaaatttccatcactcaaatagaaaggagatttgacatatcctcttctcttgctggtttaattgatggaagctttgaaattggaaatttgcttgtgattgtatttgtaagttactttggatctaaactacacagaccgaagttaattggaattggttgtctccttatgggaactggaagtattttgacatctttaccacatttcttcatgggatattataggtattctaaagaaacccatattaatccatcagaaaattcaacatcaagtttatcaacctgtttaattaatcaaaccttatcattcaatggaacatcacctgagatagtagaaaaagattgtgtaaaggaatctgggtcacacatgtggatctatgtcttcatggggaatatgcttcgtggcataggggaaacccccatagtaccattggggatttcatacattgatgattttgcaaaagaaggacattcttccttgtatttaggtagtttgaatgcaataggaatgattggtccagtcattggctttgcactgggatctctgtttgctaaaatgtacgtggatattggatatgtagatctgagcactatcagaataactcctaaggactctcgttgggttggagcttggtggcttggtttccttgtgtctggactattttccattatttcttccataccattttttttcttgccgaaaaatccaaataaaccacaaaaagaaagaaaaatttcactatcattgcatgtgctgaaaacaaatgatgatagaaatcaaacagctaatttgaccaaccaaggaaaaaatgttaccaaaaatgtgactggttttttccagtctttgaaaagcatccttaccaatcccctgtatgttatatttctgcttttgacattgttacaagtaagcagctttattggttcttttacttacgtctttaaatatatggagcaacagtacggtcagtctgcatctcatgctaactttttgttgggaatcataaccattcctacggttgcaactggaatgtttttaggaggatttatcattaaaaaattcaaattgtctttagttggaattgccaaattttcatttcttacttcgatgatatccttcttgtttcaacttctatatttccctctaatctgcgaaagcaaatcagttgccggcctaaccttgacctatgatggaaataattcagtggcatctcatgtagatgtaccactttcttattgcaactcagagtgcaattgtgatgaaagtcagtgggaaccagtctgtgggaacaatggaataacttacctgtcaccttgtctagcaggatgcaaatcctcaagtggtattaaaaagcatacagtgttttataactgtagttgtgtggaagtaactggtctccagaacagaaattactcagcacacttgggtgaatgcccaagagataatacttgtacaaggaaatttttcatctatgttgcaattcaagtcataaactctttgttctctgcaacaggaggtaccacatttatcttgttgactgtgaagattgttcaacctgaattgaaagcacttgcaatgggtttccagtcaatggttataagaacactaggaggaattctagctccaatatattttggggctctgattgataaaacatgtatgaagtggtccaccaacagctgtggagcacaaggggcttgtaggatatataattccgtattttttgggattgttcaacctgaattgaaagcacttgcaatcggcttccattcaatgattatgcgatcgctaggaggtattctagttccaatatattttggggctctgattgatacaacgtgtatgaagtggtccaccaacagctgtggagcacgaggggcttgtaggatatataattccacatatttgggaagagccttcttcggcttgaaggtagccctaatatttccagtacttgttttacttactgtatttatttttgttgtaaggaaaaaatcccatggaaaggataccaaagtattagaaaatgaaagacaagtaatggatgaagcaaacttagaattcttaaacgacagtgaacattttgtaccttctgctgaagaacagtaaagcatgtaattaagaggaggaaaaaaataattttgctgctgtttccaactaatgtattgattccataagacgttatttttgtggtgttctgagtcttttcactgagaattcccacattcttcacttatgatgcaacaat

SEQ ID NO: 7889 - DNA, 683 bp, Homo sapiens
acaattgctctacaactcagaacagcaactgctaaggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactgggttcatgggtttctttctttc

SEQ ID NO: 7890 - DNA, 794 bp, Homo sapiens
acaattgctctacaactcagaacagcaactgctaaggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactggggtaaggatgagttccaccactttttgatgctttcttgtctgtcaagttcagaacttcctgccttttactcctatatcccaaaacttgttttccacacttcatgggtttctttctttcttatttttttcttc

SEQ ID NO: 7891 - DNA, 943 bp, Homo sapiens
acaattgctctacaactcagaacagcaactgctaaggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatgtgcatcgccatctacaggagcagaagagtggacttgctacatgacctagcattattttctggccccatttatcatatcccttttctcctccaaatgtttctcctctcacctcttctgtgggacttaaattgctatatctgctcagagctcacaaatgcctttgaattatttccctgacttcctgatttttttcttcttaagtgttacctactaagagttgcctggagtaagccacccagctacctaattcctcagtaacctccatctataatctccatggaagcaacaaattccctttatgagatatatgtcaaatttttccatctttcatccagggctgactgaaaccgtggctaagaattgggagactctcttgtttcaagccaatttaacatcatttaccagatcatttgtcatgtccagtaacacagaagcaaccaactacagtatagcctgataacatgatttcttagctgacattaatatttctttcttccttgtgttcccacccttggcattgccacccacccctcaattaaggcaacaatgaagttaatggataccctctgcctttggctcagaaatgttatagcaaaaattttaaaataaaaaagtaagtctgtact

SEQ ID NO: 7892 - DNA, 1465 bp, Homo sapiens
acaattgctctacaactcagaacagcaactgctaaggctgccttgggaagaggatgatcctaaacaaagctctgatgctgggggcccttgccctgaccaccgtgatgagcccctgtggaggtgaagacattgtggctgaccacgtcgcctcttatggtgtaaacttgtaccagtcttacggtccctctggccagtacacccatgaatttgatggagatgagcagttctacgtggacctggggaggaaggagactgtctggtgtttgcctgttctcagacaatttagatttgacccgcaatttgcactgacaaacatcgctgtcctaaaacataacttgaacagtctgattaaacgctccaactctaccgctgctaccaatgaggttcctgaggtcacagtgttttccaagtctcccgtgacactgggtcagcccaacatcctcatctgtcttgtggacaacatctttcctcctgtggtcaacatcacatggctgagcaatgggcactcagtcacagaaggtgtttctgagaccagcttcctctccaagagtgatcattccttcttcaagatcagttacctcaccctcctcccttctgctgaggagagttatgactgcaaggtggagcactggggcctggacaagcctcttctgaaacactgggagcctgagattccagcccctatgtcagagctcacagagactgtggtctgcgccctgggattgtctgtgggcctcgtgggcattgtggtgggcactgtcttcatcatccgaggcctgcgttcagttggtgcttccagacaccaagggcccttgtgaatcccatcctggaatggaaggtgcatcgccatctacaggagcagaagagtggacttgctacatgacctagcattattttctggccccatttatcatatcccttttctcctccaaatgtttctcctctcacctcttctgtgggacttaaattgctatatctgctcagagctcacaaatgcctttgaattatttccctgacttcctgatttttttcttcttaagtgttacctactaagagttgcctggagtaagccacccagctacctaattcctcagtaacctccatctataatctccatggaagcaacaaattccctttatgagatatatgtcaaatttttccatctttcatccagggctgactgaaaccgtggctaagaattgggagactctcttgtttcaagccaatttaacatcatttaccagatcatttgtcatgtccagtaacacagaagcaaccaactacagtatagcctgataacatgatttcttagctgacattaatatttctttcttccttgtgttcccacccttggcattgccacccacccctcaattaaggcaacaatgaagttaatggataccctctgcctttggctcagaaatgttatagcaaaaattttaaaataaaaaagtaagtctgtact

SEQ ID NO: 7893 - DNA, 732 bp, Homo sapiens
ggaggaggtgaggagggtttgctgggtgggtatgggggagggggagactctgcaggagcctaattccccactctgagctcacccttctgtctgcccgggccctaccccttcccctactctcacccttataatccttttcagcactaggtcttcccgtcacctccacctctctccatgacccggctctgcttacccagacccgaagcacgtgaggatccgatcccagttcctccaaggggcctgggtgctggggaggggtcaggtagtccagtgcgtccacctgtatccacctggggccctagctgggcccagctcctggacagtgtcctatggctgggggcactaggactgacaatccaggcagtcttttccaccactggcccagccctgctgctgcttctggtcagcttcctcacctttgacctgctccataggcccgcaggtcacactctgccacagcgcaaacttctcaccaggggccagagtcagggggccggtgaaggtcctggacagcaggaggctctactcctgcaaatgggtacagtctcaggacaacttagcctccaggacgcactgctgctgctgctcatggggctgggcccgctcctgagagcctgtggcatgcccttgaccctgcttggcctggctttctgcctccatccttgggcctgagagcccctccccacaactcagtgtccttcaaatatacaatgaccacccttcttcatcagg

SEQ ID NO: 7894 - DNA, 1381 bp, Homo sapiens
aggtcctcgcgactccgcttctgggccccagggcagcagcacggagcctccggacaacctactgaccacccacgtgctggacaccgcctcagggctcccagccagaggcctctgcctccgcttgtgctggctggaggaccacggccagcagtgggcggagctgaggacaagctacacagacccagatggtcactgtcctggaccagatgaaggcaggcacctacaagctcaccttcgacactgagggctactggaggaagagggggcaggaaagcttctacccacatgtggaggttgttttaaccatcaccagcaaggcccagaagttccacgtgcccctggtcctacatcacctaccgagggagttagagcgaagactggcagcgggaggctgcctgcccgttcccgcacgctggctgcacccacccagccctcaacagagcgggctttgtgctcatcagggagcattggctcaccacttcctagggaagtcccggccccctggagaatcccactgggcagctgtgactcaggtgtcaatgaagttagtgccagcacctgcaaagctgtccattcggtgggacaacagtggcgcgaagacaggcagcacagcgcggcactgccccaacccccaggtgagtgcggggcactctgagaaggtgccgccgactgtggtcggaggtgagaccagggagtaggcctggacacaggctggacgtgcggcacccagggaagggagcgacagggacaccatgggtgagggtcctgcaggtggttctcctccacagagccaggaaagaggatggcaagaacatgtgaaaagctttcatttgctgatgataaaatctaaaaaacttgctgtccttggtgtgataaggggtgtcatcccgagtgttcctaggctggttctctgggctgtggccccccaggggggcagctacgtcggggtgcccaccagtcccgcggggccctggcccagtgtctgtccgatcacagctgtttccaagggcttgaagcccacgttgtccagagggatcccgaaggccagcagctttgcctcatacgtgcgcagcaggtcgttatgggcctgtggagacagggcagtgtcagggagctgagggtccccacgctcaggaccaccagagctgagtgcagctccatggaggggcagcgtgagcatcacggtgcagaaggataaagccaaaggcttatcagtcatttcccgtgtgggacacagctccaagcaccttcactgcgttggctcaggtagcacgacagggagaggctgtcactattcctattccacaaatgacgagacggaggcagagggcagggacactcagggcagagctgtggtctgggagggctctgggccctggct

SEQ ID NO: 7895 - DNA, 856 bp, Homo sapiens
gcacttccgccctctcttaacatggagccggcggaaggggtggtgtagggccgggcgataatggcggcgtcgaggctggagctaaacctggtgcggctgctatcccgctgcgaggcgatggcagcggagaaacgggacccggacgagtggcgcctggagaagtacgtgggagccctagaggacatgttgcaggccctgaaggtccacgcgagcaaaccggcctctgaggtgatcaatgaatattcctggaaggtggattttctgaaggggatgctgcaagccgagaagctgacctcctcctcagagaaagcactggccaaccagttcctggcccctggccgtgtgccaaccacagccagagagcgagtgcccgccacaaagacggtgcatctgcagtcacgggcgcggtacaccagcgagatgcggagtgagctactaggcacggactctgcagagcctgagatggacgtaaggaagagaactggagtggcagggtcccagccagtgagtgagaagcagttggcagctgagctagacctcgtcctgcagcgacatcagaacctccaggaaaagctggcggaagagatgctaggactggcccggagcctcaagaccaataccctggccgcccagagtgtcatcaagaaggacaaccagaccctgtcacactcactgaaaatggcggaccagaacctggagaaactgaagacggagtcagagcgtctggagcagcacacgcagaagtcagtcaactggctgctctgggccatgctcattatcgtctgcttcatcttcattagcatgatcctcttcattcgaatcatgcctaaactcaaataaagacccccgcccacct

SEQ ID NO: 7896 - DNA, 364 bp, Homo sapiens
ccgagaggtggttacattcgttgaaggacaccagctgcggaatttgcggctttggcagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctggaaaa

SEQ ID NO: 7897 - DNA, 560 bp, Homo sapiens
ccgagaggtggttacattcgttgaaggacaccagctgcggaatttgcggctttggcagacccagctgagtcactgtcactgcctaccaatctcgaccggacctcgaccggctcgtctgtgttgccaatcgactcggcgtggcgtcggtcgtggtagataggcggtcatgcatacgaattttcagctcttgttctggtgaccttttgaatacgtcttgtctataaaagaaattcatgcctttgtaaaatacacagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctggaaaa

SEQ ID NO: 7898 - DNA, 635 bp, Homo sapiens
atcaccggccgaattaacctcttttcttctgtatgtccatagctgtttgttcccaccgagctgtgctttaggaagctggccagccgggcctcctttaggtgcgctgcagcctttttcaaagcgagtgaatgtggcccggcccctacagttcgccaggcccgctgtaaaagggttagatttcagtctatagacgatcagtgggaaggcctttcctaggaggtaaccagaacagagagctgtaaactccgtgaatgcaagaggctgcttctgttacctgagtggttctcactcatctttgccttccttacctcgtgatctcaccattccagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctggaaaa

SEQ ID NO: 7899 - DNA, 626 bp, Homo sapiens
ggacaccagctgcggaatttgcggctttggcagctgtttgttcccaccgagctgtgctttaggaagctggccagccgggcctcctttaggtgcgctgcagcctttttcaaagcgagtgaatgtggcccggcccctacagttcgccaggcccgctgtaaaagggttagatttcagtctatagacgatcagtgggaaggcctttcctaggaggtaaccagaacagagagctgtaaactccgtgaatgcaagaggctgcttctgttacctgagtggttctcactcatctttgccttccttacctcgtgatctcaccattccagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctggaaaa

SEQ ID NO: 7900 - DNA, 789 bp, Homo sapiens
cccaccgagctgtgctttaggaagctggccagccgggcctcctttaggtgcgctgcagcctttttcaaagcgagtgaatgtggcccggcccctacagttcgccaggcccgctgtaaaagggttagatttcagtctatagacgatcagtgggaaggcctttcctaggaggtaaccagaacagagagctgtaaactccgtgaatgcaagaggctgcttctgttacctgagtggttctcactcatctttgccttccttacctcgtgatctcaccattccagacccagctgagtcactgtcactgcctaccaatctcgaccggacctcgaccggctcgtctgtgttgccaatcgactcggcgtggcgtcggtcgtggtagataggcggtcatgcatacgaattttcagctcttgttctggtgaccttttgaatacgtcttgtctataaaagaaattcatgcctttgtaaaatacacagattgaaatcatggcaggtccagaaagtgatgcgcaataccagttcactggtattaaaaaatatttcaactcttatactctcacaggtagaatgaactgtgtactggccacatatggaagcattgcattgattgtcttatatttcaagttaaggtccaaaaaaactccagctgtgaaagcaacataaatggattttaaactgtctacggttcttaacctcatctgttaagttcccatgcctggagaagctaatgccaactcatcatgtgataattcaatttgtacaataaattatgaacctggaaaagctggttgt

SEQ ID NO: 7901 - DNA, 1342 bp, Homo sapiens
gacaggggagcctctggggctgcagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccatctcttgaccttgtgatccgcccgactcggcctcccaaaatgctgggattacaggcgtgagccatcaagtctggcgagagagattgtttctagatgagggtgggggcgggtgtccttagcccaaagcttgtgccagtctctatcggaaataaatgcccccaaaacctc

SEQ ID NO: 7902 - DNA, 1310 bp, Homo sapiens
tctcagggagtgtccacccagccctgagcccgtcgtgaggggtcagagatggcgctgacccccgagtccccgagcagcttccctgggctggccgccactggcagctctgtgccggagccgcctggcggccccaacgcaaccctcaacagctcctgggccagcccgaccgagcccagctccctggaggacctggtggccacgggcaccattgggactctgctgtcggccatgggcgtggtgggcgtggtgggcaacgcctacacgctggtggtcacctgccgctccctgcgtgcggtggcctccatgtacgtctacgtggtcaacctggcgctggccgacctgctgtacctgctcagcatccccttcatcgtggccacctacgtcaccaaggagtggcacttcggggacgtgggctgccgcgtgctcttcggcctggacttcctgaccatgcacgccagcatcttcacgctgaccgtcatgagcagcgagcgctacgctgcggtgctgcggccgctggacaccgtgcagcgccccaagggctaccgcaagctgctggcgctgggcacctggctgctggcgctgctgctgacgctgcccgtgatgctggccatgcggctggtgcgccggggtcccaagagcctgtgcctgcccgcctggggcccgcgcgcccaccgcgcctacctgacgctgctcttcgccaccagcatcgcggggcccgggctgctcatcgggctgctctacgcgcgcctggcccgcgcctaccgccgctcgcagcgcgcctccttcaagcgggcccggcggccgggggcgcgcgcgctgcgcctggtgctgggcatcgtgctgctcttctgggcctgcttcctgcccttctggctgtggcagctgctcgcccagtaccaccaggccccgctggcgccgcggacggcgcgcatcgtcaactacctgaccacctgcctcacctacggcaacagctgcgccaaccccttcctctacacgctgctcaccaggaactaccgcgaccacctgcgcggccgcgtgcggggcccgggcagcgggggaggccgggggcccgttccctccctgcagccccgcgcccgcttccagcgctgttcgggccgctccctgtcttcctgcagcccacagcccactgacagcctcgtgctggccccagcggccccggcccgacctgcgcccgagggtcccagggccccggcgtgagcacgcggaggggcggctggagtccaggcggggacgcgccccaaagccccagccactcccgggagcccccccaactcccaaatcacaggccc

SEQ ID NO: 7903 - DNA, 1825 bp, Homo sapiens
gggctccagcctgtgcagctcctccaacccagcttatttgaaccacaacccagaatggttaggggccagatgtgggagtgttctctgtcatgatgccctggctctggactgctccccaccagaaagagagccagaaggcggacgagtacctgcgggagatccaggagctgggccagctgacccaggccgtgcagcagtgcattgaggctgcaggacatgagcaccagccagacatgcagaagagtctgctcagggttggcctggatggccgggccggggagggtggggctgggagggggtgggatgggcagcagggaagctctctcctatcgccctctggctcttctcaggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggctctggtggctgaagctgactgccctggcagatttggaagattgggaagagctagagaagttttccaagagcaagaaatcacccattggctacctgccttttgtggagatctgcatgaaacaacataacaaatacgaagccaagaagtatgcttcccgcgtgggtcccgagcagaaggtcaaggctttgcttcttgttggcgatgtggctcaggctgcagatgtggccatcgaacaccggaatgaggctgagctgagcctcgtattgtcccactgcacgggagccacagatggggccacagctgacaagattcaacgggccagggcacaagcccagaagaagtgaggagtccatcctgtacatctcaagcaaggggttcctcccctagcacctgggcttggcagaagggccatagttcatccagctcctcccctagagcaatgctgaggagcgggggcatggtagcagggctgtctggttttaaataaagttggaacacttca

SEQ ID NO: 7904 - DNA, 2750 bp, Homo sapiens
ggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccccggggcgctgctcctggaggctcagaaggagtatgagaaagagagccagaaggcggacgagtacctgcgggagatccaggagctgggccagctgacccaggccgtgcagcagtgcattgaggctgcaggacatgagcaccagccagacatgcagaagagtctgctcagggccgcctccttcggaaagtgtttcctggacagatttccacccgacagcttcgtgcacatgtgtcaggacctgcgtgtgctcaatgctgttcgggactatcacatcgggatcccgctcacctatagccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggctctggtggctgaagctgactgccctggcagatttggaagattgggaagagctagagaagttttccaagagcaagaaatcacccattggctacctgccttttgtggagatctgcatgaaacaacataacaaatacgaagccaagaagtatgcttcccgcgtgggtcccgagcagaaggtcaaggctttgcttcttgttggcgatgtggctcaggctgcagatgtggccatcgaacaccggaatgaggctgagctgagcctcgtattgtcccactgcacgggagccacagatggggccacagctgacaagattcaacgggccagggcacaagcccagaagaagtgaggagtccatcctgtacatctcaagcaaggggttcctcccctagcacctgggcttggcagaagggccatagttcatccagctcctcccctagagcaatgctgaggagcgggggcatggtagcagggctgtctggttttaaataaagttggaacacttca

SEQ ID NO: 7905 - DNA, 2318 bp, Homo sapiens
ggaagtgccggcctggagcccgctctaggtgggtgtcccctcggtgcttcccagctgccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattgcactgctgaggaacccctggcggaaggagaaagctgctagtgtgaggccagtgctcgatatatactctgcttccggcatgcctctggccagcctgctgtggaagagtggacccgtggtgtccctgggctggtcagctgaggaggagctgctctgtgtgcaggaagatggtgctgtactggtttatgggcttcatggtgacttccggagacacttcagcatgggcaatgaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaagctgctggagtatgagccacgctcaggggagcaggtaccccttctcctaaagatgaagaggagcaaactggcactaagcaaggccatcgagagcggggacactgacctggtgttcacggtgttgctgcacctgaagaacgagctgaaccgaggagattttttcatgacccttcggaatcagcccatggccctcagtttgtaccgacagttctgtaagcatcaggagctagagacgctgaaggacctttacaatcaggatgacaatcaccaggaattgggcagcttccacatccgagccagctatgctgcagaagagcgtattgaggggcgagtagcagctctgcagacagccgccgatgccttctacaaggccaagaatgagtttgcagccaaggctacagaggatcaaatgcggctcctacggctgcagcggcgcctagaagacgagctggggggccagttcctagacctgtctctacatgacacagttaccaccctcattcttggcggtcacaacaagcgtgcagagcagctggcacgtgacttccgcatccctgacaagaggctctggtggctgaagctgactgccctggcagatttggaagattgggaagagctagagaagttttccaagagcaagaaatcacccattggctacctgccttttgtggagatctgcatgaaacaacataacaaatacgaagccaagaagtatgcttcccgcgtgggtcccgagcagaaggtcaaggctttgcttcttgttggcgatgtggctcaggctgcagatgtggccatcgaacaccggaatgaggctgagctgagcctcgtattgtcccactgcacgggagccacagatggggccacagctgacaagattcaacgggccagggcacaagcccagaagaagtgaggagtccatcctgtacatctcaagcaaggggttcctcccctagcacctgggcttggcagaagggccatagttcatccagctcctcccctagagcaatgctgaggagcgggggcatggtagcagggctgtctggttttaaataaagttggaacacttca

SEQ ID NO: 7906 - DNA, 819 bp, Homo sapiens
tctgcaccagccatggactgctacacggcgaactggaacccactcggggactctgccttttaccggaaatatgagctgtacagcatggactgggacctgaaggaggaactcagggattgcctggtggctgctgcaccctatgggggccccattggaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccagtttgtgctggatgaggactcctacctggtgcctgagctcgatggggtccgcatcttctcccgcagcacccacgagttcctgcatgaggttccagcggccagcgaggaaatcttcaaaattgcctcaatggcccc

SEQ ID NO: 7907 - DNA, 966 bp, Homo sapiens
ccgtctgcaccagccatggactgctacacggcgaactggaacccactcggggactctgccttttaccggaaatatgagctgtacagcatggactgggacctgaaggaggaactcagggattgcctggtggctgctgcaccctatgggggccccattggaagtgctccagaaccgggttctggatgcccggatctttcacactgagtttggttccggagtggccatcctcacaggggcccaccgcttcaccctcagtgccaatgtgggtgacctcaaactccgccggatgccagaggtgccaggtctgcaaagtgcaccctcctgctggactgtgctgtgccaggaccgagtggcacacattcttctggctgtggggcctgacctttacctcttggaccatgcagcctgctccgcagtgacgccccctggcctggccccaggagtaagcagcttcctacagatggctgtctccttcacctaccgacacctggcactcttcacagacacaggctacatctggatggggacagcatcactcaaggagaagctatgtgagttcaactgcaacatccgggcacctccaaagcagatggtctggtgcagccgtcctcgtagcaaggagagggccgtggtggtggcctgggaaaggcggctgatggtggtgggcgatgcacccgagagcatccaatataagcagctcaccatccaggtgctgctggacaggctcgtgttgcggagactttaccccctggccatccagatatgcgagtacttgcgccttcctgaagtacagggcgtcagcaggatcctggcccactgggcctgctacaaggtgcaacagaaggatgtctcagatgaggatgtggctcgagccattaaccagaagctgggggacacgcctggtgtctcttactccgacattgctgcacgagcctatggttgtggccgcacggagctggccatcaa

SEQ ID NO: 7908 - DNA, 3895 bp, Homo sapiens
gcccgcgtcacgggggcgggagtcagctgagctgccggggcgaggttgggatcacctggcaccggctgaagggagcctgtgatttttttgtagcgggggcggggagtaaggtgcaagactgcgccagattcaaggacgagggctgcccgattatctcgctgcataaggcaagagcaagaggatcctcaggattttaaagaggaggcgacggctgcaggttcccaggatctgtcagaggctggggagttacagcttccattctggggcgacggggaccccgggggggtagcccttttgtaatccccaggccccggacaaagagcccagaggccgggcaccatggcgtccatcctggatgagtacgagaactcgctgtcccgctcggccgtcttgcagcccggctgccctagcgtgggcatcccccactcggggtatgtgaatgcccagctggagaaggaagtgcccatcttcacaaagcagcgcattgacttcaccccttccgagcgcattaccagtcttgtcgtctccagcaatcagctgtgcatgagcctgggcaaggatacactgctccgcattgacttgggcaaggcaaatgagcccaaccacgtggagctgggacgtaaggatgacgcaaaagttcacaagatgttccttgaccatactggctctcacctgctgattgccctgagcagcacggaggtcctctacgtgaaccgaaatggacagaaggtacggccactagcacgctggaaggggcagctggtggagagtgtgggttggaacaaggcactgggcacggagagcagcacaggccccatcctggtcgggactgcccaaggccacatctttgaagcagagctctcagccagcgaaggtgggcttttcggccctgctccggatctctacttccgcccattgtacgtgctaaatgaagaagggggtccagcacctgtgtgctcccttgaggccgagcggggccctgatgggcgtagctttgttattgccaccactcggcagcgcctcttccagttcataggccgagcagcagagggggctgaggcccagggtttctcagggctctttgcagcttacacggaccacccacccccattccgtgagtttcccagcaacctgggctacagtgagttggccttctacacccccaagctgcgctccgcaccccgggccttcgcctggatgatgggggatggtgtgttgtatggggcattggactgtgggcgccctgactctctgctgagcgaggagcgagtctgggagtacccagagggggtagggcctggggccagcccacccctagccatcgtcttgacccagttccacttcctgctgctactggcagaccgggtggaggcagtgtgcacactgaccgggcaggtggtgctgcgggatcacttcctggagaaatttgggccgctgaagcacatggtgaaggactcctccacaggccagctgtgggcctacactgagcgggctgtcttccgctaccacgtgcaacgggaggcccgagatgtctggcgcacctatctggacatgaaccgcttcgatctggccaaagagtattgtcgagagcggcccgactgcctggacacggtcctggcccgggaggccgatttctgctttcgccagcgtcgctacctggagagcgcacgctgctatgccctgacccagagctactttgaggagattgccctcaagttcctggaggcccgacaggaggaggctctggctgagttcctgcagcgaaaactggccagtttgaagccagccgaacgtacccaggccacactgctgaccacctggctgacagagctctacctgagccggcttggggctctgcagggcgacccagaggccctgactctctaccgagaaaccaaggaatgctttcgaaccttcctcagcagcccccgccacaaagagtggctctttgccagccgggcctctatccatgagctgctcgccagtcatggggacacagaacacatggtgtactttgcagtgatcatgcaggactatgagcgggtggtggcttaccactgtcagcacgaggcctacgaggaggccctggccgtgctcgcccgccaccgtgacccccagctcttctacaagttctcacccatcctcatccgtcacatcccccgccagcttgtagatgcctggattgagatgggcagccggctggatgctcgtcagctcattcctgccctggtgaactacagccagggtggtgaggtccagcaggtgagccaggccatccgctacatggagttctgcgtgaacgtgctgggggagactgagcaggccatccacaactacctgctgtcactgtatgcccgtggccggccggactcactactggcctatctggagcaggctggggccagcccccaccgggtgcattacgacctcaagtatgcgctgcggctctgcgccgagcatggccaccaccgcgcttgtgtccatgtctacaaggtcctagagctgtatgaggaggccgtggacctggccctgcaggtggatgtggacctggccaagcagtgtgcagacctgcctgaggaggatgaggaattgcgcaagaagctgtggctgaagatcgcacggcacgtggtgcaggaagaggaagatgtacagacagccatggcttgcctggctagctgccccttgctcaagattgaggatgtgctgcccttctttcctgatttcgtcaccatcgaccacttcaaggaggcgatctgcagctcacttaaggcctacaaccaccacatccaggagctgcagcgggagatggaagaggctacagccagtgcccagcgcatccggcgagacctgcaggagctgcggggccgctacggcactgtggagccccaggacaaatgtgccacctgcgacttccccctgctcaaccgccctttttacctcttcctctgtggccatatgttccatgctgactgcctgctgcaggctgtgcgacctggcctgccagcctacaagcaggcccggctggaggagctgcagaggaagctgggggctgctccacccccagccaagggctctgcccgggccaaggaggccgagggtggggctgccacggcagggcccagccgggaacagctcaaggctgacctggatgagttggtggccgctgagtgtgtgtactgtggggagctgatgatccgctctatcgaccggccgttcatcgacccccagcgctacgaggaggagcagctcagttggctgtaggagggtgtcacctttgatggggggtgggcaatggggagcagtggcttgaacccacttgagaaggctgcctcctaggctctgctcagtcatcttgcaattgccacactgtgaccacgttgacgggagtagagtagcgctgttggccaggaggtgtcaggtgtgagtgtattctgccagcttttcatgctgttcttcagagctgcagttatgccagaccatcagcctgcctcccagtagaggcccttcacctggagaagtcagaaatctgacccaattccaccccctgcctctagcacctcttctgtccctgtcattccccacacacgtcctgttcacctcgagagagagagagagagagcacctttcttccgtctgttcactctgcggcctctggaatcccagctcttctctctcagaagaagccttctcttcctcctgcctgtaggtgtcccagaagtgagaaggcagccttcgaagtcctgggcattgggtgagaaagtgatgctagttggggcatgcttttgtgcacactctctggggctccagtgtgaagggtgccctggggctgagggccttgtggaggatggtcggtggtggtgatggaggtggagagcattaaactgtctgcactgca

SEQ ID NO: 7909 - DNA, 1100 bp, Homo sapiens
gaggagcctgaggaagagggcggcgacggtggtggtgactgagcggagcccggtgacaggatggctgggcacagattggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactctggctggtgatgttcatattgtgagaggagacttcgatgagaatctgaattatccagaacagaaagttgtgactgttggacagttcaaaattggtctgatccatggacatcaagttattccatggggagatatggccagcttagccctgttgcagaggcaatttgatgtggacattcttatctcgggacacacacacaaatttgaagcatttgagcatgaaaataaattctacattaatccaggttctgccactggggcatataatgccttggaaacaaacattattccatcatttgtgttgatggatatccaggcttctacagtggtcacctatgtgtatcagctaattggagatgatgtgaaagtagaacgaatcgaatacaaaaaaccttaaagccaggcctgtcttgatgatttttggttttttttcattgtcctgttgaaatcaagtaattaaacatttaagagccacaaaattgtatcacttttataatattttgcagtaaaatataataccatcttctctgttaatacataattgctccaagcttcctgtaaactataagaatatatttagtttacagtatatggattctatgaaaaaatgtccacaacacagtaattggtcacttgttaagaaaaatttatccttgtaagtatcttcaaagttgatatttggaactttattccaaaagtagtgcatgtggagaaagaatctagactttcttgtatacatttttctcttctccagtaataaacaattacctttcatttatactttgataacctgtatttaatttaaaaaaaaacataaaaatgaggaaccaagtgaaactacggatataaatattaaagtggacgagatgacctttc

SEQ ID NO: 7910 - DNA, 996 bp, Homo sapiens
ggtgactgagcggagcccggtgacaggatgaaggaatccccctctaaaatgaagattgttctatatccagttggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactctggctggtgatgttcatattgtgagaggagacttcgatgagaatctgaattatccagaacagaaagttgtgactgttggacagttcaaaattggtctgatccatggacatcaagttattccatggggagatatggccagcttagccctgttgcagaggcaatttgatgtggacattcttatctcgggacacacacacaaatttgaagcatttgagcatgaaaataaattctacattaatccaggttctgccactggggcatataatgccttggaaacaaacattattccatcatttgtgttgatggatatccaggcttctacagtggtcacctatgtgtatcagctaattggagatgatgtgaaagtagaacgaatcgaatacaaaaaaccttaaagccaggcctgtcttgatgatttttggttttttttcattgtcctgttgaaatcaagtaattaaacatttaagagccacaaaattgtatcacttttataatattttgcagtaaaatataataccatcttctctgttaatacataattgctccaagcttcctgtaaactataagaatatatttagtttacagtatatggattctatgaaaaaatgtccacaacacagtaattggtcacttgttaagaaaaatttatccttgtaagtatcttcaaagttgatatttggaactttattccaaaagtagtgcatgtggagaaagaatctagactttcttgtatacatttttctcttctccagtaataaacaattacctttcattt

SEQ ID NO: 7911 - DNA, 1523 bp, Homo sapiens
gtcgccgaggagcctgaggaagagggcggcgacggtggtggtgactgagcggagcccggtgacaggatgttggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactctggctggtgatgttcatattgtgagaggagacttcgatgagaatctgaattatccagaacagaaagttgtgactgttggacagttcaaaattggtctgatccatggacatcaagttattccatggggagatatggccagcttagccctgttgcagaggcaatttgatgtggacattcttatctcgggacacacacacaaatttgaagcatttgagcatgaaaataaattctacattaatccaggttctgccactggggcatataatgccttggaaacaaacattattccatcatttgtgttgatggatatccaggcttctacagtggtcacctatgtgtatcagctaattggagatgatgtgaaagtagaacgaatcgaatacaaaaaaccttaaagccaggcctgtcttgatgatttttggttttttttcattgtcctgttgaaatcaagtaattaaacatttaagagccacaaaattgtatcacttttataatattttgcagtaaaatataataccatcttctctgttaatacataattgctccaagcttcctgtaaactataagaatatatttagtttacagtatatggattctatgaaaaaatgtccacaacacagtaattggtcacttgttaagaaaaatttatccttgtaagtatcttcaaagttgatatttggaactttattccaaaagtagtgcatgtggagaaagaatctagactttcttgtatacatttttctcttctccagtaataaacaattacctttcatttatactttgataacctgtatttaatttaaaaaaaaacataaaaatgaggaaccaagtgaaactacggatataaatattaaagtggacgagatgacctttcagagctcttctcttacattgtgtcataatgttggactcagattttatttgctaaataatataccatgccgacattaacagtgattcttcaaactgttgctatttccatttttcaaggtttaataaaagttttaaaaatacaagtttaggggccgggcacagtggctcacaccctaatcccaacactttgggaggctgaggcaggtggatcacctgaggtcaggagttcaagaccagcctggccaacatggtgaaaccctgtctgtactaaaaatacaaaattagccagcatggtgctacatgcctgtattcccagctactcgggaggctgaggcagtagaatcacttgaatcctggagttggaggttgcagtgagccgagatcacaccattgcactccagcctggtcaacaagagcataactccgtctc

SEQ ID NO: 7912 - DNA, 2960 bp, Homo sapiens
agcgaaggttccggggctagtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcagagtgatttcttttctgtagctttttgacctaagatctcagcaatttgaacactaacctctcccctcctggctcaagaattactccgaagtcagtctgcagaaaataaatatttagtatgacatgacactta

SEQ ID NO: 7913 - DNA, 2687 bp, Homo sapiens
tttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggaactggtgttgcgggctgggacctcagatatggaggaggaagagggcccgctggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttg

SEQ ID NO: 7914 - DNA, 2960 bp, Homo sapiens
agcgaaggttccggggctagtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgttgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgacactta

SEQ ID NO: 7915 - DNA, 2355 bp, Homo sapiens
cggtgcgcctttctttacagttcgtaaggttcataggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttcc

SEQ ID NO: 7916 - DNA, 2960 bp, Homo sapiens
agcgaaggttccggggctagtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtgttgcgggctgggacctcagatatggaggaggaagagggcccgctggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgctgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttggaattgctggcaaggggtgactgcctctgagtcattgtgtttttcaaagtgatttcttttctgtagctttttgacctaagatctcagcaatttgaacactaacctctcccctcctggctcaagaattactccgaagtcagtctgcagaaaataaatatttagtatgacatgacactta

SEQ ID NO: 7917 - DNA, 2960 bp, Homo sapiens; identical to SEQ ID NO: 7914

SEQ ID NO: 7918 - DNA, 2960 bp, Homo sapiens; identical to SEQ ID NO: 7916

SEQ ID NO: 7919 - DNA, 2960 bp, Homo sapiens; identical to SEQ ID NO: 7916

SEQ ID NO: 7920 - DNA, 2687 bp, Homo sapiens
tttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggaactggtgttgcgggctgggacctcagatatggaggaggaagagggcccgctggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgttgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttccaaaatggcctttatcatttctccagtctgtcaccctcctttcctgctcccatacacccaaggcttgtttcttcccctgtaaaaaccactgcctcaatctctggttcactcaactagtcaccatgtcctgaggcatgaagcctcctcagctcttg

SEQ ID NO: 7921 - DNA, 2687 bp, Homo sapiens; identical to SEQ ID NO: 7913

SEQ ID NO: 7922 - DNA, 2355 bp, Homo sapiens
cggtgcgcctttctttacagttcgtaaggttcataggcgggtggtcctgggctccaggaaccactgcaacttggggagttggatatcacttctgatgaattcatcctggatgaagtggatgttcacattcaggcaaatctggaggatgagttagtaaaggaagctcttaaaacgggtgtagatctccgtcactattcaaagcaagttgagctggagctacagcagattgaacagaaatccattcgggattatattcaagagagtgagaatatagcatctctacacaaccagatcacagcctgtgatgctgtcctggagcgaatggagcagatgttgggagcttttcagagtgacctcagctccatcagctctgagatccggacactgcaggaacagtcaggagccatgaacattcgacttcgaaatcgccaggcagttcgggggaaacttggggagcttgttgatggtctggtggtgccttctgctctggtcacggcaattctggaggctccagtgacagagcccaggttcttggagcagctacaggagctggatgccaaggcagccgcagtcagagagcaggaagctagaggcacagcagcctgcgcagatgtcagaggcgtgctcgatcggctccgggtcaaggcagtgacgaagatccgagagtttatcctccagaagatttattccttcaggaaacccatgaccaactatcagatcccccagacggccctgctgaagtacaggttcttctatcagtttctgttgggcaatgaacgagcaacagcaaaggagatcagggatgaatatgtggagacgctgagcaagatttacctgtcttactaccgctcttacctggggcggctcatgaaggtgcagtatgaggaagtcgctgagaaagatgatctaatgggtgtggaagatacagcaaagaaaggattcttctcaaagccatcgctccgcagcaggaacaccattttcaccctaggaacccgcggctctgtcatctcccccactgaacttgaggcccccatcctggtgcctcacacagcgcagcgcggagagcagaggtatccatttgaggccctcttccgcagccagcactacgccctcctagacaattcctgccgcgaataccttttcatctgtgaattttttgttgtgtctggcccagctgcacacgacctgttccatgctgtcatgggccgtacactcagcatgaccctgaaacacctggattcttatctagctgactgctacgatgccattgctgtttttctctgtatccacattgttctccggttccgtaacattgcagcaaagagggatgttcctgccctggacaggtactgggaacaggtgcttgccttgctatggccacggtttgaactgatcctggagatgaatgttcagagcgtccgaagcactgacccccagcgcctaggggggttggatactcggccccactatatcacacgccgctatgcagagttctcctccgctcttgtcagtatcaaccagacaattcctaatgaacggaccatgcaattgctgggacagctgcaggtggaggtggagaattttgtcctccgagtggcagctgagttctcctcaaggaaggagcagcttgtgtttctgatcaacaactatgacatgatgctgggtgtgctgatggagcgggctgcagatgacagcaaagaggttgagagcttccagcagctgctcaatgctcggacacaggaattcattgaagagttgctgtctcccccttttgggggtttagtggcatttgtgaaggaggctgaggctttgattgagcgtggacaggctgagcgacttcgaggggaagaagcccgggtaactcagctgatccgtggctttggtagttcctggaaatcatcagtggaatctctgagtcaggatgtaatgcggagtttcaccaacttcagaaatggcaccagtatcattcagggagcgctgacccagctgatccagctctatcatcgcttccaccgggtgctgtcccagccgcagctccgagccctccctgcccgggctgagctcatcaacattcaccaccttatggtggagctcaagaagcataagcccaacttctgatgtgccagaaaccgccctgagatctgccggtcatctccatggacttctgcaccccattccatacccttcttcacctggggtaccccttccagttttccccttgcttcccaggcccttgacatggcttacctgccttcactcccagcaccttgcccaacaggataagctggatccccttggccttctgaatatcccagtgtcttcaggtttcccaagaccacttccctgtgggcttcc

SEQ ID NO: 7923 - DNA, 2355 bp, Homo sapiens; identical to SEQ ID NO: 7915

SEQ ID NO: 7924 - DNA, 2866 bp, Homo sapiens
ggcggcggcggcaggaccgagcgcggcaggcggctggcccagcgcacgcagcgcggcccgaagacgggagcaggcggccgagcaccgagcgctgggcaccgggcaccgagcggcggcggcacgcgaggcccggccccgagcagcgcccccgcccgccgcggcctccagcccggccccgcccagcgccggcccgcggggatgcggagcggcgggcgccggaggccgcggcccggctaggcccgcgctcgcgcccggacgcggcggcccggggcttagggaaggccgagccagcctgggtcaaagaagtcaaaggggctgcctggaggaggcagcctgtcagctggtgcatcagaggctgtggccaggccagctgggctcggggagcgccagcctgagaggagcgcgtgagcgtcgcgggagcctcgggcaccatgagcgacgtggctattgtgaaggagggttggctgcacaaacgaggggagtacatcaagacctggcggccacgctacttcctcctcaagaatgatggcaccttcattggctacaaggagcggccgcaggatgtggaccaacgtgaggctcccctcaacaacttctctgtggcgcagtgccagctgatgaagacggagcggccccggcccaacaccttcatcatccgctgcctgcagtggaccactgtcatcgaacgcaccttccatgtggagactcctgaggagcgggaggagtggacaaccgccatccagactgtggctgacggcctcaagaagcaggaggaggaggagatggacttccggtcgggctcacccagtgacaactcaggggctgaagagatggaggtgtccctggccaagcccaagcaccgcgtgaccatgaacgagtttgagtacctgaagctgctgggcaagggcactttcggcaaggtgatcctggtgaaggagaaggccacaggccgctactacgccatgaagatcctcaagaaggaagtcatcgtggccaaggacgaggtggcccacacactcaccgagaaccgcgtcctgcagaactccaggcaccccttcctcacagccctgaagtactctttccagacccacgaccgcctctgctttgtcatggagtacgccaacgggggcgagctgttcttccacctgtcccgggagcgtgtgttctccgaggaccgggcccgcttctatggcgctgagattgtgtcagccctggactacctgcactcggagaagaacgtggtgtaccgggacctcaagctggagaacctcatgctggacaaggacgggcacattaagatcacagacttcgggctgtgcaaggaggggatcaaggacggtgccaccatgaagaccttttgcggcacacctgagtacctggcccccgaggtgctggaggacaatgactacggccgtgcagtggactggtgggggctgggcgtggtcatgtacgagatgatgtgcggtcgcctgcccttctacaaccaggaccatgagaagctttttgagctcatcctcatggaggagatccgcttcccgcgcacgcttggtcccgaggccaagtccttgctttcagggctgctcaagaaggaccccaagcagaggcttggcgggggctccgaggacgccaaggagatcatgcagcatcgcttctttgccggtatcgtgtggcagcacgtgtacgagaagaagctcagcccacccttcaagccccaggtcacgtcggagactgacaccaggtattttgatgaggagttcacggcccagatgatcaccatcacaccacctgaccaagatgacagcatggagtgtgtggacagcgagcgcaggccccacttcccccagttctcctactcggccagcggcacggcctgaggcggcggtggactgcgctggacgatagcttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaa

SEQ ID NO: 7925 - DNA, 4073 bp, Homo sapiens
gccagctgctgcgcatgcgccggccggggccccgcccccatgcgccgcgcggctccagggccacgttccagggtcgggtttggtggattcctcagtccctgccgccgcggggcgccctgggatagcggcggggcctcctggtgagcgcgcgccggggcggcctccgggaagtgggagacgctgcgggtcctgggcccaggccttgggatgggcgggaaggcttggccgcgccgggctgtgggcactgcaggaggcccctgtgcaggtggagatcgccgcggccctggcgggactccttgctggctcttgggcgcgctgatgcccatcatctccctgagtttctgagccctatctctcatgtgtcagtggtcaccgccgaatccagacactccggccctgttccggaagagccctgatatccgtggctccatggtgctgtctgtcgataccatgcactctagctctcaaggaggaaaggttttgtggaagggaatagagacttggaataacagacctgtgctaattagagacaggaaagatggaacaaggggagtgacccttctccacccccatatcctaatgtgctctctctctatccagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggctgcagggtcttcaccggtttgtggcccgggaaaagataatgtctgtgctgagtgaatggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccagcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatcccaaa

SEQ ID NO: 7926 - DNA, 460 bp, Homo sapiens
acgctgcgggtcctgggcccaggccttgggatgggcgggaaggcttggccgcgccgggctgtgggcactgcaggaggcccctgtgcagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccg

SEQ ID NO: 7927 - DNA, 1103 bp, Homo sapiens
cgcggctccagggccacgttccagggtcgggtttggtggattcctcagtccctgccgccgcggggcgccctgggatagcggcggggcctcctgaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatgga

SEQ ID NO: 7928 - DNA, 1029 bp, Homo sapiens
gttccagggtcgggtttggtggattcctcagtccctgccgccgcggggcgccctgggatagcggcggggcctcctgaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctg

SEQ ID NO: 7929 - DNA, 3377 bp, Homo sapiens
gccagctgctgcgcatgcgccggccggggccccgcccccatgcgccgcgcggctccagggccacgttccagggtcgggtttggtggattcctcagtccctgccgccgcggggcgccctgggatagcggcggggcctcctgtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggctgcagggtcttcaccggtttgtggcccgggaaaagataatgtctgtgctgagtgaatggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccagcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccc

SEQ ID NO: 7930 - DNA, 3609 bp, Homo sapiens
ggcggggcctcctggtgagcgcgcgccggggcggcctccgggaagtgggagacgctgcgggtcctgggcccaggccttgggatgggcgggaaggcttggccgcgccgggctgtgggcactgcaggaggcccctgtgcagaacagatctcggcccctttccaaacactcctgatgcctcatttgcctctcgcctcttttcgaccaccattttgggggctgaggcactcacggggcctccccaggtttcactccgtttctacacagtcggagccccatggatctcccatctcccggaggaaccgtgaagccaaacagaagcgcctgcgagagaagcaggcgactctggaggctgagatagcaggggagagcaagtcacctgcagaatccattaaggcctggaggcctaaggagttagtattgtatgaaatccctacgaaacccggtgaaaagaaagatgtctctgggcccctgcctcctgcatacagcccccgatatgttgaggctgcctggtacccgtggtgggtacgagagggcttcttcaaaccagaatatcaggcccggctgccccaagctacaggggagaccttttccatgtgtatcccacctcccaatgtcactggctccctgcacattggccacgcactcacggtggccatacaggatgccctcgtgcgctggcaccggatgcgtggggatcaagtgctgtgggtccctggttcagatcatgcaggaattgctacacaagctgtggtggagaaacaactgtggaaggaacggggagtgaggagacatgagctgagccgggaggccttccttagggaggtgtggcagtggaaggaggcgaaaggtggagagatctgtgagcagctgcgagctctgggtgcctccctggactgggatcgagagtgttttaccatggatgttggctcctcagtggctgtgactgaagcttttgtgcggctctacaaggcggggttgctgtaccggaaccatcagcttgtcaactggtcatgtgctttaagatcagccatctcggacattgaggtggagaaccggcccctgcctggccacacacagcttcgactgcctggctgccccacccccgtgtcttttggcctcctattttctgttgccttccccgtggatggagagcctgatgcagaggttgtggtaggaaccacaaggccagagacgctgcctggagatgtggctgtggccgttcatccagacgactcgcgatacacacatctacacgggcgacagcttcgtcaccccttgatggggcagcctcttcccctcatcacagactatgctgttcagccacatgtgggcacgggggcagtgaaggtgactccagctcacagtcctgccgatgctgagatgggggcccgacatggcttgagccccttgaatgtcattgcggaggatgggaccatgacctccctctgcggggactggctgcagggtcttcaccggtttgtggcccgggaaaagataatgtctgtgctgagtgaatggggcctgttccggggcctccagaaccaccccatggtactgcccatctgcagccgttctggggatgtgatagaatacctgctgaagaaccagtggtttgtccgctgccaggaaatgggggcccgagctgccaaggctgtggagtcgggggccctggagctcagtccctccttccaccagaagaactggcagcactggttttcccatattggggactggtgtgtctcccggcagctgtggtggggccatcagattccagcctacctggttgtagaggaccatgcgcagggagaagaggactgttgggtggttgggcggtcagaggctgaggccagagaggtagcagcggaactgacagggaggccaggggcagagctgaccctggagagggatcctgatgtcctagacacatggttttcttctgccctgttccccttttctgccctgggctggccccaagagaccccagaccttgctcgtttctaccccctgtcacttttggaaacgggcagcgaccttctgctgttctgggtgggccgcatggtcatgttggggacccagctcacagggcagctgcccttcagcaaggtgcttcttcatcccatggttcgggacaggcagggccggaagatgagcaagtccctggggaatgtgctggacccaagagacatcatcagtggggtggagatgcaggtgctgcaggaaaagctgagaagcggaaatttggaccctgcagagctggccattgtggctgcagcacagaaaaaggactttcctcacgggatccctgagtgtgggacagatgccctgagattcacactctgctcccatggagttcaggcgggcgacttgcacctgtcagtctctgaggtccagagctgccgacatttctgcaacaagatctggaatgctcttcgctttatcctcaatgctttaggggagaaatttgtgccacagcctgctgaggagctgtctccctcctccccgatggatgcctggatcctgagccgccttgccctggctgcccaggagtgtgagcggggcttcctcacccgagagctctcgctcgtcactcatgccctgcaccacttctggcttcacaacctctgtgacgtctacctggaggctgtgaagcccgtgctgtggcactcgccccgccccctggggccccctcaggtcctgttctcctgcgctgacctcggcctccgcctcctggccccactgatgcccttcctggctgaagagctctggcagaggctgccccccaggcctggttgcccccctgcccccagcatctcggttgccccctaccccagcgcctgcagcttggagcactggcgccagccagagctggagcggcgcttctcccgggtccaagaggtcgtgcaggtgctaagggctctccgagccacgtaccagctcaccaaagcccggccccgagtgctgctgcagagctcagagcctggggaccagggcctcttcgaggccttcttggagcccctgggcaccctgggctactgtggggctgtgggcctgttacccccaggcgcagcagctccctccggctgggcccaggctccactcagtgacacggctcaagtctacatggagctgcagggcctggtggacccgcagatccagctacctctgttagccgcccgaaggtacaagttgcagaagcagcttgatagcctcacagccaggaccccatcagaaggggaggcagggactcagaggcaacaaaagctttcttccctccagctggaattgtcaaaactggacaaggcagcctctcacctccagcagctgatggatgagcctccagccccagggagcccggagctctaactcatcatccccatcagttttcctccctctcagacctgtctttgaggacaaacagatttgtcagctgtcagggtgcagtgggacgtcagagactatgtggtccatcgccttcattgtgtaaatgaggacacagactggcttggtcgcagtgactgtggtgtccttgagatgctcacattactgcccggcctgcctcccacctggaagtctgggaatgaggagattgagataaacttttgaaatccc

SEQ ID NO: 7931 - DNA, 5351 bp, Homo sapiens
ccctttcgctgcggcctttccccaacccggacccggcacttctcgggttccgcgactgccgatcgccccggcgcggcaccgctccctcaggagtcgcctaggccgcgcagtctcccgacttctcgtcaggctttcgcgccggcgctccagcaatcactggctggagaaggtgggcgttccggctcgagaggaccctgccgcggctccggaagagcctcgtcctgggcggcggtggtgcggcggtcgccgttatggccactgggctgggcggctgaccgccgggctaggaaagggcccagggccccgaatctcggtggccgctgctccagcgcggcctgcgccatggcctcctccgccgcctcctcggagcatttcgagaagctgcacgagatcttccgcggcctccatgaagacctacaaggggtgcccgagcggctgctggggacggcggggaccgaagaaaagaagaaattgatcagggattttgatgaaaagcaacaggaagcaaatgaaacgctggcagagatggaggaggagctacgttatgcacccctgtctttccgaaaccccatgatgtctaagcttcgaaactaccggaaggaccttgctaaactccatcgggaggtgagaagcacacctttgacagccacacctggaggccgaggagacatgaaatatggcatatatgctgtagagaatgagcatatgaatcggctacagtctcaaagggcaatgcttctgcagggcactgaaagcctgaaccgggccacccaaagtattgaacgttctcatcggattgccacagagactgaccagattggctcagaaatcatagaagagctgggggaacaacgagaccagttagaacgtaccaagagtagactggtaaacacaagtgaaaacttgagcaaaagtcggaagattctccgttcaatgtccagaaaagtgacaaccaacaagctgctgctttccattatcatcttactggagctcgccatcctgggaggcctggtttactacaaattctttcgcagccattgaacttctatagggaagggtttgtggaccagaactttgaccttgtgaatgcatgatgttagggatgtggatagaataagcatattgctgctgtgggctgacagttcaaggatgcactgtatagccaggctgtgggaggagggaggaaagatgaaaaaccacttaaatgtgaaggaacaacagcaacaagaccagtatgatataccaaggtaataaatgctgtttatgacttctttaaatttacatagtactgtagcatattaataccctgtgaactgcaaaaaaccaaatacatttacagtagtattggtcaccaaaatagaggggaaactttacaattgtgagaatgtgtaaatgttctcattaaggcagtattgacccagacaaccatttagtattcatctatcccctcaatgcctcataattctggaatgcctgttgtgaaacatgtcagtgcacagtgtctcctaaattctcacacgtgcttgattttctgattcatctggtgaactgggagtaggaagttggtcatagacaatatgccctccttctcttgtctgaccaaagcttgaagcaatcacatctactgccaggttagctgtagtcttcgcctcttcctctgaggtggccaactgaggattgacttcaacaagatccagtgctgatagcaaccctggaagaacaaagtgtgacaaaacctcaggttcccttgctgctactctcagtgagggtcatcccactgggacagggagaacaagccaaagtaaaaacaagagtccattttatagtagaaaatacctatttttaggaagccccttgcacctcatcctcttggccatgaatttaagttaaaacactgttgtgctatagtagattaaaagaaaccttttaagataatgaaataaaccatccctgttcaactaacataacaggcataattgtcaggcgttctggaaaaggaaaaggcttggtgttgggtgggggaggttttcatcctgcttgttggcaaaatgtatgccacctccagtatgactaggaaccttccagatgcctgcctggaaatgaatcaagtatgaaggcagaggaaatctgccacttgcactagccaaactgcattcccacttttgaactctaatgtgttatctgtatctgttagagcaccacaccatatgccctgaaatgtagttattactgcaaacttcattctcacccctgcaggcctgagctctggaggcaggttccacatctaacaacatctttttgtctcccagcagactgacccagtgtcttgtacttgatcaagagaaaattcagccatatgttaattattttatctggacttcagttaccttctgttaaggtttgagaacttgtgtcaaagttctcggtagtgttcctttggcctggagcaagtggaagggaagcttaaaccagaagaacctatccagacctgctactatgctcacccctctaaatgcctcacttctctatagaatttaactttttagttggttattctggatgaagggtgatctgaacaagctagtattcaggaatacaagtatctaagaatatttagggtggccataaagtctggaaacacaggcaaatgtacctaatggtttattgatattacactatagtacatgatgtgctgaatgccatcatgtccgttcagcatcttcccttattagcaatgcatagttgagtgtacagtgccaaactgcaaccaacaggtgtattactgtagcatttccatcatttcctgcacatggacctgtgttcctgatttgtctctgatttccactgactaaacctgcacctttagcatatcccagaagtggtcatcaaagtttgcactattagaaatatatacatgacttatgtttccagactattgccaccctataaattaagcaaactgctttatgtatctagttgacagcattataacagtgcagtggcacaatcatggctcactgcagcctcaacctcccaagtagttgggacacctggctaattattttttgtagaaacggggtcacactatgttgcccacgctggtcttgaacccctggggtcaagtaatcctcttgccttggcctcccagagtactgggattataggtatgaaccactgtgcctagccccatgagtgtcttttggagtaaaatattgtagcataggaacaaagagacaagccatgccatatataagtgctagaggttattaacccctgctctaagtggtgtttttaggaagcaaagcagagaattgaacccccaagttctctggccaataacctaaggaccactggcaacatctaagattgcagatctgagaattagaccagtactgcctgcctttttgtactgcctaaggttctggcaggctgtggcgctaaggagaccatttctcaatgtgagtttctatcccagctagtcaagggttctctatagccctgaacctttcaatctggggtctctatctataccctagttccatcagatggttactgaagcagtatgatttggtagttctttaaattttggaatgaaaggtcatttgaagtagctttaaaaccagaagctttctgacagaaatggaaactgtttgcaaacaagtatgagttttggaaaagtagccagtcttgataacgtagaattcatcttagtactctttccatcagccattctcatctaactgtatcccccttattagaaatcctttcaggctctagtacaagacctaccctacataaaggacccaagatattgtccagtttgcagatttcttcaagagatcagctttagctccaaattcacaactcccaatgaaccaatctcttagagtgcaaattacagccttgcactcttatcttatcttgccttcttatcttaatctgcctttagataactcaaagaactgcatcagtttgacaatttattcttgtatttaattgtttaaatatacaattttttactcattattaccttagtgtaatttggtaagagccatgtccaagcatgactctaaaggactatatcctttttattagcatggccatataatttttagctacaaaagtttaagcaaaaacaaactctgcaatgatgtggaatagcagaaaagatcctttgcaggcaagagactctagcatatttacctatgtagttaacaggctgcagacctggttgctacatacctgtattgtgtatttcctcagcaatatacatgccttctcgataggttagtcccccgacaacaggagttcctgtggctggagccagtgtagggtcaaatgcatcaatatcaaaactcaaatggattggtctttgtctcctaaaaaggaagaggataaaataatacttaaaataatacttaactggttgtccttggacactcatccttcttatggttgcaactccttgattttgttgctattagtcctagtactttgttaataaagctgttaatacatttccaggcttcctattcttggaagttactgagattggcaatattaacttcctacataccacttcatgatactgccatttgttctgcatacctcagacagactaactccaatgtatatttctgccttacactgggtattagaacctcttatactaataactgtcaatagagagatttcttcacttctagatgagattgggctctcatctagagacaatttaattagacaatttaaattagtctaatttaaattggcttgatgtaagttatggttgctcttattctctgaacgtaacagcagctgaagtgaactctaattttaggtctgcagttttaacatcttccatttctaacttcattatagccccagtgtccaaaggctgaagctaacaactaagtttcttaacagcttatgaaatgacatactaccagataacaattctgacattaatcacccagaagtaaagacttggtattgggaaaatgctcttaaaattaccatttgattagtattcatctgccatctttctacactgccaagatttgcttaatataaaactcagatgaaacaatcgtgaggctgggaagaatgggacagttgaaacaataaatgcttgtcatctcagaagataagcattaaagatggagataaagaaaaattcatgagacagaagatctaggcaatgatttagaggaaacctcctcccaaaaaccccagaggaagaatatgacctgtgtttcaaattttgcctttctgaactatttaaaattatgtgtatgtttttgctttgtattttaaaagtaaagctgctgtcctcaagaaacaggctaaaa

SEQ ID NO: 7932 - DNA, 5159 bp, Homo sapiens
gacaaccagtggttgttcctcccctaaagcacagcataaatttggagagatgcatctaaactgcgtgtgggttcgggctcttttaggtgaatagggctcggcggatcgacttcctcgattatctccgtgccctggacccgccccctccgcctggcgccaggccgccgagcgccgatcggctcgatgagcggaggcgctgctgcggcgctgcggccgacgccgggtccgcaccaactgtctccccctcccagcttcttacctcggcttcctactccttcccccgcccgcccagcaccgccagcccgggagagctgccgggagttccccgggagcctcaggtggtgactatcctgttgagaagcaaaagatactttgcaagtaaaaaatatgcctcccaagtttaagcgccacctcaatgatgatgatgtcacaggttctgtgaaaagtgaaaggagaaatcttttggaagatgattcagatgaagaagaggacttttttctaaggggaccatctggaccaagatttggacctagaaatgataaaattaagcatgttcagaatcaagtggatgaagttattgatgtcatgcaagaaaatattacaaaggtaattgagagaggggagagactagatgaactacaggacaaatcagaaagcttatcggataatgcaacagcttttagcaacagatccaaacaacttcgaaggcaaatgtggtggcgtggatgcaaaataaaagccatcatggctttggttgctgctatccttttgctagtgattatcattcttatagtcatgaaataccgtacttgatttgatgacagagatcttcattaaacaagatctgggacagtaataaaagattgctgcataatttaaatgaaacctatgtgtatataactttcaaaacttctttttcaagaaactaagaggcaagtatcacttcaaattggaacgttgagaatgtccaattatcttctccctttctaacaaaatgttcttttaataattatgtttaaggcaaagagaactagcctctatttttccatatttcaaggatctaatttgaaactagatacttgccagttcattatttgtgtatataaacactgattataatatttcatattaatattttaatggcataaggacttgcattattgcattagggagcgggtcatgctgggggtcaggaagcctgtgtagagtaccaaattatatgctgaaagagatgcataaccattctgtcaatatttgcagaaatatagttcctttcatattacagttgttttgcaagcaatttccacatttataggtgtaacaaaagctaaatgttgtaaatgttgttgccctcaggtataactaaaaacattccagtaaatatatttttgactgtgtaagagaatgtgtagtaatttttttggcattggattatggaaatggaaatttttaaacagtgtgaaaaaacatggtatggcatcataaaactggagataataaagttattgaagagtgtcattggagtatttgaaaatgaccaatatatagctgccagtcatggtccagtctgttttctgttaaactccaataaagagagaccagtcagtcctaatgtgagtaaatgaaatttacaggtaacttacttactccttaattttattttagttaatagcctctaacttccaactatctcatttaccaaaagtacaaaaagtagcaaaaccatctattaatactttgaattttatatctttgcatttcctgttcatccttgaggagatgtatgttgcacaatcaaattttgcatcagccaacagtaatgagtagtagaaagtcaggaacctatgtgtatatatatatatatatatatatatatatatatatatatatatacacacaaacacacacacacacacacacacacacgcacacatatgataatcagtcagtcggtaaccaaatgctagagagtgaccattaacctaagcctgtttttataatgaaaaaatgtgttaactttaaaatatgccaacctccttgtgtcttttaaacaagtcagagtgaaaatacattgtcccctaaggtgtggggagaggaagctttataataaaattagtgattctgcagaaacttgtgcactggatatcttgacaatatgaatataaaactccctaaattaaaaatagggttaatagaaattatcagtatttaaatagggaaaaatgattttatgtttattttatttaggttttatttctttggtcatcttaatgcaaaatgaataaagcatagaatctgggtttggtgtttttttgtctgtttttaaaattctacaggattattactaggaggcaaaaaatgctgtttagaatggaaaaaatttgaagagagaaagcagactgagacactcaagacacctgcaagttatctaagaagatctaaatagaattactaaattttatagtttgcttagagcatttagaaggagataaaggtcttacatactatagtgtatattgtctttggtctctatgctctttgtaaatgtcaattaatataaacagcatctgaacagctaataaatcttttaagttaagatacccagaaaaatgagcatttttagaatttcagtagctaataattcaggaatggaaatattttaactgaatggacagaatcagtcctaacatttgtatgtatgtcctttatttgaattggaactaggctcataagtggttaattttccattagttgatgtagaaatctggtttctccataatatctacaagtgaagatgaagattacttctcaaaaagtatccatatttccagtgttccttttaataaaatatgccacttttaaataaataattacaaaatgtaaaattataaaatttttaaatttaaataataagtaacagtaaaattttttgacaatatatatgtcactgtctttgtaatttaaacatattgctgcctgggatatgggtaacagaattatcactcatggaactttgtagtagtgatggcttggtttgtaattcatcatttcatctttcttggtcttgattaatcctgaaatccttaaaatggctggcatggttatgactttattgtggtaaccttggagatataagccctcttacgatcaaaaacagaagaaaaaaatatattgttcaaactgatgccaggcctacctttattccctcccttaattactttttttctcattcagctcagatcatcctgcacttgaaaaatgaagttttaccaccatcaaaactatcattatttaacaacaagtgaagatcaacagaaaaattcaagtagctttgcaaatactagttgatactcagtgaaatcacgtcactattttgatgcctgaatccatacctttgtgatttatgtttaattacagaagcctattgccttgcagcaattttgttgttataatactgattaattggttactccttcttattataactcagtaatacctgtggtcatttggttcctctatcctgacaaagttcactggaaattgccctcagattttataaactgggggatttcttaattagataaaagttcattactgaagatggaatattatataagatggaggaagggtaattaatagacatgagatatagaaatactttgttagccctgctatagattgcctattgtagtctttctgtgcatttcaatagtctgtattaggaaattataacttcagcacttttgatagcaaaaattggcatctttcaattctgtatagtatgtgactatcctgtaaatgataatatgtgtacagactgagaaggcaggaatataaagtaattgaaatctctcattgccggtatactctaaaacatgcttgatgccttgtcagcatcattgcacacattgactctgtatttacatctgtatatacactatgattagaaaatatgcaagaaattgtttttccatgttaagaacaaatgccattagaagatgtccccttaattgtattgtcagagtattactatgtcaaggatgactgttctgttaacctaattttgtgttttcacatggaaatgtgattggactccatttttctgtgagttgagagtaagagcataagtcagtttgaaagcatttacaagtttgttttagaatgtagtaagggctgaaaggtgctctacttcttaacttgttttttccatgttgtagacaaatgaaatttgtctaaatgcttttgtctaaaaatgcatttgtctaaatgctttagattgatgtagggtttagatcctctttaatactttgagatagtcttattctgattttttttttcttctggaaaccaagtagaattagggatgggaatacaaatgcatttattctggcttctgttttattccaagaagcttcttggaacaaatcagtaggaattgaaaagaaagcatgaccaacccaattacaggggataaatgtaagcttgttaaagtaagcaccacaccatgtttctgtctccccagcacccagcacagtgctgtgaaccttggcagatgctagataaatgtgtgttgaatgaatgtgcctatgaagccacaaagatgccacatgttagtatatcagtgagaggtgactccacagtgctctctggagaagcaatatgagtgactgaagagtggggccttttgcttttgcctggatataggggtgctcttctactgtaattgggtgtggaaaaactctggctttatggtattccattaggttcttttcatttaaagtagtcttaaaatcaaagtatccaatattttaaagccacaaagtagattacataattagcagagattttagtcagtaaaatgttagaaatcaaactataagaaaattcaagtcctttattttgtgtcttgggtatatgtcattattttaaattccacactcccttatttaatcactttggtaagtgcctttgatgttttgaaatgtatagtgggagatgagcaaatgtaaatgtcatgtgccctgttccctagcttctcaattcctcataaccatttttaccagtgttgcaaagtttagacctttgtgttaatatcagaagtgtatttgtagcccctccatagtgaacaatgaaataaactatttcatagaaaacaaaaa

SEQ ID NO: 7933 - DNA, 1193 bp, Homo sapiens
gatcggctcgatgagcggaggcgctgctgcggcgctgcggccgacgccgggtccgcaccaactgtctccccctcccagcttcttacctcggcttcctactccttcccccgcccgcccagcaccgccagcccgggagagctgccgggagttccccgggagcctcaggtggtgactatcctgttgagaagcaaaagatactttgcaagtaaaaaatatgcctcccaagtttaagcgccacctcaatgatgatgatgtcacaggttctgtgaaaagtgaaaggagaaatcttttggaagatgattcagatgaagaagaggacttttttctgggaccatctggaccaagatttggacctagaaatgataaaattaagcatgttcagaatcaagtggatgaagttattgatgtcatgcaagaaaatattacaaaggtaattgagagaggggagagactagatgaactacaggacaaatcagaaagcttatcggataatgcaacagcttttagcaacagatccaaacaacttcgaaggcaaatgtggtggcgtggatgcaaaataaaagccatcatggctttggttgctgctatccttttgctagtgattatcattcttatagtcatgaaataccgtacttgatttgatgacagagatcttcattaaacaagatctgggacagtaataaaagattgctgcataatttaaatgaaacctatgtgtatataactttcaaaacttctttttcaagaaactaagaggcaagtatcacttcaaattggaacgttgagaatgtccaattatcttctccctttctaacaaaatgttcttttaataattatgtttaaggcaaagagaactagcctctatttttccatatttcaaggatctaatttgaaactagatacttgccagttcattatttgtgtatataaacactgattataatatttcatattaatattttaatggcataaggacttgcattattgcattagggagcgggtcatgctgggggtcaggaagcctgtgtagagtaccaaattatatgctgaaagagatgcataaccattctgtcaatatttgcagaaatatagttcctttcatattacagttgttttgcaagcaatttccacatttataggtgtaacaaaagctaaatgttgtaaatgttgttgccctcaggtataactaaaaa

SEQ ID NO: 7934 - DNA, 2657 bp, Homo sapiens
gagcggaggcgctgctgcggcgctgcggccgacgccgggtccgcaccaactgtctccccctcccagcttcttacctcggcttcctactccttcccccgcccgcccagcaccgccagcccgggagagctgccgggagttccccgggagcctcaggtggtgactatcctgttgagaagcaaaagatactttgcaagtaaaaaatatgcctcccaagtttaagcgccacctcaatgatgatgatgtcacaggttctgtgaaaagtgaaaggagaaatcttttggaagatgattcagatgaagaagaggacttttttctgggaccatctggaccaagatttggacctagaaatgataaaattaagcatgttcagaatcaagtggatgaagttattgatgtcatgcaagaaaatattacaaaggtaattgagagaggggagagactagatgaactacaggacaaatcagaaagcttatcggataatgcaacagcttttagcaacagatccaaacaacttcgaaggcaaatgtggtggcgtggatgcaaaataaaagccatcatggctttggttgctgctatccttttgctagtgattatcattcttatagtcatgaaataccgtacttgatttgatgacagagatcttcattaaacaagatctgggacagtaataaaagattgctgcataatttaaatgaaacctatgtgtatataactttcaaaacttctttttcaagaaactaagagctcagatcatcctgcacttgaaaaatgaagttttaccaccatcaaaactatcattatttaacaacaagtgaagatcaacagaaaaattcaagtagctttgcaaatactagttgatactcagtgaaatcacgtcactattttgatgcctgaatccatacctttgtgatttatgtttaattacagaagcctattgccttgcagcaattttgttgttataatactgattaattggttactccttcttattataactcagtaatacctgtggtcatttggttcctctatcctgacaaagttcactggaaattgccctcagattttataaactgggggatttcttaattagataaaagttcattactgaagatggaatattatataagatggaggaagggtaattaatagacatgagatatagaaatactttgttagccctgctatagattgcctattgtagtctttctgtgcatttcaatagtctgtattaggaaattataacttcagcacttttgatagcaaaaattggcatctttcaattctgtatagtatgtgactatcctgtaaatgataatatgtgtacagactgagaaggcaggaatataaagtaattgaaatctctcattgccggtatactctaaaacatgcttgatgccttgtcagcatcattgcacacattgactctgtatttacatctgtatatacactatgattagaaaatatgcaagaaattgtttttccatgttaagaacaaatgccattagaagatgtccccttaattgtattgtcagagtattactatgtcaaggatgactgttctgttaacctaattttgtgttttcacatggaaatgtgattggactccatttttctgtgagttgagagtaagagcataagtcagtttgaaagcatttacaagtttgttttagaatgtagtaagggctgaaaggtgctctacttcttaacttgttttttccatgttgtagacaaatgaaatttgtctaaatgcttttgtctaaaaatgcatttgtctaaatgctttagattgatgtagggtttagatcctctttaatactttgagatagtcttattctgattttttttttcttctggaaaccaagtagaattagggatgggaatacaaatgcatttattctggcttctgttttattccaagaagcttcttggaacaaatcagtaggaattgaaaagaaagcatgaccaacccaattacaggggataaatgtaagcttgttaaagtaagcaccacaccatgtttctgtctccccagcacccagcacagtgctgtgaaccttggcagatgctagataaatgtgtgttgaatgaatgtgcctatgaagccacaaagatgccacatgttagtatatcagtgagaggtgactccacagtgctctctggagaagcaatatgagtgactgaagagtggggccttttgcttttgcctggatataggggtgctcttctactgtaattgggtgtggaaaaactctggctttatggtattccattaggttcttttcatttaaagtagtcttaaaatcaaagtatccaatattttaaagccacaaagtagattacataattagcagagattttagtcagtaaaatgttagaaatcaaactataagaaaattcaagtcctttattttgtgtcttgggtatatgtcattattttaaattccacactcccttatttaatcactttggtaagtgcctttgatgttttgaaatgtatagtgggagatgagcaaatgtaaatgtcatgtgccctgttccctagcttctcaattcctcataaccatttttaccagtgttgcaaagtttagacctttgtgttaatatcagaagtgtatttgtagcccctccatagtgaacaatgaaataaactatttcat

SEQ ID NO: 7935 - DNA, 1738 bp, Homo sapiens
gcggaggcgctgctgcggcgctgcggccgacgccgggtccgcaccaactgtctccccctcccagcttcttacctcggcttcctactccttcccccgcccgcccagcaccgccagcccgggagagctgccgggagttccccgggagcctcaggtggtgactatcctgttgagaagcaaaagatactttgcaagtaaaaaatatgcctcccaagtttaagcgccacctcaatgatgatgatgtcacaggttctgtgaaaagtgaaaggagaaatcttttggaagatgattcagatgaagaagaggacttttttctaaggggaccatctggaccaagatttggacctagaaatgataaaattaagcatgttcagaatcaagtggatgaagttattgatgtcatgcaagaaaatattacaaaggtaattgagagaggggagagactagatgaactacaggacaaatcagaaagcttatcggataatgcaacagcttttagcaacagatccaaacaacttcgaaggcaaatgtggtggcgtggatgcaaaataaaagccatcatggctttggttgctgctatccttttgctagtgattatcattcttatagtcatgaaataccgtacttgatttgatgacagagatcttcattaaacaagatctgggacagtaataaaagattgctgcataatttaaatgaaacctatgtgtatataactttcaaaacttctttttcaagaaactaagagctcagatcatcctgcacttgaaaaatgaagttttaccaccatcaaaactatcattatttaacaacaagtgaagatcaacagaaaaattcaagtagctttgcaaatactagttgatactcagtgaaatcacgtcactattttgatgcctgaatccatacctttgtgatttatgtttaattacagaagcctattgccttgcagcaattttgttgttataatactgattaattggttactccttcttattataactcagtaatacctgtggtcatttggttcctctatcctgacaaagttcactggaaattgccctcagattttataaactgggggatttcttaattagataaaagttcattactgaagatggaatattatataagatggaggaagggtaattaatagacatgagatatagaaatactttgttagccctgctatagattgcctattgtagtctttctgtgcatttcaatagtctgtattaggaaattataacttcagcacttttgatagcaaaaattggcatctttcaattctgtatagtatgtgactatcctgtaaatgataatatgtgtacagactgagaaggcaggaatataaagtaattgaaatctctcattgccggtatactctaaaacatgcttgatgccttgtcagcatcattgcacacattgactctgtatttacatctgtatatacactatgattagaaaatatgcaagaaattgtttttccatgttaagaacaaatgccattagaagatgtccccttaattgtattgtcagagtattactatgtcaaggatgactgttctgttaacctaattttgtgttttcacatggaaatgtgattggactccatttttctgtgagttgagagtaagagcataagtcagtttgaaagcatttacaagtttgttttagaatgtagtaagggctgaaaggtgctctacttcttaacttgttttttccatgttgtagacaaatgaaa

SEQ ID NO: 7936 - DNA, 2962 bp, Homo sapiens
gggagcgcgcggcggccgggggcggagcgcagccagggctgcgcggcgcgccccggctcccgcccgctcccagccgggccccccagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccacttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggca

SEQ ID NO: 7937 - DNA, 2751 bp, Homo sapiens
atgctcagcgaaactcttgggtatctgtcttctgtgctcttgcagtgcacagaagccaaaaagcattgctggtatttcgaaggactctatccaacctattatatatgccgctcctacgaggactgctgtggctccaggtgctgtgtgcgggccctctccatacagaggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccgccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccatgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccatttttttggtgtgtttatggaagtgcatgtagagcgtcctgccctttgaaatcagactgggtgtgtgtcttccctggacatcactgcctctccagggcattctcaggcccgggggtctccttccctcaggcagctccagtggtgggttctgaagggtgctttcaaaacggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggtcggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagcctcttgagaaattgttactcattgaactggagcatcaagacatctcatggaagtggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaattatgttaagagacagtgatggctagggctcaacaattttgtattcccatgtttgtgtgagacagagtttgttttcccttgaacttggttagaattgtgctactgtgaacgctgatcctgcatatggaagtcccacttcggtgacatttcctggccattcttgtttccattgtgtggatggtgggttgtgcccacttcctggagtgagacagctcctggtgtgtagaattcccggagcgtccgtggttcagagtaaacttgaagcagatctgtgcatgcttttcctctgcaacaattggctcgtttctcttttttgttctcttttgataggatcctgtttcctatgtgtgcaaaataaaaataaatttgggc

SEQ ID NO: 7938 - DNA, 2951 bp, Homo sapiens
ttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaatacctgggatatagtaatcactcaatgaatataaactgcacttactggcatgctcaaggaatgggctattaagcaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtggtgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgat

SEQ ID NO: 7939 - DNA, 2835 bp, Homo sapiens
atgttgcctgacatggaagatgttcatctttttcagaattctccactttaccaatacttacaggatctgggacacacagactttgaaatatgttcttctttgtcaccaaaaacagaaaaatgcacaacagagggacaacaaaagcctcctacaagagtcctaccaaaacaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtggtgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgat

SEQ ID NO: 7940 - DNA, 4562 bp, Homo sapiens
gtagttttctggacccacgggacgggcaggagctggagctccgtgccgcctgtactcccgccttcatttcccatcgtgctgaggcgggtggcatggcggagaaggatgacaccggagtttgacgaagaggtggtttttgagaattctccactttaccaatacttacaggatctgggacacacagactttgaaatatgttcttctttgtcaccaaaaacagaaaaatgcacaacagagggacaacaaaagcctcctacaagagtcctaccaaaacaaggtatcctgttaaaagtggctgaaaccatcaaaagttggatttttttttctcagtgcaataagaaagatgacttacttcacaagttggatattggattccgactcgactcattacataccatcctgcaacaggaagtcctgttacaagaggatgtggagctgattgagctacttgatcccagtatcctgtctgcagggcaatctcaacaacaggaaaatggacaccttccaacactttgctccctggcaacccctaatatttgggatctctcaatgctatttgccttcattagcttgctcgttatgcttcccacttggtggattgtgtcttcctggctggtatggggagtgattctatttgtgtatctggtcataagagctttgagattatggaggacagccaaactacaagtgaccctaaaaaaatacagcgttcatttggaagatatggccacaaacagccgagcttttactaacctcgtgagaaaagctttacgtctcattcaagaaaccgaagtgatttccagaggatttacactggtcagtgctgcttgcccatttaataaagctggacagcatccaagtcagcatctcatcggtcttcggaaagctgtctaccgaactctaagagccaacttccaagcagcaaggctagctaccctatatatgctgaaaaactaccccctgaactctgagagtgacaatgtaaccaactacatctgtgtggtgccttttaaagagctgggccttggacttagtgaagagcagatttcagaagaggaagcacataactttacagatggcttcagcctgcctgcattgaaggttttgttccaactctgggtggcacagagttcagagttcttcagacggttagccctattactttctacagccaattcacctcctgggcccttacttactccagcacttctgcctcatcgtatcttatctgatgtgactcaaggtctacctcatgctcattctgcctgtttggaagagcttaagcgcagctatgagttctatcggtactttgaaactcagcaccagtcagtaccgcagtgtttatccaaaactcaacagaagtcaagagaactgaataatgttcacacagcagtgcgtagcttgcagctccatctgaaagcattactgaatgaggtaataattcttgaagatgaacttgaaaagcttgtttgtactaaagaaacacaagaactagtgtcagaggcttatcccatcctagaacagaaattaaagttgattcagccccacgttcaagcaagcaacaattgctgggaagaggccatttctcaggtcgacaaactgctacgaagaaatacagataaaaaaggcaagcctgaaatagcatgtgaaaacccacattgtacagtagtacctttgaagcagcctactctacacattgcagacaaagatccaatcccagaggagcaggaattagaagcttatgtagatgatatagatattgatagtgatttcagaaaggatgatttttattacttgtctcaagaagacaaagagagacagaagcgtgagcatgaagaatccaagagggtgctccaagaattaaaatctgtgctgggatttaaagcttcagaggcagaaaggcagaagtggaagcaacttctatttagtgatcatgccgtgttgaaatccttgtctcctgtagacccagtggaacccataagtaattcagaaccatcaatgaattcagatatgggaaaagtcagtaaaaatgatactgaagaggaaagtaataaatccgccacaacagacaatgaaataagtaggactgagtatttatgtgaaaactctctagaaggtaaaaataaagataattcttcaaatgaagtcttcccccaaggagcagaagaaagaatgtgttaccaatgtgagagtgaagatgaaccacaagcagatggaagtggtctgaccactgcccctccaactcccagggactcattacagccctccattaagcagaggctggcacggctacagctgtcaccagattttaccttcactgctggccttgctgcagaagtggctgctagatctctctcctttaccaccatgcaggaacagacttttggtggtgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaattgatgtgtgctggggtttggaactaaaagtagtttcaacagtgcgtgggttatgacatttcttatgtttctttgttcatgtgtgtatttagtagttaattttaagatgtcctagtgatctttaaaagaaaaatattgtaccattttttagaattacactttcacctttctttttgcaattgaaagtgatgatgtcaaagtgggatttctgtactccaaggccccacccccaatttagcaagcagaaaaacgttccttgtatcactttaccttggataattgggtgccattaacacaaacaggtcacaatcctgctgttttctagccctgtccaccataatgagattcaggaaacatcctgtcagcctcctggaaagcatccttgtctccttagtatttcatttacaaactacctcttaacagagactgcttttcaaattggccaatcttacctgttttgtgttgtgattgcattttcaaagagtaattattttcagcatatacagttttgaaacctgtagctcctatgcaataacatagttctatagacattatttgggggaaatgtagtaataactcaatctatgttgctgtcctagaaaggaaattgcatgatgaatctagattgtctttagagtaaagaaacacattcaaattcctgtaacttatcactttcagtgagtaaatttacttataccaaaggggattttttttctttcaggaatctaaggaaatttactttttaacctgagaaaaaaacttggttctgctttatataaacagtagagattattgtactataagtgattttgcctttttgccaaaatcctggaactcatctataattaacctcttcggagcaataccttaggttgggccttgctttactacttagaaatagctaaatttcaattttaaaaatctttgtgtgttataactgttaaattattcaataatacttagggtttactttcttatttaaatcacttatttagtttaccgacttcatttttctttggatttagaagaagcaattatggaaaaacttggtaatctctctcaacctataaccttacacaggaagaattagagtttaataatttttaattcttttattgtatgttacttttattacaccagtttgggggaaaatcttcataaaattgtatcagttttattcagtgttctctaaggtgataccttttaattttgaaagactaaataattttaatcgagaatttccagtctttcagtctgatctatttaattcactacttgttacataatccagtgaaaactctacttgttgaaattatgacataaagatcttgcagctttatttgagtatttgttcttttgtgtagtttccatcttttaaaatatttaaaatattttcaagataaagtattatcttctctgcaaaaattcctggagtaattttctctcataatatttgaagtcagtggttctcagttgtattagtggggtaactacatcaaaataaataaagtcttatttttaaaatgcaaattttagaccatactcccagtgattcttagttggtctttttggaatgagccataggtaatgtttatgtccaataaaatctaggaacctc

SEQ ID NO: 7941 - DNA, 5879 bp, Homo sapiens
ggcggcggaggcggcggtggcggcggtggcggctgggtcgggccccgacgggcggcggcggctgaggtggaggcggagggaggcggcggcggcggcggcgggaagatggcggctcccgtcctgctaagagtgtcggtgccgcggtgggagcgggtggcccggtatgcagtgtgcgctgccggaatcctgctctccatctacgcctaccacgtggagcgggagaaggagcgggaccccgagcaccgggccctctgcgacctggggccctgggtgaagtgctccgccgcccttgcctccagatggggtcgaggatttggtcttttgggttccatttttggaaaggatggtgtattaaaccagccaaacagtgtctttggacttatattttatatactacagttattacttggcatgacagcaagcgctgtggcggctttgatcctcatgacgtcctccatcatgtcggtcgtggggtccctgtacctggcctacattctgtactttgtgctgaaggagttctgcatcatctgcatcgtcacgtacgtgctgaacttccttcttctcattatcaactacaaacgactagtttacttgaacgaggcctggaagcggcagctgcaacccaagcaggactgacgcccgacagactccaccctaacagtctcaagcccctttccattcagtttattttgcagcaggtttttattattattattattattattattcacaacagacactttccctaagaatctcaaactgatttttaaaaatccggtaaattagaaggggccctcgctattttctgtgtcagtcttcattttaaatatggatacaaaaaggatacgccgagccaatcaaagacaagctttaactttactttgaagtgtttctgaaatgataaaatgtagccctagccccctgccctcaattgtaaagtgagcaaccattgctagtaattctttaatgtgtataaattcaatttcaggtataacaaatgtgatcatgacatgaaaatattctagaatagatactgtattaaatattgccatgtttacaatatgtaatatgtttttagccgatggatttaaacatgtagattcaactagaatccatttgtgatatttgtaaataaaggtagaaatattagatccatttctgcagaacttactgtacagtttagttggagtgtagcactgaagaactgtcagctcagcgttgactgaggagatagtgaaaatagcctatacacagcatcttgtgaaaagtactggcagccgtggttgcagcaaataatagggcaaaaaaaataataatagggtggtcggttccctttcatctccctcttctgaaaggaaaaaattgaattggaacgttcaagtccagtttgtgttcagtcataaaactgggccagttgttaaccttacagaatgagtcatgtggccagaccttcaagtccaaggccttcagacactaaggatgggaaaatgggtatttttctttggagaaaagctggaaatataaacatggcatttttaggtaaagtttcttccactagttgaattttcatgcagatatttttccttaacgttggtgccagtcaagcaaagagtattatgatggaaaagaccagtccaagccccatcgctccggagtgggagccagtgttcttgctaattgtttctttctgcactaaccactcagatgtctaatttaattgttttgcagtcaaatactggatttgtaaccttcagggctgacatgctgcccagtttgcttcatcgggagaatagcaacaggtagacacatctcaaggctaaatctgctcatgtcgccactgctctcataatgacacacatgcagtaagaagacttttgtaaggggatttgagtacacccaaatgaaattgtgacaggatgtttgtatggttaacatctgatatcagaatgttaaaagtgccttctgtcttaaatctcaaaccaaatattttgtgtgttgaccttgggcagaagaagtgtccttccctcctttcttcaccgtcaggtagaaaacctgcactctgcagaagggtcctgtgtgatcacttaatcctctggttgagaagcagcagtaatgtttttgcttccaacctgattaatcattttatgttgaaaatagtcaatgagaccagtatctcttgagtgctttatttgccttctctttgaagggaggggacgggctctgctctgtaaactcaaatgtgtagagtcagcaacaattccgtagcttccaactgactcagaattgatgcaacgtaggtcttctggcccgaggcaggtatcaagtccaaatcataatgaacttttcaccagtttcaaccagtttcttaaaagagagcttaagtcaagatttcatcaagacttgtgttttcccatgaatgtgaatctttcaatggctgttggagtatgtatgtactgttcttgcattctgaagtagttaaagaactctagaaagtactgattggccatctggtgtctatggagaaagaagtcctcacgtttgagggctgtacagtgaggccatcttgtagcagcgcatccagctctaccaaggcagtcctctggttcttttttctaagctacagtggaaatggcctaatggttaaaactgtggtatacatgacatcggttgtgctaaacaagttcctcgtgtcccaatatccaatggtttttcatcctattttgtatcaatcaacagagtatagttaaagcttgtcttgatgttgcattcttgcaaatgtcttcaactcttacctgagaaaacatggcaaaatggtcagccagacccttccagtttttcctttgcttttctaagcctcggggaaaccactgtttcagttgtataaaaacttttgccacattcctatggcccagtcgaattaataccctttttctcactgagagaggaacacgtactgcctgtcataacagcattgtaatgccagtgtctcagtaacagaatcctggtgggtgttaattgggtgttttttgccctggagaattcagattcctttctatacctccgattctgcccagaagagggggggaatcaccagtgttacaaaattagaagattgttttgcctgttttagactgaatatttgaacactgcagcattactagccaccagtgttaaaggacagatgaggggaaacatttgtttttagcagtaattccatgcctcatcttttttaagtgatttgttccaaatgaagccatttattgacttgatgttcacaaatatcatttgaagaaataacaggaattggggttagatgataaattctagggaatctaggtgatttggaggatttcatttgttttgcattacagctagttgctctcactaaaggtaaatttccggtgaaataactcaggtttaactagctgtgtgcccagaatcactgttccttcatacatgtgtcctctccttaaattcattactttcaaatgatgttcaaagcattgactattttcattcaaagaaactacattcggccgggcacggtggctcacgcctataatcccagcactttgggaggccgaggcgggtggattacctaaggtcaggagttcaagaccagcctggccagcatagtgaaaccccatctctactaaaaatacaaaaattagccaggcgcagtggcacacccctgtaatcccagctactcgggaggctgagggaggagaattgcttgagcccgggagacagaggttgcagtgagtcaagatcatgccactgcactccagcctggccaacagagcgagactgtcccccccccaaaaaaaaaagagagagactgcattcaaagaggaccaagactacagtgaaattaaaactgtttgctggctgggcatggtggctcacacctgtaatcccagcactttgggaggccgaggcggttggatcacctgaggtcagaagttcgagatcagcctgaccgacatagtggaaccctgtctttactaaaaatacaaaaattagctgggcatggtggcggcacctgtaatgccagctcctccagaggctgaggcaggagaattgcttgaacccagtaggtggaggttgcagtgagccacagttgcgccattgcactccagcctgggcaatgagtgaaactctgtctcaaataaaaaaataaaaataaaaactatttgttgacttttgtttttcatttagttttggaaaagactatttgcaaaagtacagagttatcttcagcaattacttcacaacttagattggtaccaagagtgacaggagatcttgtcttggaagatcattattagatgccaacaaggagacccactgtgatttctggtaacctatttggggaaaaagacctaatgacctaatatgcaatttctgtcctcgtgtctttttctctaacacacagtcatgggtgaaacatttcagacacctcaggcagcacttatggtttctaattgtgagaactacccttccatcaaacaaaaagggcaagggtgggagccccggctacttggttaaacattttttactacaaattcgcccagaaaaggtgaaatattttgttataaaactgtattaagcatggcctaagtatttattaggtatatgatctgtgtagtatgttccatcagaaatatttcttactagtgctttaagctccagagtaaacagtcatttaaaatggagttcactgggcaggtttcccctttaatctagatagaaatactctttatcagagatttaaggcactgttttgctaactggtaaataaaaccaaatgtaaatatgtaagaatgtttatttgttgcacataacttttttggtataaaataaatgtagaagttacctgtggaagttgtgctcccattattcttaaactgcagggttgcattccaaaagaactgaaacgaagtctttttagactcagtaggagccttatattcttgaagtcaatactgtaacctcatttctaaggtatacagggttgattctttttctcttaaatcatatgtaacttgcagaagattcagagtcctcagacctctagttcttggaattcctgtaggtttacggtgtatgtgattgtcaagaattaatgacaaaaatgtgtcactgcctacagttctgtgaacactcagaatgtattaatgagctgtttttccatagttttactttagcttaccttgaatactccctgtataatcctctaaaaaggtagcatcggcaagaaagatgaatccgttggaaatacagctgagccatacttcacggaatagaacaagtgtgttctgtgctggagctcaagacctgtggaaagggactgcccccactgggtgcaatggctcatgcctgtaatcccagcactttgggaggtagaggcgggtggatcacttgaggtcaggagttcaagaccagcctggccaacatggtgaaacctgcctctactgaaaaatacagaaaaattagccaggattgtggtgtgcgcctgtaatcccagctattcaggaagctgaggcaggagaattgcttgaaccagggaggcggaggttgcagtgagacgagatcacgccactgcactgcagcctaggcgacagaggaagactccagctcaagaaaaaaaacaatggactgcccctaatttgtaaaccatttaaatgtgtctattacatttaacttttcttaatgtttgtcaactaaaagttttattcattatactttgacatactggaacacaaaacttgattcctttgaaaaactaaagagaagttgataaaaaaaatacagaagctctagattcctaattggaactgactacactcatttttaaaaaatggacgatgcctaataaa

SEQ ID NO: 7942 - DNA, 4717 bp, Homo sapiens
ctacttccggtgcgaaccgcctcggccgttccctcgcggagcttactgagcgcggccgccgagcccagctccgccgccgagcgcctgtgccggcacggctacaccatggagcgcccggataaggcggcgctgaacgcactgcagcctcctgagttcagaaatgaaagctcattagcatctacactgaagacgctcctgttcttcacagctttaatgatcactgttcctattgggttatatttcacaactaaatcttacatatttgaaggcgcccttgggatgtccaatagggacagctatttttacgctgctattgttgcagtggtcgccgtccatgtggtgctggccctctttgtgtatgtggcctggaatgaaggctcacgacagtggcgtgaaggcaaacaggattaaagtgaacatcacctttttatagcattaaattcattttttaaaatgataaatgctggagggggccatctgatttgaataaagttgaaagaacatgttaaagtcagtcttaaggagtcacgtttgagtatgtaaattttgatctttctaatatgttggtttgtatattcagttttaactgtatgaatctgatttgcaaatgagaatttggaaaagttagttacaaagaaatatgttaatttaattagacaatactctggaaggaattttatcttctttcaacaaaacatgttttatagtattctgacttacggttgcttttgagttttactcatttggatatattaagatgcacacagtgaagcaaattaaactccactttacgctggaatgctttctttagcatgaaaataccaggtccttggatttgggattttaatttcctatggaaagttgcttaaattgtggacactggaattaatctgaatgtcactgaggaatttcacatgaagtgtaatccctagtcaataagaattatccattacattattttatgggaaaactaggctaaattacatccattcaggtaaaaggaccttagcttactgaaggatctaaagagcaaagcaaagatctcactactcaaacactcagcctgcttccttcaagtccccttgcaggccagctttgtgctttgcagaccaactttttaatgagatactttgcttcctcattcaacattgaagctaggcttcaattaaaaggttcgaggaagctccatttaaaattgttttttttactattttttaaaattgtagtgtatatgataggaatttgcatttaaatatgttcatttttgcatatgttaggagtggaaacaatctggaaaacatttttttttcatccaaaaagtattctccttgggcatatctgatggaaaaaaaccttgattttattttcgtatctttagtctgtgttctttctagttatttggtactaattatgtgcaatctaaaaacactcccacaagtatttgttttttaattataaaatcatagtatatgttctttgtagaaaactggaaaaatacatattcaaacaggaaaaaaaatcaaaattccccataatgttgccatctaaaaataacctctattttagttgatatcccgtattcatttttgaaagccattccttaatgctagtttgatacacactaaaagtttagcttacaagttcaaattctgccagcttttcctgacagctatttgcatttttttcagatgagtgattattggccattttctttttctttttctttattttatttatttatttttttgagacagagttttgctctgttgcccaggctggagtgcagtggtgcaatctcggctcactgcaacctctgcctcctgggttcaagtgattctccacctcagcctcccaagtagctgggactacggatgcctgccaccacgcctggctaatttttttttgtatttttttgtagagacggggtttcaccatgttgtccaggctaatcttgaacttgtgacctcaggtgatccacccgcctcggcctccgaaagtgctgggattacaggcgtgagctaccacgcccggccttattgaccattttctaaataagcacattctatctttattctcttaaaattcaaattttctgttactgataatcctaatactaggattcttgcttaagtatgtgaaaccattaccgatttgttgttcacatttattttttatgttgtgaaactggactaaaggaatagagggatgattagtcataaaagtcaaatagcatttgtgtttaactgttgagaaaagtgaaagatcagtatgattattatggaactgtttttaattcttgcttaaagactacaattttagtataatgacatttgagtctagggtagtatgtggtagatttctagatggtccctaattaagaagtattgttgtatttagaattgtccacctaatttctttttatataatgccaaggtatttcttgtgcttttgggatcttatgctgtttgtaaaatgttactgtccaatgttggattattgttttggtttcaggcatttgctgaataggtgatgatacatgggtatttttctgcaagtatttaaaccaggggcatatgcaaaggcagttgtaatttcctcttggaaaaagcgccaaatgtttgaaggttaaaatcaaatgctagggttgatatttaggcttataacaaaataggcttgttttcaaagcagttttttcctagagttttaactgttaactcactagtttgctgctgtttttaactatgttaaataacatatggtatttggcaaatagatttatttttcaaaatgtctcactagtttccttttacacaatgtatatacttcaagatgtatagaaaggaaagctacagttgagcccttatacatgttttaaggtagaaatatgttccctattgtttgaaaactgattgtaagaataacctcagttaggagatataacttgaagtgtcagtccaaactactgatttaaccctatttacggtaacacattaccttcctcacctcctgtttggccctggagaatgtagtcctttttctcatttgtgttgagaaatgaaaagtctgctgtagaatgtatctgatgtcattagttcttcaaatggataccattgtacatataacagtagaatttggtttggggttgttagtgaaaaaaaatttaaacctgccattaaaaatccccatgtttcatggaaatctaacagaaatacattgtaataattagaacattttgttttcttttttctttttttttttttcgagacggagttttgcccttcttgcccaggctggagtgcaagggcgcaatctcggctcgctgcaacctccgcctcccgggttcaagcagttctcctgcctcagccccctgagtacctcagatgacaggtgcgtgccaccacacccggctaatttttgtatttttagtagagacggggtttcaccatgttagccaggctagtctcgaactcctgacctcaggtgatccacccgcctccgcctcccaaagtgctgggattacaggtatcagccaccgtgcctggcctaataattggaacattttcatcatgaaaatgtcatcagctttgccaaaagaaacaaccaattgacttgtttggcgtttgttttccattttcatgtcaattttatgtatacagttagaatacccaaggagaccactaaaatcagttaaacaagtagggtatatacaaagaaagatgaaacccgaaagtacataaaaaggatttaaatccgattttagatgtacctagtgtgtatttcttatctctagacaagttcatgtttattgtttaatttatgcccaagtgaagttgtaaacttatggttcaactctgacacagaatttgtcacttgtctgaggtcagtggcaggtttctctgctgtcaagcactctgtgtcacccaccagattagtataactattaattcagactgtactcctatgtttaagataatttttacaagagctggctgaagcagcacattagtaacctgacaagatttctttttcccttttcagggggaaagggtcaccttaaaaataaattattttcagggactttgggaatctaatgataaatattacacataatctatgaatagcttaatcctttatatattccttaaaataggaattcctcgacatcactcctggccacactttccttgcctgtgttgttgctatgtgtatttgaaagtaatatctgcattccttttaagatgttctgtaagtcatatttgtcagttatacagagtagtcttccttttccccacgttcagtgtaatctcactgaacagtaataatagcaatagctaacaacatctgcacagcaccttacagtttgcaaagaacgttcacacattctcatttgagttttgcatagtgaacctgttacgagatgtctcttgacgtcgatgctaaaagtgttagaatctttacatcactagagtcattgaatatgctgtagtattgaatagtgccctgactagggggaggatttggatgtgctgcatttcaagccgtgtataatcatcaaaatggggggcttgagttctttagctacttgaatccgatttacttctgttaagtgatgcttttctaaccgttttctggatggattttgtattcactatattgtagcttgtaatttgtataaatgtaccatctgatgtcattaaaaaaagtgtttgtagtgcta

SEQ ID NO: 7943 - DNA, 693 bp, Homo sapiens
gggtcactggcatcgagtctggaacagtcattctcagcaagagctctttgaactctgacattctctagttttacggactcggcaccacagccctctggctggtagtccctcttcgcggctcatatgctcgggtctccttgcggcccccagctcagcgaccgagacgcagacgaggaccagtgttcacgcgagttcagggggcggcgtagccgccgcccgcccaggaggaccatgttgcgcggcaagtcccggctcaacgtggagtggctgggctactcgccaggcctgctcctcgagcacaggcccctcctggcagggcgcacgccgcggagccaccgccgaaatgaaagctcattagcatctacactgaagacgctcctgttcttcacagctttaatgatcactgttcctattgggttatatttcacaactaaatcttacatatttgaaggcgcccttgggatgtccaatagggacagctatttttacgctgctattgttgcagtggtcgccgtccatgtggtgctggccctctttgtgtatgtggcctggaatgaaggctcacgacagtggcgtgaaggcaaacaggattaaagtgaacatcacctttttatagcattaaattcattttttaaaatgataaatgctggagggggccatctgatttgaataaagttgaaagaacatgttaaa

SEQ ID NO: 7944 - DNA, 1311 bp, Homo sapiens
tctctctctgccttggctgccaggcagggaagggccccctgtccagtggacacgtgacccacgtgaccttacctatcattggagatgactcacactctttaccctaccccttttgctttgtatccaataaatatcagcgcagcctggcatttggggccactaccagtctcctgctttgtatccaataaatatcagtgcagcctggcattcggggccactaccggtctccgcgtcttggtggtagtggtcccccagacacagctgtcttttctttcatctctttgtcttgtgtctttatttctacactctcttgtctctgcacacggagagaaacccaccaaacctgtggggctggaccctacactattccaggtagttgttggaatcctggggaatttttcactcttatattattatatgttcctttactttaggggatacaagccaagatccacagatttgattctcaggcacctgactgtagctgactccttggttatcctatctaaaagaatcccagagaccatggcaacttttgggttgaaacattttgacaattattttggatgcaaatttcttttgtatgcacacagggtaggcaggggtgtgtccattggaagcacctgcctcttgagtgtcttccaggtgatcaccatcaaccctaggaactccaggtgggcagagatgaaagtaaaagccccgacatacattggtctctccaatatcctgtgctgggccttccacatgctggtaaatgccatttttcctatttatacaactggcaaatggagcaacaacaacatcacaaagaaaggagatttgggatattgttctgccccacttagtgatgaagtcacaaagtcagtatatgcagcattgacatccttccatgatgttttgtgtctggggctcatgctctgggccagcagctccatcgttttggtcttgtacaggcacaaacagcaggtacaacacatctgtaggaacaatctctaccccaactcttctcctgggaacagagccatccaaagcatccttgcattggtgagcacctttgcattatgttacgccctttccttcatcacctacgtttatttagctctcttcgataattccagttggtggctagtgaacactgctgcactaatcattgcctgttttccaactattagcccttttgttctcatgtgccgtgaccccagcagatccaggctctgcagtatctgctgcagaagaaatagacgattctttcatgatttcaggaaaatgtgaattggctgtcttggtttatgttcggccactgatgcactc

SEQ ID NO: 7945 - DNA, 2997 bp, Homo sapiens
ggcgatgcccagcagataagccaggcaaacctcggtgtgatcgaagaagccaatttgagactcagcctagtccaggcaagctactggcacctgctgctctcaactaacctccacacaatggtgttcgcattttggaaggtctttctgatcctaagctgccttgcaggtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctcaacgtcagtgtgttagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcaacccaaccaccgggattttggtcattggaaatctgacaaattttgaacaaggttattaccagtgtactgccatcaacagacttggcaatagttcctgcgaaatcgatctcacttcttcacatccagaagttggaatcattgttggggccttgattggtagcctggtaggtgccgccatcatcatctctgttgtgtgcttcgcaaggaataaggcaaaagcaaaggcaaaagaaagaaattctaagaccatcgcggaacttgagccaatgacaaagataaacccaaggggagaaagcgaagcaatgccaagagaagacgctacccaactagaagtaactctaccatcttccattcatgagactggccctgataccatccaagaaccagactatgagccaaagcctactcaggagcctgccccagagcctgccccaggatcagagcctatggcagtgcctgaccttgacatcgagctggagctggagccagaaacgcagtcggaattggagccagagccagagccagagccagagtcagagcctggggttgtagttgagcccttaagtgaagatgaaaagggagtggttaaggcataggctggtggcctaagtacagcattaatcattaaggaacccattactgccatttggaattcaaataacctaaccaacctccacctcctccttccattttgaccaaccttcttctaacaaggtgctcattcctactatgaatccagaataaacacgccaagataacagctaaatcagcaagggttcctgtattaccaatatagaatactaacaattttactaacacgtaagcataacaaatgacagggcaagtgatttctaacttagttgagttttgcaacagtacctgtgttgttatttcagaaaatattatttctctctttttaactactctttttttttattttagacagagtcttgctccgtcgcgcaggctgtgatcgtagtggtgcgatctcggctcactgcaacctccgctccctgggttcaagcgattctcctgcctgagcctcctgagtagctgggactacaggcacgtgccaccacgcccggctaattttttgtatttttagtagagatggggtttcacgttgttagccaggatggtctccatctcctgacctcatgatccgcccaccttggcctcccaaaatgctgggattacaggcatgagccactgcgcccggcctctttttagctactcttatgttccacatgcacatatgacaaggtggcattaattagattcaatattatttctaggaatagttcctcattcatttttatattgaccactaagaaaataattcatcagcattatctcatagattggaaaattttctccaaatacaatagaggagaatatgtaaagggtatacattaattggtacgtagcatttaaaatcaggtcttataattaatgcttcattcctcatattagatttcccaagaaatcaccctggtatccaatatctgagcatggcaaatttaaaaaataacacaatttcttgcctgtaaccctagcactttgggaggccgaggcaggtggatcacctgaggtcaggagttcgagaccagcctggccaacatggcgaaaccccttctctactaaaaatacaaaaattagctgggcgtggtagtgcatgcctgtaatcccagctacttgggaggctgaggcaggagaatcgcttgaacccaggaggtggaggttgcagtgagccgagattgtgccactgcactccaacctgggtgacagagtgagattccatctgaaaaacaaaaacaaaaacagaaaacaaacaaacaaaaaacaaaaaatccccacaactttgtcaaataatgtacaggcaaacactttcaaatataatttccttcagtgaatacaaaatgttgatatcataggtgatgtacaatttagttttgaatgagttattatgttatcactgtgtctgatgttatctactttgaaaggcagtccagaaaagtgttctaagtgaactcttaagatctattttagataatttcaactaattaaataacctgttttactgcctgtacattccacattaataaagcgataccaatcttatatgaatgctaatattactaaaatgcactgatatcacttcttcttcccctgttgaaaagctttctcatgatcatatttcacccacatctcaccttgaagaaacttacaggtagacttaccttttcacttgtggaattaatcatatttaaatcttactttaaggctcaataaataatactcataatgtctca

SEQ ID NO: 7946 - DNA, 3236 bp, Homo sapiens
aaagtctatacgcaataagtaagcccaaagaggcatgtttgcttggcgatgcccagcagataagccaggcaaacctcggtgtgatcgaagaagccaatttgagactcagcctagtccaggcaagctactggcacctgctgctctcaactaacctccacacaatggtgttcgcattttggaaggtctttctgatcctaagctgccttgcaggtcaggttagtgtggtgcaagtgaccatcccagacggtttcgtgaacgtgactgttggatctaatgtcactctcatctgcatctacaccaccactgtggcctcccgagaacagctttccatccagtggtctttcttccataagaaggagatggagccaatttctcacagctcgtgcctcagtactgagggtatggaggaaaaggcagtcagtcagtgtctaaaaatgacgcacgcaagagacgctcggggaagatgtagctggacctctgagatttacttttctcaaggtggacaagctgtagccatcgggcaatttaaagatcgaattacagggtccaacgatccaggtaatgcatctatcactatctcgcatatgcagccagcagacagtggaatttacatctgcgatgttaacaaccccccagactttctcggccaaaaccaaggcatcctcaacgtcagtgtgttagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcaacccaaccaccgggattttggtcattggaaatctgacaaattttgaacaaggttattaccagtgtactgccatcaacagacttggcaatagttcctgcgaaatcgatctcacttcttcacatccagaagttggaatcattgttggggccttgattggtagcctggtaggtgccgccatcatcatctctgttgtgtgcttcgcaaggaataaggcaaaagcaaaggcaaaagaaagaaattctaagaccatcgcggaacttgagccaatgacaaagataaacccaaggggagaaagcgaagcaatgccaagagaagacgctacccaactagaagtaactctaccatcttccattcatgagactggccctgataccatccaagaaccagactatgagccaaagcctactcaggagcctgccccagagcctgccccaggatcagagcctatggcagtgcctgaccttgacatcgagctggagctggagccagaaacgcagtcggaattggagccagagccagagccagagccagagtcagagcctggggttgtagttgagcccttaagtgaagatgaaaagggagtggttaaggcataggctggtggcctaagtacagcattaatcattaaggaacccattactgccatttggaattcaaataacctaaccaacctccacctcctccttccattttgaccaaccttcttctaacaaggtgctcattcctactatgaatccagaataaacacgccaagataacagctaaatcagcaagggttcctgtattaccaatatagaatactaacaattttactaacacgtaagcataacaaatgacagggcaagtgatttctaacttagttgagttttgcaacagtacctgtgttgttatttcagaaaatattatttctctctttttaactactctttttttttattttagacagagtcttgctccgtcgcgcaggctgtgatcgtagtggtgcgatctcggctcactgcaacctccgctccctgggttcaagcgattctcctgcctgagcctcctgagtagctgggactacaggcacgtgccaccacgcccggctaattttttgtatttttagtagagatggggtttcacgttgttagccaggatggtctccatctcctgacctcatgatccgcccaccttggcctcccaaaatgctgggattacaggcatgagccactgcgcccggcctctttttagctactcttatgttccacatgcacatatgacaaggtggcattaattagattcaatattatttctaggaatagttcctcattcatttttatattgaccactaagaaaataattcatcagcattatctcatagattggaaaattttctccaaatacaatagaggagaatatgtaaagggtatacattaattggtacgtagcatttaaaatcaggtcttataattaatgcttcattcctcatattagatttcccaagaaatcaccctggtatccaatatctgagcatggcaaatttaaaaaataacacaatttcttgcctgtaaccctagcactttgggaggccgaggcaggtggatcacctgaggtcaggagttcgagaccagcctggccaacatggcgaaaccccttctctactaaaaatacaaaaattagctgggcgtggtagtgcatgcctgtaatcccagctacttgggaggctgaggcaggagaatcgcttgaacccaggaggtggaggttgcagtgagccgagattgtgccactgcactccaacctgggtgacagagtgagattccatctgaaaaacaaaaacaaaaacagaaaacaaacaaacaaaaaacaaaaaatccccacaactttgtcaaataatgtacaggcaaacactttcaaatataatttccttcagtgaatacaaaatgttgatatcataggtgatgtacaatttagttttgaatgagttattatgttatcactgtgtctgatgttatctactttgaaaggcagtccagaaaagtgttctaagtgaactcttaagatctattttagataatttcaactaattaaataacctgttttactgcctgtacattccacattaataaagcgataccaatcttatatgaatgctaatattactaaaatgcactgatatcacttcttcttcccctgttgaaaagctttctcatgatcatatttcacccacatctcaccttgaagaaacttacaggtagacttaccttttcacttgtggaattaatcatatttaaatcttactttaaggctcaataaataatactcataatgtctcattttagtgactcctaaggctagtccttttataaacaactttttctgacatagcatttatgtataataaaccagacatttaaagtgta

SEQ ID NO: 7947 - DNA, 4946 bp, Homo sapiens
cggcaggagtaggctggcgggcgcagggggcggggtgcgccctccctccccggccagggcgctcgggagcggggacccgagcctgcagccgagctccgctgccggccctggacactcggctcagccaagcatccttcctgggggccgaggaagtggggccactctgccgttccgaggacctgggaggagccctcggtaccccgggccccggggccctggggcacacacgtccagcccagcccgagcctgcgtttcctgagccgggatctggggcgagatggccgcaggcggcagtgcgcccgagccccgcgtcctcgtctgcctcggggcgctcctggccggctgggtcgccgtaggattggaggctgttgtcattggagaagttcatgagaatgttactctgcactgtggcaacatctcgggactgaggggccaggtgacctggtaccggaacaactcggagcctgtcttccttctctcgtccaactctagcctccggccagctgagcctcgcttctctctagtggatgccacctccctgcacattgaatcgctgagcctgggagatgagggaatctacacctgccaggagatcctgaatgtgactcagtggttccaagtgtggctgcaggtggccagcggcccctatcagattgaggtccacatcgtggccaccggcacactccccaacggcaccctctacgcagccaggggctcccaggtggacttcagctgcaacagcagctccaggccaccacccgtggttgaatggtggttccaggccctgaattccagcagcgagtcctttggccacaacctgacagtcaactttttctcactgttactgatatcgccaaacctccaagggaactacacctgtttagccttgaatcagctcagcaagagacatcgaaaggtgaccaccgagctcctggtctactatccccctccatcagctccccagtgctgggcacagatggcatcaggatcgttcatgttgcagcttacctgtcgctgggatgggggataccctgaccctgacttcctgtggatagaagagccaggaggtgtaatcgtggggaagtcaaagctgggggtggaaatgctgagcgagtcccagctgtcggatggcaagaagttcaagtgtgttacaagccacatagttgggccagagtcgggcgccagctgcatggtgcagatcaggggtccctcccttctctctgagcccatgaagacttgcttcactgggggcaatgtgacgcttacatgccaggtgtctggggcctacccccctgccaagatcctgtggctgaggaaccttacccagcccgaggtgatcatccagcctagcagccgccatctcattacccaggatggccagaactccaccctcactatccacaactgctcccaggacctggatgagggctactacatctgccgagctgacagccctgtaggggtgagggagatggaaatctggctgagtgtgaaagaacctttaaatatcggggggattgtgggaaccattgtgagcctccttctgctgggactggccattatctcagggcttctgttgcattatagccctgtgttctgctggaaagtaggaaacacttccaggggacaaaacatggatgatgtcatggttttggtggattcagaagaggaagaggaggaggaggaggaggaggaggaagatgctgcagtaggggaacaggagggagcacgtgagagagaggagttgccaaaagaaatacctaagcaggaccacattcacagagtgaccgccttggtgaatgggaacatagaacagatgggaaatggattccaggatcttcaagatgacagcagtgaggagcaaagtgacattgttcaagaagaagacaggccagtctgaagaagaggatggtccatggttgtcttgctctgaaagcttggagagctacattgaagacgagctcttcattcagctttgactccacctgcacccctggcgggggcttgcactaacaatgtttgggtctcagcaaaaaacaaaaccaagcacacacatctttccttccatgtattgaaaaacattggtttgatttgctctaagttttcccaatgatgtttaaaagctttgagaaggaaagctgctttggtgtctgaggtgccacttctgctgtgaatcctggctttatccaggttgatctactgtgatagatgctgatttagagggaacagaggtcagggaagcactgggtcttggtgccttttgccgcttttttttttttttttttttttttttgagacggagtctccctctattgcccaggctggagtgcaatggcacgatcttggctcaccacaacttctgcctcccaggttcaagcgattctcctgcctcagccacggcaccttgcaaatatcagctccttggaacaggtgaagttccaggtaccaatgccaatcagaggaaggcagtttggttcaggctttggagttagaaacacctgaagttgaatctgggctctgttgcttccttctttcatgggctagagcacgactctttacctctctcttggcctcaatttcctcacctgtaaaatagatgaggaagctgctcacttattattgtctcgttctgaaagcttggaaagctacatcgaagatgagctcttcattcagctttgatttgacctgtacccctggtgggggattgcactggcaacatttgggtctcagcaaaaaaaccaagcacacacatctttccttccatttattgaaaaacatctttgtaagatccattcattgaaaaacataatccatttattgaaaaatatctttgtaagatcacctgctaaatatgaaaatctgacttgaatttgtactctttaaagttgcgtatctgctctagtgggcaggacctagggcttaaaggggaacttcctttctccatttctaagaactgggactctaaaatgagaagctggttgtctgaagtaaccctgcaggtgtggttggggaaggtctgttttcttggatgaaggaactaaactaagcatatcagagcactgtcttaaccagttttatttccctggagatagaattcttttaaaaagagttagggagctggtaataggaagtgcctttcattataactacattttgcagagcttcatatttatatacaagcctcctaggtgatacactgttagcttgcagactttcctatgcttcatttctcctgttgctttcaaagaaggcaggagacacgtttaataacggagtatctggtgataagaattgcttgggcaaaccagctcatctggactctttctcagtcttggaagtgggaagaggaaaacttgtttccttcctgcttcttaaggatattctgagggtacactgatcaataacactaaatttggaatgaaaataccatgtgatgagtttagcctgctgatgcttccagtagatccttgtatagtttcaagatttaagttttccgatttcatataaatttcttaaagtcgaggaccttataagggtgcaatggatgtttgctaaatatgaaaaactgacttgaatttgcactctttaatgttgcgtatctgctctagtgggcaggacctagggcttaaaggggaacttcctttctccaattctaggaactgggactctaaaatgagaagctggttgtctgaagtaaccctgcaggtgtggttggggaaggtctgttttcttggatgaagggattaaactgagcaaatcactagaagtatgccctgtcccctgctcagaacactggggagctcaagagtgggctgcaatgtgcacccctcaggaatagctgtgaattgcaggtctactggctttttgctttttgtcttttgctgcaaggtaccccacgtacttaaccattctcaacagtgtaaatcagtgtcattttagaatgagatactcagcttgcttctaaagtcactgaattactgagtgagtctctcctttagagtcttcggcaaccaaattccagaattgaagagtctactactcagaggcaacaagattaaaaaaagaaaacacaaaaactgttgaggtgaaaaaaaaaaaaaaccctagctaggaacacagagaatgttttgtaggatcactgggatattttccacaacttcctcttctctagcacacacatctgttgataggaaatatttgagggtttttccactaccaaatgggagcttcatggtcctggtgtcaaacactataaacctttgaccagctgagctgtgactgctgtcacatatctgagtcctgtgtgcacagtaatatcctgggtcaggtaaaatccaggtcttcaagttttaaggattttttgaagaattcgggcttctttaagacgatccatgcccaaatccacaagcttgttgacagtggattacagtttgtgtggcaaagtccaagttgttacactgtgctttaaaaaaaatcttatctgcatgtattgttaacttagagaccatgagatctatttatcaggaccaggaagatacacacttcaggtccattgcaactgacttttttcttgtttttctcaaaccctggtggagcctgggaagggggcctccacaattctgtggctttgatattagccccaattctcacaagcacatacaagccccataattgccgcaggaaaacacaagatggaaaattgcaataacccatgcactgagacttagaaaatcatccttactaggcaaaatgtattatgatgcaataagtgccaactgatatttctcacgttgggactggccaggaactgctgcaaagaaaaataagcagctccttctccattatttacattttaagatgtggtggggggaggttgggagaaattagttctgaggttatcatatgccttttttaaaagataatggaataaagctatttttaagtaa

SEQ ID NO: 7948 - DNA, 3679 bp, Homo sapiens
atggacaacccacaggctctgccactcttcctactcctggcctccttggtagggatcctcaccctcagagcctcttctggacttcagcaaaccaacttctcctctgccttctcttcagactcaaagagctcttcccaggggctgggtgtggaagttccctccatcaaacctcccagctggaaagttccagatcagttcctggattcaaaagcctctgctggaatctctgattccagctggtttcctgaggccctgagttccaacatgtctgggtccttctggtcaaatgtttctgctgagggccaagatttgagcccggtttcccccttctctgaaacccctggttctgaagtatttcctgatatttcggatcctcaagttcctgccaaagaccccaagccttccttcactgttaagaccccagcttcaaacatttctactcaagtctcccataccaaactgtctgttgaggccccagattcaaaattctccccggatgatatggatcttaaactctctgcccagagccctgaatccaaattttctgcagagacccactcagctgcaagctttccccagcaggtggggggcccactcgctgtgctggtggggaccaccatccggctccccctagtcccaatccccaaccctgggccccccacctctctggtggtctggcgccggggctcaaaggtgctggcagctgggggcctggggccaggggcacctctgatcagcctggaccctgctcaccgagaccacctgcgatttgaccaggcccggggggttctggagctcgcctctgcccagctggacgatgcaggggtctacacggctgaggtcatccgggcaggggtctcccagcagactcacgagttcacggtgggtgtgtatgagcccctaccccagctgtcggttcagcccaaggctccagagacagaggagggggcggccgagctccggctgcgctgcctggggtgggggccaggtcgcggggagctgagctggagccgggacggacgcgccctggaggcggcggaatcggagggagccgagacgccccggatgcgctcagagggcgaccagctgctcatcgtgcgccctgtgcgcagcgaccacgcccggtacacttgccgcgtccgcagccccttcggccacagggaggctgccgccgacgtcagcgtcttctacggcccggacccgccgaccatcacggtctcctcggaccgcgacgccgcgcctgcccgctttgtcaccgcgggcagtaacgtgaccttgcgctgcgccgccgcctcgcggccgcccgccgacatcacgtggagcctggcggacccggccgaggccgcggtgcccgcggggtcgcgcctcctgctgcccgcggtcggaccgggccacgcaggcacctacgcctgcctggcggcgaacccgcgtaccggccgccgccgccgctcgctgctcaaccttacagtggcggacctgccccccggggccccacagtgctcagttgaagggggtcccggggaccgcagcctccgcttccgctgctcgtggcccggcggggcccctgctgcctccctgcagttccagggtctccccgaaggcatccgcgccgggccagtgtcctctgtgctgctggcggccgtccccgcccacccccggctcagcggcgtccccatcacctgccttgctcgccacctggtggccacgcgtacctgcacagtcacgccggaggccccccgagaggtgctgctgcatccgctggtggcagagacacggttgggggaggcagaggtggcactggaggcctctggttgtcccccaccctcacgggcatcctgggcccgggaagggaggcccctggctccaggaggcgggagtcgcctgcggctcagtcaagatgggcggaaactccacatcggcaacttcagcctggattgggacctgggaaattactccgtgctgtgcagtggggcgctgggtgctggcggtgaccagatcaccctcattggaccctccatatcctcgtggaggcttcagagagccagagatgcagccgtgctgacttgggatgtggagcgcggggccctgatcagcagttttgagatccaggcatggccagatgggcctgctctgggcaggacttccacctacagggactgggtctccctgctcatcctggggcctcaggagcggtcagccgtggtgccccttccacctcggaacccagggacctggacctttcggatcctgcccatcctggggggccagccagggactccatcacaaagccgggtctaccgggccggccccacgttgagccatggggccatcgctggcatcgtcctgggctccctgctgggcctggcgctgctagccgtacttctcctcctttgcatctgctgcctgtgccgctttcgtggaaagactcctgagaaaaagaagcatccttctaccttggtccccgtggtcaccccctcagaaaagaagatgcatagtgtgaccccagtggagatttcatggcctctggacctcaaagtccctctggaggaccacagctcaactagggcctaccaagcacagaccccagttcagttgtctctgtaggcggaggctcaaagactgttcgcgcagccacacaggtgtgatcagagccagtggtctgccctgcacagggcgttttgggccagaacttcctatttcactccagcagcagccagggcctgctatgactgagggttggaccctgaaagtgggactttctgtctccctctcttgctgcagaagaagagtcttcctgtatttgtgcaagtaaggagatgtgacttcttggctgggaaactcttgctgatctaactgtgtggtttgcacaacctccaagcctctgcagcagacaggcagggcttgctgtgttgctctgagctagagagggagcttggccatgttctctgaaaaggtccccttacattcactttgccacctgtaggccacaccccatccagctcccagcatcttcatcttaaaacagatcagatcatgtcactcttctctttaaacgcttctacggcctgtgcatttcccttcagatattatccaaactcatcgtcgtgaccttcaaaaccttgtggtctggcctctgttggcctccctgacctcccctcccaattctttctctgcccccggactccagtatcacagtctgtctctcagccacaatttattttgcccctagagtttgctgtgcttataacacttctttttcccatatgtcattcatttctcaagtctaagagtagcagttaccatcttagacgaccgttcccttacccctcccttagtcttgggttaagtcccagaatccttgaatttgccgttcctgatacataaatatgtaatttcttgtgtggcctgagactctctctctaaactaagggctttacaaaagcagagaccacatcattaactcagcacttaacccagagcctcacacacagcaggcaatcaataaatatttgttgactgatcaaatgttttggtgccagtgaagagttgggcttgctgctgctgtcttcagcgtaagtcttgctttttcagctgggtttctaattgagaatttagagagtgcattggtgaggattcttttgactgcaagtaacaaaataaaatggtggcaagaactatg

SEQ ID NO: 7949 - DNA, 144 bp, Homo sapiens
atggacaacccacaggctctgccactcttcctactcctggcctccttggtagggatcctcaccctcagagcctcttctggacttcagcaaaccaacttctcctctgccctgcacagggcgttttgggccagaacttcctatttc

SEQ ID NO: 7950 - DNA, 1834 bp, Homo sapiens
atagggaaggaagggaagtaagcagtcacagacgctggcggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagggcacatgccagagaggccaacgactctggagaaaccatgagggtggccatcttcgcaagtggctgctccagtgatgagccaacttcccagaatctgggcaacaactactctgatgagccctgcataggacaggagtaccagatcatcgcccagatcaatggcaactacgcccgcctgctggacacagttcctctggattatgagtttctggccactgagggcaaaagtgtctgttaaaaatgccccattaggccaggatctgctgacataattgcctagtcagtccttgccttctgcatggccttcttccctgctacctctcttcctggatagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagcaa

SEQ ID NO: 7951 - DNA, 1474 bp, Homo sapiens
gaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaacactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagggcacatgccagagaggccaacgactctggagaaaccatgagggtggccatcttcgcaagtggctgctccagtgatgagccaacttcccagaatctgggcaacaactactctgatgagccctgcataggacaggagtaccagatcatcgcccagatcaatggcaactacgcccgcctgctggacacagttcctctggattatgagtttctggccactgagggcaaaagtgtctgttaaaaatgccccattaggccaggatctgctgacataattgcctagtcagtccttgccttctgcatggccttcttccctgctacctctcttcctggatagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctg

SEQ ID NO: 7952 - DNA, 716 bp, Homo sapiens
gatatagggaaggaagggaagtaagcagtcacagacgctggcggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccag

SEQ ID NO: 7953 - DNA, 1170 bp, Homo sapiens
agaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagcaa

SEQ ID NO: 7954 - DNA, 2190 bp, Homo sapiens
ggagtttgagtgagagatatagggaaggaagggaagtaagcagtcacagacgctggcggccaccagaagtttgagcctctttggtagcaggaggctggaagaaaggacagaagtagctctggctgtgatggggatcttactgggcctgctactcctggggcacctaacagtggacacttatggccgtcccatcctggaagtgccagagagtgtaacaggaccttggaaaggggatgtgaatcttccctgcacctatgaccccctgcaaggctacacccaagtcttggtgaagtggctggtacaacgtggctcagaccctgtcaccatctttctacgtgactcttctggagaccatatccagcaggcaaagtaccagggccgcctgcatgtgagccacaaggttccaggagatgtatccctccaattgagcaccctggagatggatgaccggagccactacacgtgtgaagtcacctggcagactcctgatggcaaccaagtcgtgagagataagattactgagctccgtgtccagaaactctctgtctccaagcccacagtgacaactggcagcggttatggcttcacggtgccccagggaatgaggattagccttcaatgccaggctcggggttctcctcccatcagttatatttggtataagcaacagactaataaccaggaacccatcaaagtagcaaccctaagtaccttactcttcaagcctgcggtgatagccgactcaggctcctatttctgcactgccaagggccaggttggctctgagcagcacagcgacattgtgaagtttgtggtcaaagactcctcaaagctactcaagaccaagactgaggcacctacaaccatgacataccccttgaaagcaacatctacagtgaagcagtcctgggactggaccactgacatggatggctaccttggagagaccagtgctgggccaggaaagagcctgcctgtctttgccatcatcctcatcatctccttgtgctgtatggtggtttttaccatggcctatatcatgctctgtcggaagacatcccaacaagagcatgtctacgaagcagccaggtaagaaagtctctcctcttccatttttgaccccgtccctgccctcaattttgattactggcaggaaatgtggaggaaggggggtgtggcacagacccaatcctaaggccggaggccttcagggtcaggacatagctgccttccctctctcaggcaccttctgaggttgttttggccctctgaacacaaaggataatttagatccatctgccttctgcttccagaatccctgggtggtaggatcctgataattaattggcaagaattgaggcagaagggtgggaaaccaggaccacagccccaagtcccttcttatgggtggtgggctcttgggccatagggcacatgccagagaggccaacgactctggagaaaccatgagggtggccatcttcgcaagtggctgctccagtgatgagccaacttcccagaatctgggcaacaactactctgatgagccctgcataggacaggagtaccagatcatcgcccagatcaatggcaactacgcccgcctgctggacacagttcctctggattatgagtttctggccactgagggcaaaagtgtctgttaaaaatgccccattaggccaggatctgctgacataattgcctagtcagtccttgccttctgcatggccttcttccctgctacctctcttcctggatagcccaaagtgtccgcctaccaacactggagccgctgggagtcactggctttgccctggaatttgccagatgcatctcaagtaagccagctgctggatttggctctgggcccttctagtatctctgccgggggcttctggtactcctctctaaataccagagggaagatgcccatagcactaggacttggtcatcatgcctacagacactattcaactttggcatcttgccaccagaagacccgagggaggctcagctctgccagctcagaggaccagctatatccaggatcatttctctttcttcagggccagacagcttttaattgaaattgttatttcacaggccagggttcagttctgctcctccactataagtctaatgttctgactctctcctggtgctcaataaatatctaatcataacagc

SEQ ID NO: 7955 - DNA, 1818 bp, Homo sapiens
actcattgcaccttcctgccaccccaggcagtgtctgggccctcagctccccctccctccacctaccccctcacacccaccactacgaccccacgggatacccagcccagacggaggaaacaccgagcctagagacatgagagttggaggagcattccaccttctactcgtgtgcctgagcccagcactgctgtctgctgtgcggatcaacggggatggacaggaggtcctgtacctggcagaaggtgataatgtgaggctgggctgcccctacgtcctggaccctgaggactatggtcccaatgggctggacatcgagtggatgcaggtcaactcagaccccgcccaccaccgagagaacgtgttccttagttaccaggacaagaggatcaaccatggcagccttccccatctgcagcagagggtccgctttgcagcctcagacccaagccagtacgatgcctccatcaacctcatgaacctgcaggtatctgatacagccacttatgagtgccgggtgaagaagaccaccatggccacccggaaggtcattgtcactgtccaagcacgacctgcagtgcccatgtgctggacagagggccacatgacatatggcaacgatgtggtgctgaagtgctatgccagtgggggctcccagcccctctcctacaagtgggccaagatcagtgggcaccattacccctatcgagctgggtcttacacctcccagcacagctaccactcagagctgtcctaccaggagtccttccacagctccataaaccaaggcctgaacaatggggacctggtgttgaaggatatctccagagcagatgatgggctgtatcagtgcacagtggccaacaacgtgggctacagtgtttgtgtggtggaggtgaaggtctcagactcccggcgtataggcgtgatcatcggcatcgtcctgggctctctgctcgcgctgggctgcctggccgtaggcatctgggggctcgtctgctgctgctgcgggggctccggggctggcggcgcccgcggtgccttcggctacggcaacggcggcggggtcggcggaggggcctgcggcgacttggctagtgagatcagagaggacgccgtggcgcccgggtgcaaggccagcgggcgcggcagccgcgtcacccacctcctggggtacccgacgcagaacgtcagccgctccctgcgccgcaagtacgcgcctcccccctgcggcggccccgaggacgtggccctggcgccctgcaccgccgccgccgcctgcgaagcgggcccctccccggtctacgtcaaggtcaagagcgcggagccggctgactgcgccgaggggccggtgcagtgcaagaacggcctcttggtgtgagcgcgcgcgccgggccgggctgcgccccagccaggaggagggcgcggggctctctgtctgcagctggggacacgtcggggctggggacgacctcgctcgccccaggctgccaggcggctgggggtgaaggcatttccctaaggaaatgcgtagggaggcagagcctcctccccaaaagtgggaaggggcgggcgagggcggaggaaggcgatcctgagccttctccgcacccccgggaccgaaggcttgggggagagggagggaggaggaggctgagtgtcctagagcggctgaggccggaggcctggtgtccccagcctaagcagagggccccgggggccgggtgggtgggggtctgtctggacgaattgttctgtgtgtgaggtctgagctctgaggcagcagtgttagcacaataaagaaacattgagacgtga

SEQ ID NO: 7956 - DNA, 2170 bp, Homo sapiens
acagcgccgggcggcggcggggagatgcggctgctggcactggcggcggccgcgctgctggcgcgggctccggctccggaggtctgtgcggccctcaatgtcactgtgtccccggggcccgtggttgactacctggagggggagaatgccactctcctctgccacgtctcccagaaaaggcggaaggacagcttgctggccgtgcgctggttctttgcacactccttcgactcccaggaggccttgatggtgaagatgaccaagctccgggtggtgcagtactatgggaatttcagccgcagcgccaaacggcggaggctgcgcctgctggaggagcagcggggggcgctctacaggctctccgtcttgacactgcagccctccgatcaagggcattacgtctgcagagtccaggaaatcagcaggcacaggaacaagtggacggcctggtccaatggctcctcagccacggaaatgagaggagtctccagccatccagtggagaggggagcttttcttgggatttcccttgtaatactacctcactctttgcccttcaccgcagacttaaccatggcctccttcctgcagagttcttgatgtgagataaaattgcttgtctttcactggaaactcccagaaagaaaggctggtgcctggtctctcctcatttccctgtcatgaacacctcgcccagcacatggagggtgacttgcgatgatatatttaaaaaataactcccagttctgagaagagccataggagtgttggctcttattatctgtcctgatttccatatgttggttgttttctattgcaaaagtaatatagtgtaatatagttcaattatagaaaacatggaaaaatactgaaagggtttaaagaagaaaataaaaatgacttaccatatctctactcaacttaacatttcagtgcaaatccttcctgtcattttatgcaaattaaaatttaaaacctaatttcaatcttactgtaaagagtgttctgtgactcgcttttctgatattactaaatagtgtgcacattttcccttgttaaatatgcctcaaaaacataatgttaatgatggaataatgttccatcatgcaggtggacctcaatttagcttcctgcttattgttactggacatttgaagctgctgtaaatctttgtcaataaatctccatgaatatccctgaccttagcataaaatcctggaaataagattgccgggtccaaagatctacccaaattaaaaatggacacaatttcaagaagtgaattgacctctaaaatagtttacaaatttatattaccaccagcattgaaaatgccttttccccacggattggtctacataagagtgttggttaattttatgtgttgacttgactaggctaaacgatgcccagatagcaggtaaaacattatttctgggtgtgttcgttctgtttctctgggatcccagactaacacaatcatatactttttgaggatgatgatgataacaatgaatgcctgcaacagtgcctggtacacagttgatcctcaatagatacttgatgaatgaataaaatgttctttgtcaagtgtcattagcaactgttgctgtggatgactttgaagtaggcgtgacttggtggatgtagtcaccctctctgggatgccttacctctctttcccttgacctatttcaatcatacatattttttggggctccacatccagctttcatcttccatcaatgccttctttgggcatgccagcccatggagtgctctcccactggcaacatcttgtagcttctgtttttagcactgtagacacaacattatgtggtcatgccgttgtttttcaagctgctgtggcacagtgatgatgtcaaaaatattatacataaaagagttggccaggcatggtggcttacgcctgtaatcccagcactttgggaggccgaggtgggtggatcacgaagtcaagagttcaagaccagcctggccaacatggtgaaaccccatctctacaaaaatacaaaaattagccaggtgtggtggtgtgcacctgtaatcccagctactcgggaggctgagatgaagaattgcttaaacccaggaggcaaaggctgcagtgagccaagatcccgccactgcactccagcactccgctctc

SEQ ID NO: 7957 - DNA, 2192 bp, Homo sapiens
acagcgccgggcggcggcggggagatgcggctgctggcactggcggcggccgcgctgctggcgcgggctccggctccggaggtctgtgcggccctcaatgtcactgtgtccccggggcccgtggttgactacctggagggggagaatgccactctcctctgccacgtctcccagaaaaggcggaaggacagcttgctggccgtgcgctggttctttgcacactccttcgactcccaggaggccttgatggtgaagatgaccaagctccgggtggtgcagtactatgggaatttcagccgcagcgccaaacggcggaggctgcgcctgctggaggagcagcggggggcgctctacaggctctccgtcttgacactgcagccctccgatcaagggcattacgtctgcagagtccaggaaatcagcaggcacaggaacaagtggacggcctggtccaatggctcctcagccacggaaatgagagtcatttccctcaaagcttctgaagagtcatcctttgagaaaacaaaagagacttgggcattttttgaagatctctatgtgtatgctgtcctcgtgtgctgcgtggggatcctcagcattctgctcttcatgctggtcatcgtctggcagtctgtgtttaacaagcggaaatccagagtgagacattatttggtgaaatgccctcagaacagctcaggggagactgtcactagcgtgaccagcttggccccactacagcccaagaagggcaagaggcagaaggagaagcctgacattcctcccgcagtccctgccaaagctccgatagcccccacgttccataaaccgaagctgctgaaaccacagagaaaagtcacgctgccaaagattgctgaggaaaacttaacctatgccgaactggagctgatcaaaccccaccgggctgccaaaggcgcccccaccagcactgtctacgcccagatcctcttcgaggagaacaagctgtagtacagcgtccacctccaaggttctatttaatacctgccacccagtgatttatgaagccttggagacaaagcccttatgtctgtattttcactcatgccttctgagtggtggggagccccttttcagcagcattctgggtgcctttgaagaggtacaagcctgctctccccaaaagaatcggggccacagctcttgacagatctcccgggacaagatgcgcctgggtttgagccctgagcgtaaggattctgatcctgagagcagccaaggagattttctgctgagccaaaccccttcacatttttctcctctttccccaggttttctttaaaatcgtttttaaatcttaattttactctctactcttcctgtatccacgatacaagctcacagtatatagctagaggaaatgccattatggacccaactgtaagatggcacatatgttggttttccaaggatcagatggcattgccagggccacagccaactgctgattgccagcaccacctgagatggcatctcttgttttaaatagatgcactaaccctgaagattaaggccagaggggcagactgactagagaagtataaggtctgtctctgaatgccatggtgcccacctatgagaccctgaggccgcaggacaagaagaacaccattctagagggcttccagccctttcacaaggtggacctgtactgatagagaaacacactctctaagaagtgcttactcacccttttccaaaggagcacaggtgttggccatcagaagacacactggagcgcatgggcctcttcactgtgtgccaagctcagtcacctctgattcagcccctgaaggtgtctgctgccaggtgccctcagggtaggagagtgggaagtacacgccaagctggaaagtgtgttctgaagaccctcctcttgccaagtgccttgcccattgcaaccttgtgtgtgaattctaatgggtttgaatgggggtcagggtgcatggggaagttgctctgtggacctttgggacacaggaatcttggacttactggcaggggatccattctgaaagcaccatcctgtcaactgtgttattgaggacatttcttgatgtgagtatagtctgggtggctatttactgcccactatagaaattgtttgactatgtagtggaccatgtatatatgataaattatctattttaaacaca

SEQ ID NO: 7958 - DNA, 2969 bp, Homo sapiens
ccccggcccgcgaggccccgggctcgcccatgaggcctctgcccagcgggaggaggaagacccgaggcatctccctaggactcttcgccctctgcctggccgcagcccgctgtctgcagagtcagggtgtgtccctatacattcctcaggccaccatcaatgccactgtcaaagaagacatcctgctctcagttgagtactcctgtcatggagtgcccaccatcgaatggacatattcatccaattggggaacgcagaagatcgtggagtggaaaccagggactcaggccaacatctctcaaagccacaaggacagagtctgcacctttgacaacggctccatccagctcttcagcgtgggagtgagggattccggctactatgtcatcaccgtgacggagcgcctggggagcagccagtttggcaccatcgtgctgcacgtctctgagatcctctatgaagacctgcactttgtcgctgtcatccttgcttttctcgctgctgtggccgcagtattaatcagcctcatgtgggtttgtaataagtgtgcatataaatttcagaggaagagaagacacaaactcaaagaaagcacaactgaggagattgagctggaagatgttgagtgttagccaaggctgggcctgactgcattcctacctcaagaggaaaccattctccaacaaaaagagcaagcacagctattatacccattgtgtgtggtcctgttgcagcccgctcctaacaggacagtgggagattaacaacattgactgcatggagttgaggactgtggatgggacaaagctagtattaggactcgcgctaagttcaaggagaagagtgattgaggctttgaaccaggagcttcgcttggctgcagcatcagggccgtgctgacacataaccaatgggtgagtgcaggcgttggctgcttgctcacgacacttgctctggtgtgcaggatggcctgttgtcagagtccctgtatcagaggccagaggatttccagatggatgtgcagccagcattagaacatgctttctgtgctcctgtctgctctgcaactgctgtgccaaccagccccccatctggtatcccacaagcaagcactgctgtgggagctattgtgagaaaacctgaggcttttagacaatctgctgcctcagagcagaggtggaaagagactgggggtgggggttggtgctgttgtgctgcagagtttttcattggtgaggcccggtggctgggagttttatgggagaggagctcaatggactcctgagaggccagctttggatacaaggaatagagaaaattatctttctcttcctccctcattccaacgttaattggattttccctcccatggctcaaacttaggccattgtaagtaaaacaacagctcatctccattatgggcagcacctggcctcctgacgagctggatgccacctgtgtgaaagctgagcttgcatagtgggtgatgcagctggaaaatcagtcatctcgggctttgcatctgtccccctcagtcactaacacttcacgtctcaagtcaggcccttgccctctcctacctgggctgaggaacgcttggcccttgcctacctcacagtcagagtatcaagagaagcccacagtatgcacagagttctctgagcaacttacgaaatgcatgaggcttcttcaaggatctggaaagctatactggaaaacgctattctgagtattagaaattgataaaatcctctgaggtcttggggctccaggtgagattggggactggaccacagctggccttggccattattccctcaggttgttggtcaccatgttcacctgtaagtttctccatcccaacttccatttgacaagctctaaaagcaggcatggatttattttccattctcttatctctccaatattcatagctacagaccaaaggtaccatccgatgatgatgtgttcctagtcctcagttgcaaattcacccatgcaaaggttaagaagtcttagaacattcctttctcttcttcctcctttcaggcctccaatgtccatatcttctctatttcctatgtggcagaggagttgcttggataagttacagccctttccctcaatattgaatccagagttttgggaagggatctctcagaatattcagacaggaactctcagtatccagagcaggactcccaaggcactgcttgattcaaaaggcgacagcagttggtctacacaacggatgtgtagctctagcacctgacaggtagaagataccctcaaggcgcctcctgtagacacacgggtaaactcacacactatgtcctatccccacgcagcagtcggaggaaccaggctctgggccaggacagtttccagtgctgtgaagaaacgaggtgagcagtatccaaggggctcaaggataatctgctgatttctttcttgtctttcacacagagaggccaccagcaggaaagcagtgggagttgggtagctgctggggccagcatgtcctcttccacactacctgcctttcagaactctgctcttccgcttgtcccgaagtcagggctggcaatcttcataatcaaaggggagttggaaaagaacacccactaagaggcctccatggcagatgtcaattaaattgcccccccgcccaaatctcatgacagtttattcacatcagtagtgtgggaagttacaatgttttttttaaaaaaagcttctttccttggctttccatttctttgaaaaaagggtttcttttgaatttttaaagctctgccatactgaacattcctgtggaaaggtttaaaatgcagagcctgaggtttttgcttttcagaaaaataaaaatcttagagattagctagtgtaaatgttaagctataaattatatttcaaactgtgaaaaaaaaaagttttaaagaatgaatgaaataaaacctgaaaataaa

SEQ ID NO: 7959 - DNA, 2257 bp, Homo sapiens
gtgagtcaccaaggaaggcagcggcagctccactcagccagtacccagatacgctgggaaccttccccagccatggcttccctggggcagatcctcttctggagcataattagcatcatcattattctggctggagcaattgcactcatcattggctttggtatttcagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgcctcggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggcgacaccgattttataaataaactgagcaccttctttttaaacaaacaaatgcgggtttatttctcagatgatgttcatccgtgaatggtccagggaaggacctttcaccttgtctatatggcattatgtcatcacaagctctgaggcttctcctttccatcctgcgtggacagctaagacctcagttttcaatagcatctagagcagtgggactcagctggggtgatttcgccccccatctccgggggaatgtctgaagacaattttggttacctcaatgagggagtggaggaggatacagtgctactaccaactagtggatagaggccagggatgctgctcaacctcctaccatgtacaggacgtctccccattacaactacccaatccgaagtgtcaactgtgtcagggctaagaaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagaccctgcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctacacca

SEQ ID NO: 7960 - DNA, 2581 bp, Homo sapiens
ctgcaattgtgtccggaatttattccttctggtgggttcatggtcttgctgacttcaagaatgaagccgctgacctcgcgcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgcctcggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggcgacaccgattttataaataaactgagcaccttctttttaaacaaacaaatgcgggtttatttctcagatgatgttcatccgtgaatggtccagggaaggacctttcaccttgtctatatggcattatgtcatcacaagctctgaggcttctcctttccatcctgcgtggacagctaagacctcagttttcaatagcatctagagcagtgggactcagctggggtgatttcgccccccatctccgggggaatgtctgaagacaattttggttacctcaatgagggagtggaggaggatacagtgctactaccaactagtggatagaggccagggatgctgctcaacctcctaccatgtacaggacgtctccccattacaactacccaatccgaagtgtcaactgtgtcagggctaagaaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagaccctgcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctacacca

SEQ ID NO: 7961 - DNA, 258 bp, Homo sapiens
gctacactgaggaacaagcttatgtggaacataattagcatcatcattattctggctggagcaattgcactcatcattggctttggtatttcagaagtctctgtctggctttcagcaatgaagggttgtagaagttccaaggcttcccttagcattgatctttgcttcctgaactgcagggagacactccatcacagtcactactgtcgcctcagctgggaacattggggaggatggaatcctgagctgcacttttga

SEQ ID NO: 7962 - DNA, 2612 bp, Homo sapiens
gctggttgtgagtcaccaaggaaggcagcggcagctccactcagccagtacccagatacgctgggaaccttccccagccatggcttccctggggcagatcctcttctggagcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgcctcggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggcgacaccgattttataaataaactgagcaccttctttttaaacaaacaaatgcgggtttatttctcagatgatgttcatccgtgaatggtccagggaaggacctttcaccttgtctatatggcattatgtcatcacaagctctgaggcttctcctttccatcctgcgtggacagctaagacctcagttttcaatagcatctagagcagtgggactcagctggggtgatttcgccccccatctccgggggaatgtctgaagacaattttggttacctcaatgagggagtggaggaggatacagtgctactaccaactagtggatagaggccagggatgctgctcaacctcctaccatgtacaggacgtctccccattacaactacccaatccgaagtgtcaactgtgtcagggctaagaaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagaccctgcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctacacca

SEQ ID NO: 7963 - DNA, 1441 bp, Homo sapiens
ctggtaatctgtggcgtaacaagacctccaggtgattctctgtattagcagccgctctgtgctccctgattcctccagaaaagcacaaggatttaatccagatagatataaatttcacctgggatcatttatcattccacattcttctttaagaaatgtgctaaagagccacagatgggtcttgatgaaaacaaaggaaaagccatgaagtttctacagcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgcctcggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctct

SEQ ID NO: 7964 - DNA, 2431 bp, Homo sapiens
aaggagatggtgctcttcttttttctttctgaattgtggccaccttcataccagtctgtcatggaacacttaagccgcttgagtgtctgctggtactcccagccctgccatgcctgagccccctgcacacaaggagccaggagtaatcagggcagacccattagggcacggggacttctggattgtgaaattggctctctgggggccaaggccttctaacgttggtggaagtggctttggcttattgggtcggattctaggccattcgttccaacctttagagacatcccagctttccctagcccagagtctgcagcccctccaccatcccacatcctccccctccctttcctcatgaaccccagtcgcgcctctgccttctcaaacccctccaccatcccacaccctcctcctgcccttcctcatgaaccccagtcgcgcctctgccttctcatccctgcgcaccacacaggctcgctcgtgcccggtgaatgctgaggctgctctgcacgtggagtgtggccctgtgggcaagggctgggctcttggaggtaggggagctacaggggcgactgggaggaggatgttgtgttacacacgcatcagagttaactttgcagtgagagcggccttgctgcggccaaagaacatggaaaagcatgagtggggtgatgtgccttaaagcatcagacacttgggcctcgggcatcaggagccagccacagggatgtctggggaaatggcgttccatgagatgcaagcacacaagaatgcacttggcacatctggggaacagcaggcagctgatatcactgggcccaccccgcaccagggaggatggaagcaggatctcccagcaggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcaccgacgcccaggaccctggcctgcagagacgcccccgccacaggatccagagcaagcagcgccccctggacgagcgggccctgcaagagaagctgaaggactttcctgtgtgcgtgagcaccaagccagagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaaggtagacctacaagatggggtactaacaccacccccaccgcccccaccaccacccccagctcctgaggtgctggccagtgcacccccactcccaccctcaaccgcggcccctgtaggccaaggcgccaggcaggacgacagcagcagcagcgcatctccttcagtccagggagctcccagagaagtggtcgacccctccggtggctgggccactctgctagagtccatccgccaagctgggggcatcggcaaggccaagctgcgcagcatgaaggagcgaaagctggagaagcagcagcagaaggagcaggagcaagtgagagccacgagccaaggtgggcacttgatgtcggatctcttcaacaagctggtcatgaggcgcaagggcatctctgggaaaggacctggggctggtgacgggcccggaggagcctttgcccgcgtgtcagactccatccctcctctgccgccaccgcagcagccacaggcagaggacgaggacgactgggaatcgtagggggctccatgacaccttcccccccagacccagacttggccgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttctcttaagaggcttccagagaaaacggcacaccaatcaataaagaactgagcagaaaccaacagtgtgcttttaataaaggacctctagctgtgcagga

SEQ ID NO: 7965 - DNA, 1213 bp, Homo sapiens
tccctgcgcaccacacaggctcgctcgtgcccggtgaatgctgaggctgctctgcacgtggagtgtggccctgtgggcaagggctgggctcttggaggtaggggagctacaggggcgactgggaggaggatgttgtgttacacacgcatcagagttaactttgcagtgagagcggccttgctgcggccaaagaacatggaaaagcatgagtggggtgatgtgccttaaagcatcagacacttgggcctcgggcatcaggagccagccacagggatgtctggggaaatggcgttccatgagatgcaagcacacaagaatgcacttggcacatctggggaacagcaggcagctgatatcactgggcccaccccgcaccagggaggatggaagcaggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcaccgacgcccaggaccctggcctgcagagacgcccccgccacaggatccagagcaagcagcgccccctggacgagcgggccctgcaagagaagctgaaggactttcctgtgtgcgtgagcaccaagccagagcccgaggacgatgcagaagagggacttgggggtcttcccagcaacatcagctctgtcagctccttgctgctcttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccggcattgccaacgacctcatgtacattgccgacctgggccccggcattgccccctctgcccctggcaccattccagaactgcccaccttccacactgaggtagccgagcctctcaagacctacaagatggggtactaacaccacccccaccgcccccaccaccacccccagctcctgaggtgctggccagtgcacccccactcccaccctcaaccgcggc

SEQ ID NO: 7966 - DNA, 1604 bp, Homo sapiens
atggcgttccatgagatgcaagcacacaagaatgcacttggcacatctggggaacagcaggcagctgatatcactgggcccaccccgcaccagggaggatggaagcaggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgcttttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccagcattgccaacgacctcatgtacagtgccgacctgggccccggcattgccccctctgcccctggcaccattccggaactgcccaccttccacactgaggtagccgagcctctcaaggcagacctacaagatggggtactaacaccacccccaccgcccccaccaccacccccagctcctgaggtgctggccagtgcacccccactcccaccctcaaccgcggcccctgtaggccaaggcgccaggcaggacgacggcagcagcagcgcgtctccttcagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctgtgcccccaccgcaacagccacaggcagaggaggacgaggacgactgggaatcctagggggctccatgacaccttcccccccagacccagacttgggctgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaac

SEQ ID NO: 7967 - DNA, 2384 bp, Homo sapiens
aaggagatggtgctcttcttttttctttctgaattgtggccaccttcataccagtctgtcatggaacacttaagccgcttgagtgcctgctggtactcccagccctgccatgcctgagccccctgcacacaaggagccaggagtaatcagggcagacccattagggcacggggacttctggattgtgaaattggctctctgggggccaaggccttctaacgttggtggaagtggctttggcttattgggtcggattctaggccattcgttccaacctttagagacatcccagctttccctagcccagagtctgcagcccctccaccatcccacatcctccccctccctttcctcatgaaccccagtcgcgcctctgccttctcaaacccctccaccatcccacaccctcctcctgcccttcctcatgaaccccagtcacgcctctgccttctcatccctgcgcgccacacaggctcgctcgtgcccggtgaatgctgaggctgctctgcacgtggagtgtggccctgtgggcaagggctgggctcttggaggtaggggagctacaggggcgactgggaggaggatgttgtgttacacacgcatcagagttaactttgcagtgagagcagccttgctgcggccaaagaacatggaaaagcatgagtggggtgatgtgccttaaagcatcagacacttgggcctcgggcatcaggagccagccacagggatgtctggggaaatggcgttccatgagatgcaagcacacaagaatgcacttggcacatctggggaacagcaggcagctgatatcactgggcccaccccgcaccagggaggatggaagcaggatctcccagcaggtagagcagagccggagccaggtgcaggccattggagagaaggtctccttggcccaggccaagattgagaagatcaagggcagcaagaaggccatcaaggtgttctccagtgccaagtaccctgctccagagcgcctgcaggaatatggctccatcttcacgggcgcccaggaccctggcctgcagagacgcccccgccacaggatccagagcaagcaccgccccctggacgagcgggccctgcaggagaagctgaaggactttcctgtgtgcgtgagcaccaagccggagcccgaggacgatgcagaagagggacttgggggtcttcccagcaacatcagctctgtcagctccttgctgcttttcaacaccaccgagaacctgtacaagaagtatgtcttcctggaccccctggctggtgctgtaacaaagacccatgtgatgctgggggcagagacagaggagaagctgtttgatgcccccttgtccatcagcaagagagagcagctggaacagcaggtcccagagaactacttctatgtgccagacctgggccaggtgcctgagattgatgttccatcctacctgcctgacctgcccagcattgccaacgacctcatgtacagtgccgacctgggccccggcattgccccctctgcccctggcaccattccggaactgcccaccttccacactgaggtagccgagcctctcaaggcagacctacaagatggggtactaacaccacccccaccgcccccaccaccacccccagctcctgaggtgctggccagtgcacccccactcccaccctcaaccgcggcccctgtaggccaaggcgccaggcaggacgacggcagcagcagcgcgtctccttcagtccagggagctcccagggaagtggtcgacccctccggtggctgggccactctgctagagtccatccgccaagctgggggcatcggcaaggccaagctgcgcagcatgaaggagcgaaagctggagaagaagaagcagaaggagcaggagcaagtgagagccacgagccaaggtgggcacttgatgtcggatctcttcaacaagctggtcatgaggcgcaagggcatctctgggaaaggacctggggctggtgaggggcccggaggagcctttgcccgcgtgtcagactccatccctcctgtgcccccaccgcaacagccacaggcagaggaggacgaggacgactgggaatcctagggggctccatgacaccttcccccccagacccagacttgggctgttgctctgacatggacacagccaggacaagctgctcagacctgcttccctgggagggggtgacggaaccagcactgtgtggagaccagcttcaaggagcggaaggctggcttgaggccacacagctggggcggggacttctgtctgcctgtgctccatggggggacggctccacccagcctgcgccactgtgttcttaagaggcttccagagaaaacggcacaccaatcaataaagaactgagca

SEQ ID NO: 7968 - DNA, 14247 bp, Homo sapiens
gcggccgcagaatcgagctcgggccccggcccccggcccgcggcgcggggctcccgggccccgccgcggacgtcgcgccggtcgccccttccccgtagcccgtgcgccctcggcgcggagccccggcccgccgcggtcccgtctcctgggcctgtcccgcccgcgccctccgccggccctcaggtataatacttctccacgtctgcttcaggaagaaagtgcctgccattcttatcatttctaagcaggttcatgccagcccagaacagagaatcagctggagcccagatttcaagttttgagtaaaataccttcaagcgaatgggccctattgtgctcacacattcagaacctgttacccaaggaattccctaaagaattagaagtgcgtctcaccaaccagccaagatgaacatggtgaagaggatcatggggcggccgaggcaggaggagtgcagcccacaagacaacgccttaggactgatgcacctccgccggctcttcacggagttgtgccatcctccccggcacatgactcagaaggaacaagaagagaaactgtatatgatgctgccagtgtttaacagggtttttggaaatgctccgccgaatacaatgacagaaaaattttctgatcttctgcagttcacaacacaagtctcacgactaatggtgacagaaattcgaaggagagcatcaaacaaatccacagaggctgcaagtcgggccatagttcagttcctagagattaatcagagtgaagaagccagtagaggctggatgcttctaacgacaattaatttgttagcttcctctggtcagaaaaccgtggactgcatgacaacaatgtcagtgccttccaccctggttaaatgtttatatctgttttttgaccttccacatgtgcctgaggcagttggaggtgcacagaatgagctacctctagcagaacgtcgaggactactccagaaagtttttgtacagatcttagtgaaactgtgcagttttgtttcccctgcggaggagctggctcagaaagatgatctccagcttctattcagtgcaataacctcttggtgccctccctataacctgccttggagaaagagtgctggagaagtcctcatgaccatatctcgtcatggtcttagtgtcaatgtagtgaagtatattcatgagaaagagtgtttatctacatgtgttcagaatatgcagcaatcagatgacctgtctcccctagaaattgtcgaaatgtttgctgggctttcttgtttcctcaaagattccagcgatgtttcccaaacacttctggatgattttcggatatggcaaggatataattttctttgtgatctcttgcttagattggaacaagcaaaagaggcagaatccaaagatgccttgaaagatctggttaatctgataacttccctaacaacatatggtgtcagtgaactaaaaccagctggtattaccacaggggcaccctttttattgcctggatttgcagtacctcagcctgcaggcaaaggtcacagtgtgagaaacgtccaggcctttgcagttcttcagaatgcatttttaaaagcaaaaaccagcttccttgcccaaatcatccttgatgctatcacaaatatttacatggctgacaatgccaattacttcatcctagagtcacagcacacattgtcacagtttgcagagaagatttctaaactcccagaagtacaaaacaaatactttgagatgctggagtttgttgtttttagcttaaattatataccttgtaaagaacttattagtgtcagtatcctcttaaaatctagctcttcttatcactgtagcattattgcaatgaaaacacttcttaagtttacaagacatgactacatatttaaagacgtgttcagggaggttggccttttggaggtcatggtaaaccttttgcataaatatgctgccctgttgaaggatccaactcaggcactaaatgaacaaggggactcaagaaataatagttcagttgaagaccaaaaacacctggctttattggttatggagaccttgacagtgcttcttcaaggatcaaacacaaatgcaggaatttttcgagaatttggaggtgcaagatgtgcacataatatagtaaagtaccctcaatgccggcagcatgccttgatgactatccaacagctggtgctctccccaaatggggacgatgacatgggcactctcctggggctaatgcattcagccccaccgacggaattgcagttgaagactgatattttaagggccctcctgtcggtccttcgagaaagccatcgttcaagaacagtttttaggaaagttggaggatttgtgtacattacatccttgctcgttgctatggaaagatctttgagctgtccacccaagaatggctgggagaaagtgaaccagaatcaagtgtttgaacttcttcacactgtgttctgcacgttgactgcagcaatgcgctatgagccagccaactctcatttcttcaaaacagagattcagtatgagaagttggcagatgctgttcgatttcttggctgcttctcagacctaagaaaaataagcgccatgaatgtcttcccctcaaatacacagccatttcaaagacttttagaggaagatgtaatctcaatagaatcagtgtcacccacgttacggcactgcagtaaactttttatttatctttacaaagtagccacagattcttttgacagtcgtgcagaacagatccctccttgcctgacaagtgagtcttctctcccctctccttggggtacaccagctttgtccaggaaaaggcatgcatatcattctgtttcaactccccctgtttaccctcctaaaaatgttgccgacctgaaactacatgtgacaacttcatctctgcagagttctgatgcagtcatcattcatcctggagccatgcttgccatgctggacctactggcctctgttgggtcagtgacacagccagaacatgctttggatcttcaacttgccgtggcaaatattttacaatccctggtgcacacagaaaggaaccagcaagtcatgtgtgaagctggtcttcatgcacgactgctgcagaggtgcagtgctgcattggctgatgaggaccactcactgcacccgcccctgcagcggatgtttgaacgattagcctctcaggctctggaacccatggtgttgagggagtttttacgtttggcaagtcctttaaattgtggtgcctgggacaaaaaactgctaaaacaatatagggtccacaaaccaagttcactgagttatgaaccagaaatgagaagtagtatgatcacatctctggaaggtctgggtactgataatgtttttagcttacatgaagataaccattaccggataagcaagagcctggtaaaatctgcggaaggaagtactgtacccctgaccagggtgaagtgtctggtctccatgacaaccccacatgacatcagacttcatgggtcatcagttactccagcttttgttgaatttgacacatcacttgaagggtttggatgtctttttttgcccagtttggcccctcataatgctcctacaaataataccgtcacaacaggtcttattgatggggctgtggtcagtggcattggttctggtgaaagattcttccctcctccctccggcttaagttactctagctggttttgtattgaacattttagttctcctccaaataaccaccctgtcagacttcttactgttgtgcgccgagcaaattcttctgagcaacattacgtgtgccttgcaatagttctatcagcaaaagaccgatctctgattgtttccaccaaagaggaactcctccaaaattatgttgatgattttagtgaagagtcctcattttatgaaattctcccatgctgtgctcgctttcgatgtggagagcttatcattgagggacagtggcatcatttggtcctggtaatgagcaaaggcatgttgaaaaacagtactgcagccctttatattgatggacagcttgttaacactgtaaagcttcattatgtccacagtactccagggggttcaggttcggcaaatccaccagtggtgagcacggtctatgcctacattggtactccacctgcccaacgccaaattgcctcattggtttggcgcctgggacccacacattttctagaagaagttttaccttcttcaaatgttactaccatttatgaacttggaccaaattatgttggaagctttcaggctgtatgtatgccatgtaaagatgcaaaatccgaaggggtggtgccatcccctgtgtcattagtaccagaggagaaagtgtcatttggcctctatgcactctctgtgtcgtctctaacagtggcaagaatccggaaagtgtataacaaattggatagcaaagccattgctaagcagttaggcatttcctcacatgagaatgccactcctgtgaagttgatacacaattcagcaggacatcttaatggatctgcacggacaattggggccgctctgattggatacttgggagtaagaacatttgtccctaagcctgttgccactactttgcagtacgttggtggagctgcagccatcctgggcctggtggccatggcctctgatgtggaagggttatatgcagcagtcaaggccctggtttgtgtggtcaagagtaacccactagccagcaaagaaatggaaagaatcaagggctaccagttgctggcaatgttgcttaagaagaaacgttcccttcttaacagccacatcctccatctaactttttctttggtgggaactgttgatagtggacatgagacctccattattccaaattcaactgctttccaggacctcctctgtgattttgaagtctggctccatgcaccatatgaacttcatctttccttatttgaacactttattgaactgctcacagagtccagtgaagcctcaaagaatgccaaattaatgagagaattccagttaatcccaaagctgctcctgactcttcgagatatgtctttatcccagcctactattgctgctattagtaatgtcctgagcttcttactgcaaggttttcctagcagcaatgatctgctcagatttgggcagtttatttcttctactttgccaacctttgcggtttgtgagaaatttgtagtaatggaaataaataatgaagagaagcttgacactggaactgaagaggagtttggaggtcttgtatcagctaatcttatacttttgaggaacagacttctggatatcttgctaaaactaatttatacatctaaagaaaagacaagcattaatttgcaagcttgtgaagaactggtgaagacactgggttttgactggatcatgatgtttatggaggaacacttacattccaccacagttacagcagccatgaggattcttgttgtcctactaagtaatcagtctattctcatcaagtttaaagaaggactcagtggtggaggatggcttgaacagacagattctgtcttaactaataagattggaactgtattaggattcaacgtgggcagaagtgctggtgggagatcgacggtcagggagattaaccgagatgcttgtcattttcctggttttccagtccttcagtcattccttcctaaacacactaatgtccctgccctctattttctcctcatggccttgtttctgcagcagccagttagtgagctgcctgagaacctgcaggtcagtgtgcctgtcatcagctgccggagtaagcagggttgccagtttgatttggattccatttggacattcatctttggagttcctgcctccagcggaactgtggtctcttctatccataacgtatgcacagaagctgtttttttattattgggaatgctccgcagcatgctgacttcaccttggcaatcagaagaagagggatcttggctccgagaatatcctgtgaccctgatgcagttcttcagatatttgtatcacaacgtgccagaccttgcctccatgtggatgagccctgacttcctgtgtgcattagcagccaccgtcttccccttcaatattcgcccttactcagagatggtgactgaccttgatgatgaagttggatctccagcagaagagtttaaagcgtttgcagcagacacagggatgaacaggagccaatcagagtactgcaatgtgggcaccaagacatatctgaccaatcacccggctaaaaagttcgtttttgacttcatgcgggtcttaatcatagacaacctctgtctcactcctgccagcaagcaaactccactaattgatcttttgttggaggcttcccctgaaaggtctacaagaactcagcaaaaagaatttcaaacttacattttggatagcgtgatggaccatttgcttgcagctgatgtgttattaggggaagatgcatctctgcctattaccagtggaggaagctaccaggtattggtgaacaatgtgttttatttcacacagcgtgtggtggacaagctttggcaaggcatgttcaacaaagaatctaaacttcttatagattttataattcaactaattgcacagtcaaagagaagatcacagggattgtcactggatgcagtgtatcattgcctcaataggaccatcttgtaccagttctcacgggcacacaaaaccgttcctcagcaagtagctctgcttgattcactcagggtcctcactgtaaacagaaacttgatcctgggacctgggaaccatgaccaagaattcattagctgtctggcccactgcttgataaatctacatgttggaagcaacgtggatggatttggactggaagcagaagcccgcatgaccacatggcacattatgatcccctcggacattgaaccagatggtagttacagccaagatattagtgaagggcgtcagcttctcataaaagctgtcaacagagtttggactgaactgatacatagtaagaaacaagtcttagaggaacttttcaaagtaactctacctgtgaatgaaaggggccacgtggacatagctacagcaaggccactcattgaagaagctgccctgaagtgctggcagaatcatttggcccatgaaaagaaatgcataagtcgaggagaagctttagcgcccaccacacagtccaaattatcccgtgtcagcagtggctttggtctttccaagttaacaggatcaagaaggaatcgaaaagaaagtggtcttaataaacacagtctttccacccaggagatttcgcagtggatgtttactcacattgctgttgttcgtgacttagtagatacacaatataaagaatatcaggagcgtcagcagaatgccctgaagtacgtgacagaagagtggtgtcagatcgagtgcgagctgttgagggagcgggggctgtggggccctcccatcggctcccacctcgacaagtggatgctggagatgacagaagggccctgcaggatgaggaaaaagatggtgcgaaatgatatgttttataaccattacccttacgtgccagaaactgagcaagagacaaatgtggcgtctgagatcccaagtaaacagcctgagacacccgatgatattcctcaaaagaaacctgctcgatatagaagagccgtaagttatgacagtaaagagtactacatgcgactggcctctggcaatcccgccattgtccaagacgccattgtggagagttcagaaggtgaagctgctcagcaagaaccagagcatggggaagacactattgctaaagtcaaaggtttggtcaagcctcctctaaaacgctcccgatctgcacctgatggaggagatgaggagaaccaggagcagctacaagaccagattgctgagggcagctccatagaagaggaggagaaaacagataatgctaccttactgcgcctgttagaggaaggagaaaagatccaacacatgtaccgctgtgctcgagtccagggcctagataccagtgaggggctccttctttttggtaaagagcatttttatgtgattgatggatttaccatgacagcaaccagggaaataagagatattgaaaccttacctccaaatatgcatgagcctattattcctagaggagccaggcaaggccctagtcaactcaagagaacatgcagcatttttgcatatgaagatatcaaggaagttcataaaaggagatatctcctgcagcctattgctgtggaagttttctctggagatggacggaattacctccttgcttttcagaaaggaatcagaaacaaagtctatcaaaggtttttggctgtagtgccatctctaacggacagttcagaatctgtatctgggcaacgaccaaacacgagtgtggagcagggatctgggttacttagcactttggttggagagaagtctgtgactcagagatgggagagaggtgaaatcagcaacttccaatatttgatgcatttgaacactttggctggcagatcatataatgatctcatgcagtatcctgtcttcccctggatccttgcagattatgactcagaggaggtggatcttactaatcccaagacgtttagaaacctggctaagccaatgggagcacaaacagatgaacgattagctcagtataagaagcggtataaagactgggaggatcctaatggagaaactcctgcataccactatgggacccactattcatctgcaatgattgtggcctcataccttgtaaggatggagcctttcacacagatattcttaaggctacagggtggccactttgacctggctgaccggatgtttcacagtgtgcgcgaggcctggtattcagcgtcaaagcacaatatggcagatgtaaaagaacttatcccagagttcttttatttaccagaattcctgttcaattccaacaactttgatctaggctgtaaacaaaatggcaccaagcttggagatgttatccttccaccctgggcaaaaggggacccacgagaattcatcagagtccatcgtgaggctttggagtgtgattacgtgagtgcccatctacatgagtggattgacttaatcttcggttataaacagcaaggccctgctgcagtagaagctgtaaatgtcttccatcatcttttttatgagggtcaagtggatatctacaacatcaatgacccactaaaggagacagccacaattgggttcattaataacttcggtcagatccctaaacagttatttaaaaaacctcatccaccaaagcgagtgagaagtcgactcaatggagacaatgcaggaatctctgtcctaccaggatctacaagtgacaagatcttttttcatcatctagacaacttgaggccttctctaacacctgtaaaagaactcaaagaacctgtaggacaaatcgtatgtacagataaaggtattcttgcggtggaacagaataaggttcttatcccaccaacctggaataaaacttttgcttggggctatgcagacctcagttgcagactgggaacctatgagtcagacaaggccatgactgtttatgaatgcttgtctgagtggggccagattctctgtgcaatctgccccaaccccaagctggtcatcacgggtggaacaagcacggttgtgtgtgtgtgggagatgggcacctccaaagaaaaggccaagaccgtcaccctcaaacaggccttactgggccacactgataccgtcacctgcgccacagcatcattagcctatcacataattgtcagtgggtcccgtgatcgaacctgtatcatttgggatttgaacaaactgtcatttctaacccagcttcgagggcatcgagctccagtttctgctctttgtatcaatgaattaacaggggacattgtgtcctgcgctggcacatatatccatgtgtggagcatcaatgggaaccctatcgtgagtgtcaacacgttcacaggtaggagccagcagatcatctgctgctgcatgtcggagatgaacgaatgggacacgcagaacgtcatagtgacaggacactcagatggagtggttcggttttggagaatggaatttttgcaagttcctgaaacaccagctcctgagcctgctgaagtcctagaaatgcaggaagactgtccagaagcacaaatagggcaggaagcccaagacgaggacagcagtgattcagaagcagatgagcagagcatcagccaggaccctaaggacactccaagccaacccagcagcaccagccacaggccccgggcagcctcctgccgcgcaacagccgcctggtgtactgacagtggctctgacgactccagacgctggtccgaccagctcagtctagatgagaaagacggcttcatatttgtgaactattcagagggccagaccagagcccatctgcagggcccccttagccacccccaccccaatcccattgaggtgcggaattacagcagattgaaacctgggtaccgatgggaacggcagctggtgttcaggagtaagctgactatgcacacagcctttgatcgaaaggacaatgcacacccagctgaggtcactgccttgggcatctccaaggatcacagtaggatcctcgttggtgacagtcgaggccgagttttcagctggtctgtgagtgaccagccaggccgttctgctgctgatcactgggtgaaggatgaaggtggtgacagctgctcaggctgctcggtgaggttttcactcacagaaagacgacaccattgcaggaactgtggtcagctcttctgccagaagtgcagtcgctttcaatctgaaatcaaacgcttgaaaatctcatccccggtgcgtgtttgtcagaactgttattataacttacagcatgagagaggttcagaagatgggcctcgaaattgttgaagattcaacaagctgagtggagaccatggtctgtagaccccttcccgattctcctgtcccagcttggaaggcattgaaaacagtctccgtttacacatctcttcataccacgtgtttgaagtgttaaaattcaaagggatcattgaataaaacgggtgtagagtacaggaatggggcagacgcgattcaggtgaacagcacaagaagaatatgaggtggttcctaggagcaacactttcgacctccagttctccctgatgacagtagctgtctccaagagaaaaatcctcacttattaactctcttttcttgcatctcatttttatagagctactcatccttatttggaaaaaccaacaacaaaaaaggcttttagaaaatggttgtaaatctgacttctttgcaagtaactatgtatattgtaaatagatataaaaggccttttttctaaataaggacttaactgcctgtaacatgaaacttcaaactaaaccactaactcaatgaactacttatggtttgtctgacatccctcacttaccaattaattataaatatgtttttttaaatccccaaagacattatctgtggtctttttttcctttcaagctcagcctgtgtgcctgatgtcatttctttcaagttgcccacagtatctccacttaaactaggctagtaaccaaaataatgtggaccttctttaggaaacagtgtgggagaataggagtccagccgtaagataaactggaaatatttgggcgtcttgtacctggctacgcaccacctcagtgttgttcctacataaacagggccccttttaaacttgtatgtggactgctgtttggtcaaagaataccttcttagcattgcagaaaggtggtcagatgaccagtgtagtgcaggaaacagccctgtctcaactaatggaaatatatttgcatgtaacccaaaattagcttatcttgcatagaacataataagtatgtgtctttggtgacactaatgttctactatagcttattttcaaacaaggggtaaaaaaaggaaagaaagaagtgtacagaattaacatataaactttgttgtaaaactgaatcatgtcagaactgcttaaaattaacctttaccatttaatgtcatctacctgaaaacagtgagatttatactgtatcaatgtctatttttttgtttttgctatgaatataattacagtattttaatatttagttatttaatttgttctactagttggatacagaacacacaaatccagggggattaaagctggaaggggctaagagattagtttacagagaaaaggcttggtggtgggatttttttaaatgtgtgttatgtacatatatatatatatataatatatattaaaaatgaaacaattaatctagattttaacattttcagaaacttagtgataacattatgaacaattctaaaagccctgtgatttgaaaaatatagaatcattaatggcccaagataggccttcacaccttcacaggtgcgaaaggaaaggccttcacaccctcacagaggcatcatgcaaaggacagcggctttggcttttccaattttccatctttaggccctggtgagaggcacacttatgcactaaaatgcacatatatgcacatgcattcaaaaataggcatttggtacaatggtgatcttgtacctgatgggctgaaaccagcttaagaacaaatttgttcttcctgatatgataactaggtctccaagagaaaatagaaaggctgctttagtgccttacgcttactaaatttaaatctttatttacctgggtttgagcctacagtctatttatgattacatatcaaaattgattaaaacacttccatttctaaaagttcaaatatacttgttaataaaaggattatcggcattaatactttaatttaaagaaaagttgtgttctgttttcctttctgtgtcttactccccccacactctccctcccccatcaccatcttcaattctaataaataatgctgatgttcaacagttgcagaaattgtgctattatgtaactgtgggccttgcccctgtctggccctctagatgatttgtagcagtgttattctacactttttaaaagaagcgtcctccttttgtccatgaatcatgtttaccccatacccagtggcagaggtgttctttaaagacttgaatatatgaatgtgtgtgtgtagttacttaaaggttattcctctttgtaataggaaactatatgggatgaacacttttaaactttccgacacaacttccattactaactttctaacagaacttccataactagaaggtggaaaccaaaaccctcatggtagtatttcctctggcagctggtgctgtgggcaactgttttgttcaatcgggtttcttttctttttgcctctaatgcagaaatcaacagaatcactcacacatacaagtacactcacatacataaactaattatttctctggatatctttctgtgttccatgtaaatttatttaccaacatctattgtcaacatgtacatctaccttagtatggtctgcattctttttctgagagtacctcatagggctcctgcctgatctttgtagtttgttcattcatccatccacctgttcatttgttcatccatgtattctaacatttctatgtagtgtgcaactctaatgtcatgcttttgaagaagagaatagctgcccatagcagccatccgtctggataatagcaaaacactctagataagttattttgcactttcttatgtataaagttggtagaaacttatttttgctttgtatcatttaaatacattttgttttggtaaatgaactgtgtataaaatatttatgccgttaaaactgtttttagaaagtatttttaatttcagcaagtttggttacttgttgcatgactcttaacacagctgactttttgtgtcagtgcaatgtatattttttgtcctgttattaacttgtaagccctagtaatggccaattatttgtacagcaacagaagtaaattgaagatactggctaagactggattgattgtggacttttatactatattgcagaaaccaatatctgtttcttggtggttatgtaaaagacctgaagaattactatctagtgtgcagtctgtgatatctgaatgttcattgtatatttgtctctgatgcaaaaaggtagagtaacacaattacaatacatgattaaatgc

SEQ ID NO: 7969 - DNA, 14255 bp, Homo sapiens
gcggccgcagaatcgagctcgggccccggcccccggcccgcggcgcggggctcccgggccccgccgcggacgtcgcgccggtcgccccttccccgtagcccgtgcgccctcggcgcggagccccggcccgccgcggtcccgtctcctgggcctgtcccgcccgcgccctccgccggccctcaggtataatacttctccacgtctgcttcaggaagaaagtgcctgccattcttatcatttctaagcaggttcatgccagcccagaacagagaatcagctggagcccagatttcaagttttgagtaaaataccttcaagcgaatgggccctattgtgctcacacattcagaacctgttacccaaggaattccctaaagaattagaagtgcgtctcaccaaccagccaagatgaacatggtgaagaggatcatggggcggccgaggcaggaggagtgcagcccacaagacaacgccttaggactgatgcacctccgccggctcttcacggagttgtgccatcctccccggcacatgactcagaaggaacaagaagagaaactgtatatgatgctgccagtgtttaacagggtttttggaaatgctccgccgaatacaatgacagaaaaattttctgatcttctgcagttcacaacacaagtctcacgactaatggtgacagaaattcgaaggagagcatcaaacaaatccacagaggctgcaagtcgggccatagttcagttcctagagattaatcagagtgaagaagccagtagaggctggatgcttctaacgacaattaatttgttagcttcctctggtcagaaaaccgtggactgcatgacaacaatgtcagtgccttccaccctggttaaatgtttatatctgttttttgaccttccacatgtgcctgaggcagttggaggtgcacagaatgagctacctctagcagaacgtcgaggactactccagaaagtttttgtacagatcttagtgaaactgtgcagttttgtttcccctgcggaggagctggctcagaaagatgatctccagcttctattcagtgcaataacctcttggtgccctccctataacctgccttggagaaagagtgctggagaagtcctcatgaccatatctcgtcatggtcttagtgtcaatgtagtgaagtatattcatgagaaagagtgtttatctacatgtgttcagaatatgcagcaatcagatgacctgtctcccctagaaattgtcgaaatgtttgctgggctttcttgtttcctcaaagattccagcgatgtttcccaaacacttctggatgattttcggatatggcaaggatataattttctttgtgatctcttgcttagattggaacaagcaaaagaggcagaatccaaagatgccttgaaagatctggttaatctgataacttccctaacaacatatggtgtcagtgaactaaaaccagctggtattaccacaggggcaccctttttattgcctggatttgcagtacctcagcctgcaggcaaaggtcacagtgtgagaaacgtccaggcctttgcagttcttcagaatgcatttttaaaagcaaaaaccagcttccttgcccaaatcatccttgatgctatcacaaatatttacatggctgacaatgccaattacttcatcctagagtcacagcacacattgtcacagtttgcagagaagatttctaaactcccagaagtacaaaacaaatactttgagatgctggagtttgttgtttttagcttaaattatataccttgtaaagaacttattagtgtcagtatcctcttaaaatctagctcttcttatcactgtagcattattgcaatgaaaacacttcttaagtttacaagacatgactacatatttaaagacgtgttcagggaggttggccttttggaggtcatggtaaaccttttgcataaatatgctgccctgttgaaggatccaactcaggcactaaatgaacaaggggactcaagaaataatagttcagttgaagaccaaaaacacctggctttattggttatggagaccttgacagtgcttcttcaaggatcaaacacaaatgcaggaatttttcgagaatttggaggtgcaagatgtgcacataatatagtaaagtaccctcaatgccggcagcatgccttgatgactatccaacagctggtgctctccccaaatggggacgatgacatgggcactctcctggggctaatgcattcagccccaccgacggaattgcagttgaagactgatattttaagggccctcctgtcggtccttcgagaaagccatcgttcaagaacagtttttaggaaagttggaggatttgtgtacattacatccttgctcgttgctatggaaagatctttgagctgtccacccaagaatggctgggagaaagtgaaccagaatcaagtgtttgaacttcttcacactgtgttctgcacgttgactgcagcaatgcgctatgagccagccaactctcatttcttcaaaacagagattcagtatgagaagttggcagatgctgttcgatttcttggctgcttctcagacctaagaaaaataagcgccatgaatgtcttcccctcaaatacacagccatttcaaagacttttagaggaagatgtaatctcaatagaatcagtgtcacccacgttacggcactgcagtaaactttttatttatctttacaaagtagccacagattcttttgacagtcgtgcagaacagatccctccttgcctgacaagtgagtcttctctcccctctccttggggtacaccagctttgtccaggaaaaggcatgcatatcattctgtttcaactccccctgtttaccctcctaaaaatgttgccgacctgaaactacatgtgacaacttcatctctgcagagttctgatgcagtcatcattcatcctggagccatgcttgccatgctggacctactggcctctgttgggtcagtgacacagccagaacatgctttggatcttcaacttgccgtggcaaatattttacaatccctggtgcacacagaaaggaaccagcaagtcatgtgtgaagctggtcttcatgcacgactgctgcagaggtgcagtgctgcattggctgatgaggaccactcactgcacccgcccctgcagcggatgtttgaacgattagcctctcaggctctggaacccatggtgttgagggagtttttacgtttggcaagtcctttaaattgtggtgcctgggacaaaaaactgctaaaacaatatagggtccacaaaccaagttcactgagttatgaaccagaaatgagaagtagtatgatcacatctctggaaggtctgggtactgataatgtttttagcttacatgaagataaccattaccggataagcaagagcctggtaaaatctgcggaaggaagtactgtacccctgaccagggtgaagtgtctggtctccatgacaaccccacatgacatcagacttcatgggtcatcagttactccagcttttgttgaatttgacacatcacttgaagggtttggatgtctttttttgcccagtttggcccctcataatgctcctacaaataataccgtcacaacaggtcttattgatggggctgtggtcagtggcattggttctggtgaaagattcttccctcctccctccggcttaagttactctagctggttttgtattgaacattttagttctcctccaaataaccaccctgtcagacttcttactgttgtgcgccgagcaaattcttctgagcaacattacgtgtgccttgcaatagttctatcagcaaaagaccgatctctgattgtttccaccaaagaggaactcctccaaaattatgttgatgattttagtgaagagtcctcattttatgaaattctcccatgctgtgctcgctttcgatgtggagagcttatcattgagggacagtggcatcatttggtcctggtaatgagcaaaggcatgttgaaaaacagtactgcagccctttatattgatggacagcttgttaacactgtaaagcttcattatgtccacagtactccagggggttcaggttcggcaaatccaccagtggtgagcacggtctatgcctacattggtactccacctgcccaacgccaaattgcctcattggtttggcgcctgggacccacacattttctagaagaagttttaccttcttcaaatgttactaccatttatgaacttggaccaaattatgttggaagctttcaggctgtatgtatgccatgtaaagatgcaaaatccgaaggggtggtgccatcccctgtgtcattagtaccagaggagaaagtgtcatttggcctctatgcactctctgtgtcgtctctaacagtggcaagaatccggaaagtgtataacaaattggatagcaaagccattgctaagcagttaggcatttcctcacatgagaatgccactcctgtgaagttgatacacaattcagcaggacatcttaatggatctgcacggacaattggggccgctctgattggatacttgggagtaagaacatttgtccctaagcctgttgccactactttgcagtacgttggtggagctgcagccatcctgggcctggtggccatggcctctgatgtggaagggttatatgcagcagtcaaggccctggtttgtgtggtcaagagtaacccactagccagcaaagaaatggaaagaatcaagggctaccagttgctggcaatgttgcttaagaagaaacgttcccttcttaacagccacatcctccatctaactttttctttggtgggaactgttgatagtggacatgagacctccattattccaaattcaactgctttccaggacctcctctgtgattttgaagtctggctccatgcaccatatgaacttcatctttccttatttgaacactttattgaactgctcacagagtccagtgaagcctcaaagaatgccaaattaatgagagaattccagttaatcccaaagctgctcctgactcttcgagatatgtctttatcccagcctactattgctgctattagtaatgtcctgagcttcttactgcaaggttttcctagcagcaatgatctgctcagatttgggcagtttatttcttctactttgccaacctttgcggtttgtgagaaatttgtagtaatggaaataaataatgaagagaagcttgacactggaactgaagaggagtttggaggtcttgtatcagctaatcttatacttttgaggaacagacttctggatatcttgctaaaactaatttatacatctaaagaaaagacaagcattaatttgcaagcttgtgaagaactggtgaagacactgggttttgactggatcatgatgtttatggaggaacacttacattccaccacagttacagcagccatgaggattcttgttgtcctactaagtaatcagtctattctcatcaagtttaaagaaggactcagtggtggaggatggcttgaacagacagattctgtcttaactaataagattggaactgtattaggattcaacgtgggcagaagtgctggtgggagatcgacggtcagggagattaaccgagatgcttgtcattttcctggttttccagtccttcagtcattccttcctaaacacactaatgtccctgccctctattttctcctcatggccttgtttctgcagcagccagttagtgagctgcctgagaacctgcaggtcagtgtgcctgtcatcagctgccggagtaagcagggttgccagtttgatttggattccatttggacattcatctttggagttcctgcctccagcggaactgtggtctcttctatccataacgtatgcacagaagctgtttttttattattgggaatgctccgcagcatgctgacttcaccttggcaatcagaagaagagggatcttggctccgagaatatcctgtgaccctgatgcagttcttcagatatttgtatcacaacgtgccagaccttgcctccatgtggatgagccctgacttcctgtgtgcattagcagccaccgtcttccccttcaatattcgcccttactcagagatggtgactgaccttgatgatgaagttggatctccagcagaagagtttaaagcgtttgcagcagacacagggatgaacaggagccaatcagagtactgcaatgtgggcaccaagacatatctgaccaatcacccggctaaaaagttcgtttttgacttcatgcgggtcttaatcatagacaacctctgtctcactcctgccagcaagcaaactccactaattgatcttttgttggaggcttcccctgaaaggtctacaagaactcagcaaaaagaatttcaaacttacattttggatagcgtgatggaccatttgcttgcagctgatgtgttattaggggaagatgcatctctgcctattaccagtggaggaagctaccaggtattggtgaacaatgtgttttatttcacacagcgtgtggtggacaagctttggcaaggcatgttcaacaaagaatctaaacttcttatagattttataattcaactaattgcacagtcaaagagaagatcacagggattgtcactggatgcagtgtatcattgcctcaataggaccatcttgtaccagttctcacgggcacacaaaaccgttcctcagcaagtagctctgcttgattcactcagggtcctcactgtaaacagaaacttgatcctgggacctgggaaccatgaccaagaattcattagctgtctggcccactgcttgataaatctacatgttggaagcaacgtggatggatttggactggaagcagaagcccgcatgaccacatggcacattatgatcccctcggacattgaaccagatggtagttacagccaagatattagtgaagggcgtcagcttctcataaaagctgtcaacagagtttggactgaactgatacatagtaagaaacaagtcttagaggaacttttcaaagtaactctacctgtgaatgaaaggggccacgtggacatagctacagcaaggccactcattgaagaagctgccctgaagtgctggcagaatcatttggcccatgaaaagaaatgcataagtcgaggagaagctttagcgcccaccacacagtccaaattatcccgtgtcagcagtggctttggtctttccaagttaacaggatcaagaaggaatcgaaaagaaagtggtcttaataaacacagtctttccacccaggagatttcgcagtggatgtttactcacattgctgttgttcgtgacttagtagatacacaatataaagaatatcaggagcgtcagcagaatgccctgaagtacgtgacagaagagtggtgtcagatcgagtgcgagctgttgagggagcgggggctgtggggccctcccatcggctcccacctcgacaagtggatgctggagatgacagaagggccctgcaggatgaggaaaaagatggtgcgaaatgatatgttttataaccattacccttacgtgccagaaactgagcaagagacaaatgtggcgaaacctgctcgatatagaagagccgtaagttatgacagtaaagagtactacatgcgactggcctctggcaatcccgccattgtccaagacgccattgtggagagttcagaaggtgaagctgctcagcaagaaccagagcatggggaagacactattgctaaagtcaaaggtttggtcaagcctcctctaaaacgctcccgatctgcacctgatggaggagatgaggagaaccaggagcagctacaagaccagattgctgagggcagctccatagaagaggaggagaaaacagataatgctaccttactgcgcctgttagaggaaggagaaaagatccaacacatgtaccgctgtgctcgagtccagggcctagataccagtgaggggctccttctttttggtaaagagcatttttatgtgattgatggatttaccatgacagcaaccagggaaataagagatattgaaaccttacctccaaatatgcatgagcctattattcctagaggagccaggcaaggccctagtcaactcaagagaacatgcagcatttttgcatatgaagatatcaaggaagttcataaaaggagatatctcctgcagcctattgctgtggaagttttctctggagatggacggaattacctccttgcttttcagaaaggaatcagaaacaaagtctatcaaaggtttttggctgtagtgccatctctaacggacagttcagaatctgtatctgggcaacgaccaaacacgagtgtggagcagggatctgggttacttagcactttggttggagagaagtctgtgactcagagatgggagagaggtgaaatcagcaacttccaatatttgatgcatttgaacactttggctggcagatcatataatgatctcatgcagtatcctgtcttcccctggatccttgcagattatgactcagaggaggtggatcttactaatcccaagacgtttagaaacctggctaagccaatgggagcacaaacagatgaacgattagctcagtataagaagcggtataaagactgggaggatcctaatggagaaactcctgcataccactatgggacccactattcatctgcaatgattgtggcctcataccttgtaaggatggagcctttcacacagatattcttaaggctacagggtggccactttgacctggctgaccggatgtttcacagtgtgcgcgaggcctggtattcagcgtcaaagcacaatatggcagatgtaaaagaacttatcccagagttcttttatttaccagaattcctgttcaattccaacaactttgatctaggctgtaaacaaaatggcaccaagcttggagatgttatccttccaccctgggcaaaaggggacccacgagaattcatcagagtccatcgtgaggctttggagtgtgattacgtgagtgcccatctacatgagtggattgacttaatcttcggttataaacagcaaggccctgctgcagtagaagctgtaaatgtcttccatcatcttttttatgagggtcaagtggatatctacaacatcaatgacccactaaaggagacagccacaattgggttcattaataacttcggtcagatccctaaacagttatttaaaaaacctcatccaccaaagcgagtgagaagtcgactcaatggagacaatgcaggaatctctgtcctaccaggatctacaagtgacaagatcttttttcatcatctagacaacttgaggccttctctaacacctgtaaaagaactcaaagaacctgtaggacaaatcgtatgtacagataaaggtattcttgcggtggaacagaataaggttcttatcccaccaacctggaataaaacttttgcttggggctatgcagacctcagttgcagactgggaacctatgagtcagacaaggccatgactgtttatgaatgcttgtctgagtggggccagattctctgtgcaatctgccccaaccccaagctggtcatcacgggtggaacaagcacggttgtgtgtgtgtgggagatgggcacctccaaagaaaaggccaagaccgtcaccctcaaacaggccttactgggccacactgataccgtcacctgcgccacagcatcattagcctatcacataattgtcagtgggtcccgtgatcgaacctgtatcatttgggatttgaacaaactgtcatttctaacccagcttcgagggcatcgagctccagtttctgctctttgtatcaatgaattaacaggggacattgtgtcctgcgctggcacatatatccatgtgtggagcatcaatgggaaccctatcgtgagtgtcaacacgttcacaggtaggagccagcagatcatctgctgctgcatgtcggagatgaacgaatgggacacgcagaacgtcatagtgacaggacactcagatggagtggttcggttttggagaatggaatttttgcaagttcctgaaacaccagctcctgagcctgctgaagtcctagaaatgcaggaagactgtccagaagcacaaatagggcaggaagcccaagacgaggacagcagtgattcagaagcagatgagcagagcatcagccaggaccctaaggacactccaagccaacccagcagcaccagccacaggccccgggcagcctcctgccgcgcaacagccgcctggtgtactgacagtggctctgacgactccagacgctggtccgaccagctcagtctagatgagaaagacggcttcatatttgtgaactattcagagggccagaccagagcccatctgcagggcccccttagccacccccaccccaatcccattgaggtgcggaattacagcagattgaaacctgggtaccgatgggaacggcagctggtgttcaggagtaagctgactatgcacacagcctttgatcgaaaggacaatgcacacccagctgaggtcactgccttgggcatctccaaggatcacagtaggatcctcgttggtgacagtcgaggccgagttttcagctggtctgtgagtgaccagccaggccgttctgctgctgatcactgggtgaaggatgaaggtggtgacagctgctcaggctgctcggtgaggttttcactcacagaaagacgacaccattgcaggaactgtggtcagctcttctgccagaagtgcagtcgctttcaatctgaaatcaaacgcttgaaaatctcatccccggtgcgtgtttgtcagaactgttattataacttacagcatgagagaggttcagaagatgggcctcgaaattgttgaagattcaacaagctgagtggagaccatggtctgtagaccccttcccgattctcctgtcccagcttggaaggcattgaaaacagtctccgtttacacatctcttcataccacgtgtttgaagtgttaaaattcaaagggatcattgaataaaacgggtgtagagtacaggaatggggcagacgcgattcaggtgaacagcacaagaagaatatgaggtggttcctaggagcaacactttcgacctccagttctccctgatgacagtagctgtctccaagagaaaaatcctcacttattaactctcttttcttgcatctcatttttatagagctactcatccttatttggaaaaaccaacaacaaaaaaggcttttagaaaatggttgtaaatctgacttctttgcaagtaactatgtatattgtaaatagatataaaaggccttttttctaaataaggacttaactgcctgtaacatgaaacttcaaactaaaccactaactcaatgaactacttatggtttgtctgacatccctcacttaccaattaattataaatatgtttttttaaatccccaaagacattatctgtggtctttttttcctttcaagctcagcctgtgtgcctgatgtcatttctttcaagttgcccacagtatctccacttaaactaggctagtaaccaaaataatgtggaccttctttaggaaacagtgtgggagaataggagtccagccgtaagataaactggaaatatttgggcgtcttgtacctggctacgcaccacctcagtgttgttcctacataaacagggccccttttaaacttgtatgtggactgctgtttggtcaaagaataccttcttagcattgcagaaaggtggtcagatgaccagtgtagtgcaggaaacagccctgtctcaactaatggaaatatatttgcatgtaacccaaaattagcttatcttgcatagaacataataagtatgtgtctttggtgacactaatgttctactatagcttattttcaaacaaggggtaaaaaaaggaaagaaagaagtgtacagaattaacatataaactttgttgtaaaactgaatcatgtcagaactgcttaaaattaacctttaccatttaatgtcatctacctgaaaacagtgagatttatactgtatcaatgtctatttttttgtttttgctatgaatataattacagtattttaatatttagttatttaatttgttctactagttggatacagaacacacaaatccagggggattaaagctggaaggggctaagagattagtttacagagaaaaggcttggtggtgggatttttttaaatgtgtgttatgtacatatatatatatatataatatatattaaaaatgaaacaattaatctagattttaacattttcagaaacttagtgataacattatgaacaattctaaaagccctgtgatttgaaaaatatagaatcattaatggcccaagataggccttcacaccttcacaggtgcgaaaggaaaggccttcacaccctcacagaggcatcatgcaaaggacagcggctttggcttttccaattttccatctttaggccctggtgagaggcacacttatgcactaaaatgcacatatatgcacatgcattcaaaaataggcatttggtacaatggtgatcttgtacctgatgggctgaaaccagcttaagaacaaatttgttcttcctgatatgataactaggtctccaagagaaaatagaaaggctgctttagtgccttacgcttactaaatttaaatctttatttacctgggtttgagcctacagtctatttatgattacatatcaaaattgattaaaacacttccatttctaaaagttcaaatatacttgttaataaaaggattatcggcattaatactttaatttaaagaaaagttgtgttctgttttcctttctgtgtcttactccccccacactctccctcccccatcaccatcttcaattctaataaataatgctgatgttcaacagttgcagaaattgtgctattatgtaactgtgggccttgcccctgtctggccctctagatgatttgtagcagtgttattctacactttttaaaagaagcgtcctccttttgtccatgaatcatgtttaccccatacccagtggcagaggtgttctttaaagacttgaatatatgaatgtgtgtgtgtagttacttaaaggttattcctctttgtaataggaaactatatgggatgaacacttttaaactttccgacacaacttccattactaactttctaacagaacttccataactagaaggtggaaaccaaaaccctcatggtagtatttcctctggcagctggtgctgtgggcaactgttttgttcaatcgggtttcttttctttttgcctctaatgcagaaatcaacagaatcactcacacatacaagtacactcacatacataaactaattatttctctggatatctttctgtgttccatgtaaatttatttaccaacatctattgtcaacatgtacatctaccttagtatggtctgcattctttttctgagagtacctcatagggctcctgcctgatctttgtagtttgttcattcatccatccacctgttcatttgttcatccatgtattctaacatttctatgtagtgtgcaactctaatgtcatgcttttgaagaagagaatagctgcccatagcagccatccgtctggataatagcaaaacactctagataagttattttgcactttcttatgtataaagttggtagaaacttatttttgctttgtatcatttaaatacattttgttttggtaaatgaactgtgtataaaatatttatgccgttaaaactgtttttagaaagtatttttaatttcagcaagtttggttacttgttgcatgactcttaacacagctgactttttgtgtcagtgcaatgtatattttttgtcctgttattaacttgtaagccctagtaatggccaattatttgtacagcaacagaagtaaattgaagatactggctaagactggattgattgtggacttttatactatattgcagaaaccaatatctgtttcttggtggttatgtaaaagacctgaagaattactatctagtgtgcagtctgtgatatctgaatgttcattgtatatttgtctctgatgcaaaaaggtagagtaacacaattacaatacatgattaaatgcaatagtccaggtacttaagtaatttttttttcatttcaaataaatacctatttaccacc

SEQ ID NO: 7970 - DNA, 425 bp, Homo sapiens
gcggccgcagaatcgagctcgggccccggcccccggcccgcggcgcggggctcccgggccccgccgcggacgtcgcgccggtcgccccttccccgtagcccgtgcgccctcggcgcggagccccggcccgccgcggtcccgtctcctgggcctgtcccgcccgcgccctccgccggccctcaggtataatacttctccacgtctgcttcaggaagaaagtgcctgccattcttatcatttctaagcaggttcatgccagcccagaacagagaatcagatgtcttcaattgctgtggtgacaagaacatagtgaatataagctgctgaaagtagagctagtcgtggctggaacagagagaaattcagaattagaagtgcgtctcaccaaccagccaagatgaacatggtgaagaggatcatggggc

SEQ ID NO: 7971 - DNA, 453 bp, Homo sapiens
ggcgcggggctcccgggccccgccgcggacgtcgcgccggtcgccccttccccgtagcccgtgcgccctcggcgcggagccccggcccgccgcggtcccgtctcctgggcctgtcccgcccgcgccctccgccggccctcagctggagcccagatttcaagttttgagtaaaataccttcaagcgaatgggccctattgtgctcacacattcagaacctgttacccaaggaattccctaaagaattagaagtgcgtctcaccaaccagccaagatgaacatggtgaagaggatcatggggcggccgaggcaggaggagtgcagcccacaagacaacgccttaggactgatgcacctccgccggctcttcacggagttgtgccatcctccccggcacatgactcagaaggaacaagaagagaaactgtatatgatgctgccagtgtttaacagg

SEQ ID NO: 7972 - DNA, 3392 bp, Homo sapiens
actgcgctctgcgccgattgcaaagtagtccctgaggatgagcccctgtgattggaggacgacaacaaacggatggtttgggctcaggaggaaaggacctgcctgatggagcccggcaattggcgggagagatagcgtgtgtaactctagggaggggagaatcaccccttagcgacatcacccccacgcgcgtgactgagactgcatcctcccatgagggtaaacgtgggaggtaaagagaccttccgctgcgtaaagctggatcgacccggaaacaaaatcttttaaaaaacgattgacactctggaggggcgggggaattgataagttgggacgaccggacagcttctcaggttgctaagcgacgaggcgggagcgcacgcacaccctggctgctttgtagcacctgaggaaactgtggcggcggcggcggcgtcctggagacccaagagaccaagcgagcgtgtcgctccctctcgggtccgaggacctagcctaggaaccttctgcccggggtagtgtctggtgatgaggcgagagttttgctgggacgcctactccaaagcggccgggagtcgcgcttcttccccactcccgagacaggatagagattccttctgccatcagatgtctttctgcttgactgaactgcacctgtggtctttgaagaataccttacacattgcggatagagacattgggatctaccagtattatgacaagaaagatccaccagcgacagagcatggtaacttagaaaagaagcagaagctggcagagtcacgagattatccttggacgctcaaaaacagacgcccagaaaaactccgagactcgctcaaagagttggaggagctgatgcaaaacagtcggtgtgtgctgagcaaatggaagaacaaatatgtctgtcagctcctttttggttcaggtgtgctggtgtctctaagcctttctgggccgcagctggagaaagtggtgattgacagaagcctggtggggaagctcatctcagacaccatcagtgatgctcttctcacagacagttttatcatcttatcatttttggcacaaaacaaactatgttttattcagtttaccaagaagatggagtcttctgatgtaaacaaaagactggaaaaactctcagccttggattataagattttctattatgaaatacccggcccaataaacaagacaacagagcgacatctagctatcaactgtgttcatgatagagttgtttgctggtggccactggtcaacgatgatgcttggccttgggcccccatttcttctgagaaggacagagccaatctactcctcctgggttatgctcaaggaagactagaggttctgagttctgtccgcacagaatgggacccactggatgttcgctttggcaccaaacagccttatcaggtgttcacagtggagcactccgtaagtgtagacaaagagcccatggctgacagctgcatctatgaatgcattcggaataaaatccagtgtgtgtcagtcaccagaataccactaaagtcaaaggccatcagctgctgcaggaatgttactgaagacaaactgattctgggctgtgaagattcttcgctaattctttatgaaactcaccgtagagtgactctcttagcacagactgaacttttgccttcattaataagctgccacccaagtggtgccattctgctagttggcagcaaccaaggggagttgcaaatttttgatatggctctatcccctattaacatccaactgttggctgaagaccgcttacccagggagactctgcaattcagtaaattatttgatgcctccagcagtcttgttcaaatgcaatggatagctcctcaggttgtttctcagaagggtgaaggtagtgatatctatgatctcctcttcctcaggtttgaaagaggacctttgggtgtgctgttgtttaaactaggcgtcttcactcgaggacagctgggcctgatagacatcatcttccagtacattcactgtgatgagatctatgaggcaataaacatcctgagcagcatgaactgggacactctgggccaccagtgctttatcagcatgagcgccattgtaaaccatcttcttagacagaagctcactccagagagagaagcacagcttgagacaagccttggaaccttctatgctccaacaagaccacttctggattccactatattggaatatagagatcaaatcagcaaatatgcaaggagattcttccatcacttgctcaggtaccagaggtttgaaaaggcatttctcctagctgttgacgttggtgctcgtgacctctttatggatattcattaccttgcactagataaaggtgaattggcactagctgaagtggcaagaaaaagagctagtgacattgatgcagaatcaataacctctggggttgaactcctgggacccttggacagaggggatatgctaaatgaagcatttattggcctgtctttagcacctcaaggagaagactcatttccagataacctccctccctcttgcccaacccacagacatattttacaacaaagaatactgaatggctcttctaacagacaaataattgacagaaggaatgaacttgaaaaagacatctgttctggatttttgatgactaatacctgtaatgcagaagacggagaactgagagaagacggcagagaacaggaaatcagagatggtggttctctcaaaatgattcactttggtctggtgtaaacattaagaaaaaaagaaaactgccttcttcatatctaaacttttcatggcctgatacagacttaaaatcccccgtgtggatttttaacaagagacagtatgaatcatataaattagttaagagttttgagttgagtgtttgttttcaaaataaagttttattatttcaaaaacatgcagcataacagcaaagtgatcgtaagtaaaagtcttcaacctacttattttcaataatgtaaaattttgaaagtgtcttaaattgtatgttaattaggtgctacaaaaatagaatatttaaactttgttctcccaggtactttaaaaaaggggcagtagggggcaggcatagtgctcatgcctgtagtcccagtgctttaggaggccaaggctgaaggatcacttgagcccaggagttcaagactagcctgtgcaacatagtgaaacgctgtctctagaaaaaattttaaaaattagccaggcatggtggtacatgcttgtgaagctgaggcagaagaattgcttgagcccaggagttcaaggctacagtgagctgtgatcgcgccactgcactctaacctgggcaacagagagtgaccctgtctccaaaaaaaaaaaaaaaaaaa

SEQ ID NO: 7973 - DNA, 4111 bp, Homo sapiens
attttgcgggcaactagctcttccagctgctgtaaattgctgctgcgggagaaactggagccgctgtagccggcgcgcccttcttcccttactgcgaggagccaccgcctctttcgcgctccttatacacctatcactgggagcggtggcagcaacattccctggaccaaccgccgcctcttcaggcggccgctttgccggtcattcccgaagcccggcaactgagggcggccccctttccttaacagtctcctcgctacagatcgtctgctccctcagcctcgcccgagacccacttccccagtctcgcccgggtggaggtcgacgaggaggagacaagagtcacccttcctccaggcggcgccggccccctcacccgcgggtgtgtcctataaatggcgtcggaaagcgacaccgaggaattctatgatgcccctgaagatgtgcacctagggggcggctaccccgtggggtctccaggaaaagttgggctttcaacattcaaggaaacagagaacactgcatacaaagttggaaatgagtcccctgtacaagaattgaaacaagatgtgtctaaaaagattattgaaagtattattgaggagagtcagaaagtactacagcttgaagatgactctttggattccaaaggaaaagaactctctgatcaagctactgccagtcctattgtggctagaacagatctgagcaatatacccggactgttagccatagatcaagtactaccggaagaatcccaaaaggcagagagtcagaatacatttgaagagactgaattagaattaaaaaaatgctttccttctgatgaaacctgtgagaaaccagtagatgaaaccacgaagttaactcaaacaagttcaactgagcagcttaatgtgcttgaaactgaaacagaagtattgaacaaggaagcagtggaagtcaaaggaggtggtgatgttttagagcctgtgtcctcagactccttatctactaaagattttgccgctgtggaagaagtggcccctgccaaacccccaagacaccttactccagagcctgatatagtggctagtacaaagaagcctgttccagcacgcccacctcctccaactaatttcccacctcctagacccccacctccttctcgacctgctccaccaccaagaaaaaggaaaagcgaattggaatttgagactctgaaaactcctgatatagatgttcccaaagagaatattacgtctgattctctcctaaccgcaagcatggcttcagaaagtacggttaaggattctcagccttctcttgatttggcaagtgctaccagtggagataaaatagttaccgcccaggaaaatggaaaagcacctgatgggcagactgtagcaggtgaagtgatgggccctcagagacctagatccaactctgggagagagcttactgatgaggaaattttagccagtgtaatgattaagaacctggatactggagaagaaatacctttgagtcttgcagaagagaaactaccaacaggcattaatcctctcactctacacatcatgagaaggacaaaagaatatgtaagtaatgacgcggcacagtcagatgatgaagagaagttacagtctcagccaacagatactgatggtggaaggttaaaacagaaaacgactcaactaaagaagtttcttggaaaatcagtaaagagagcaaagcaccttgctgaggaatatggtgaacgtgctataaataaagttaaaagtgttagagatgaagtgtttcatactgatcaagatgatccttcatcaagtgatgatgaaggaatgccatacacaagaccagttaaattcaaagcagcacacggtttcaaaggaccttatgattttgatcagatcaaagtggtgcaagatcttagtggtgaacatatgggagctgtttggaccatgaaattttctcactgtggccgattacttgcctcagctggacaagacaatgtagtgagaatatgggctttaaaaaatgcttttgactatttcaacaatatgcgaatgaaatacaatactgaaggacgtgtgtccccatcaccctctcaggaaagtctaagttcatcaaaatcggatacagatacaggggtatgcagtggaactgatgaagaccctgatgataaaaacgcaccctttcggcaacggccattttgcaaatataaaggacatactgctgatctccttgatctttcatggtctaaaaactactttcttctttcttcttcaatggataaaacagtcagattatggcacatttctcgaagagaatgcctttgctgttttcaacatatagattttgtcactgccatagcttttcatccaagagatgacaggtattttctaagtgggtctttggatggaaagctccgcctttggaacatacctgacaaaaaagtggctttgtggaatgaagtagatggtcagacaaaattgatcacagctgcaaatttctgtcagaatggcaaatatgcagtgattgggacatatgatggcagatgtattttctatgatacagagcatttgaaataccatacacaaatacatgtccgatctactagagggcgcaacaaggttggaagaaaaattactggcattgagcctttacctggagaaaataagatattggtaacctcaaatgactccagaatcagactatatgatttgagagatttgtcactatccatgaagtataagggttacgtcaatagcagcagccagatcaaagcaagtttcagccatgattttacttacctcgttagtggttcagaagataagtatgtttatatctggagtacctaccatgacctaagcaagtttacttcagtcaggagagatcgtaatgacttctgggaaggtattaaagcccacaatgcagttgttacatcagccatctttgcaccaaacccaagtttgatgttatctttggatgtgcaatctgaaaaatcagaagggaacgagaaaagtgaagatgctgaagttttggatgccacaccttctggtattatgaagacagataacacagaagttcttctctctgctgacttcactggagcaatcaaagtgtttgttaataaaagaaaaaatgtatcttaatttgaaatggcatttaaaataaacatatcagtaagtttctatatgtatcaaaactgaaaaaatagtgttccaggctaacatacttttttaatttttattgaaagttgttcaaatataatatattttttgagaggcagtgttaatgatctaggaaaccctgggctgatagagtagaaaggaatatggctagaataacattgccaaacattaggctttatgttttgttatgtttgtgttttcgttgtataattatgaacatgcacaagtttctgcatgaaaagatattaatatattaatcacatgtatgtgccttttggttacatgcattaaatctaacagagttaaattatttcagtggctcttttggcctcttactaggggggatagtcttgtttctagcttaaacaattttttttttgcacaaaatttcatttttaataaaagtggtatcttttgactgagttattgttttgaaaatggtatataggtttccagtaggtcaacaaccatatgtaaatggtttttataaatttctcaatttggggacaagatttttttgtggtctaaattgtgggcttaagattcttttctttatatgtgtacatataatttttttttctttgccacactggagcacaatgtttctatgtaaagaattattttcattctttatccatgagcaccaggctttgctcacttaaaaaaaaattaagccacattaaggagtgagtcttcttttttacaataatgtaaaaattaaactgtttacatttttttaaagcattgtagtttttaaaaattaagctgttttgttttgtgttgttgaatttgaaagcctttgtaaatatcaatataatgtaccaatgaaataacatctggggcaatgaaaccctgatcatgttgttgatggttagcatatgtttctgaaaattaaatatgtattattaaaagttggtctccaacacttgtttaaa

SEQ ID NO: 7974 - DNA, 867 bp, Homo sapiens
tgggggaaaaactactttcttctttcttcttcaatggataaaacagtcagattatggcacatttctcgaagagaatgcctttgctgttttcaacatatagattttgtcactgccatagcttttcatccaagagatgacaggtattttctaagtgggtctttggatggaaagctccgcctttggaacatacctgacaaaaaagtggctttgtggaatgaagtagatggtcagacaaaattgatcacagctgcaaatttctgtcagaatggcaaatatgcagtgattgggacatatgatggcagatgtattttctatgatacagagcatttgaaataccatacacaaatacatgtccgatctactagagggcgcaacaaggttggaagaaaaattactggcattgagcctttacctggagaaaataagatattggtaacctcaaatgactccagaatcagactatatgatttgagagatttgtcactatccatgaagtataagggttacgtcaatagcagcagccagatcaaagcaagtttcagccatgattttacttacctcgttagtggttcagaagataagtatgtttatatctggagtacctaccatgacctaagcaagtttacttcagtcaggagagatcgtaatgacttctgggaaggtattaaagcccacaatgcagttgttacatcagccatctttgcaccaaacccaagtttgatgttatctttggatgtgcaatctgaaaaatcagaagggaacgagaaaagtgaagatgctgaagttttggatgccacaccttctggtgcagtggctcatgcctgtaatcccagcactttgggaggccgaggcaggcggatcacttga

SEQ ID NO: 7975 - DNA, 3877 bp, Homo sapiens
ccctccgaaatctcgcgagggtaggtgcgcgtcggtattttgcgggcaactagctcttccagctgctgtaaattgctgctgcgggagaaactggagccgctgtagccggcgcgcccttcttcccttactgcgaggagccaccgcctctttcgcgctccttatacacctatcactgggagcggtggcagcaacattccctggaccaaccgccgcctcttcaggcggccgctttgccggtcattcccgaagcccggcaactgagggcggccccctttccttaacagtctcctcgctacagatcgtctgctccctcagcctcgcccgagacccacttccccagtctcgcccgggtggaggtcgacgaggaggagacaagagtcacccttcctccaggcggcgccggccccctcacccgcgggtgtgtcctataaatggcgtcggaaagcgacaccgaggaattctatgatgcccctgaagatgtgcacctagggggcggctaccccgtggggtctccaggaaaagttgggctttcaacattcaagattattgaaagtattattgaggagagtcagaaagtactacagcttgaagatgactctttggattccaaaggaaaagaactctctgatcaagctactgccagtcctattgtggctagaacagatctgagcaatatacccggactgttagccatagatcaagtactaccggaagaatcccaaaaggcagagagtcagaatacatttgaagagactgaattagaattaaaaaaatgctttccttctgatgaaacctgtgagaaaccagtagatgaaaccacgaagttaactcaaacaagttcaactgagcagcttaatgtgcttgaaactgaaacagaagtattgaacaaggaagcagtggaagtcaaaggaggtggtgatgttttagagcctgtgtcctcagactccttatctactaaagattttgccgctgtggaagaagtggcccctgccaaacccccaagacaccttactccagagcctgatatagtggctagtacaaagaagcctgttccagcacgcccacctcctccaactaatttcccacctcctagacccccacctccttctcgacctgctccaccaccaagaaaaaggaaaagcgaattggaatttgagactctgaaaactcctgatatagatgttcccaaagagaatattacgtctgattctctcctaaccgcaagcatggcttcagaaagtacggttaaggattctcagccttctcttgatttggcaagtgctaccagtggagataaaatagttaccgcccaggaaaatggaaaagcacctgatgggcagactgtagcaggtgaagtgatgggccctcagagacctagatccaactctgggagagagcttactgatgaggaaattttagccagtgtaatgattaagaacctggatactggagaagaaatacctttgagtcttgcagaagagaaactaccaacaggcattaatcctctcactctacacatcatgagaaggacaaaagaatatgtaagtaatgacgcggcacagtcagatgatgaagagaagttacagtctcagccaacagatactgatggtggaaggttaaaacagaaaacgactcaactaaagaagtttcttggaaaatcagtaaagagagcaaagcaccttgctgaggaatatggtgaacgtgctataaataaagttaaaagtgttagagatgaagtgtttcatactgatcaagatgatccttcatcaagtgatgatgaaggaatgccatacacaagaccagttaaattcaaagcagcacacggtttcaaaggaccttatgattttgatcagatcaaagtggtgcaagatcttagtggtgaacatatgggagctgtttggaccatgaaattttctcactgtggccgattacttgcctcagctggacaagacaatgtagtgagaatatgggctttaaaaaatgcttttgactatttcaacaatatgcgaatgaaatacaatactgaaggacgtgtgtccccatcaccctctcaggaaagtctaagttcatcaaaatcggatacagatacaggggtatgcagtggaactgatgaagaccctgatgataaaaacgcaccctttcggcaacggccattttgcaaatataaaggacatactgctgatctccttgatctttcatggtctaaaaactactttcttctttcttcttcaatggataaaacagtcagattatggcacatttctcgaagagaatgcctttgctgttttcaacatatagattttgtcactgccatagcttttcatccaagacatttgaaataccatacacaaatacatgtccgatctactagagggcgcaacaaggttggaagaaaaattactggcattgagcctttacctggagaaaataagatattggtaacctcaaatgactccagaatcagactatatgatttgagagatttgtcactatccatgaagtataagggttacgtcaatagcagcagccagatcaaagcaagtttcagccatgattttacttacctcgttagtggttcagaagataagtatgtttatatctggagtacctaccatgacctaagcaagtttacttcagtcaggagagatcgtaatgacttctgggaaggtattaaagcccacaatgcagttgttacatcagccatctttgcaccaaacccaagtttgatgttatctttggatgtgcaatctgaaaaatcagaagggaacgagaaaagtgaagatgctgaagttttggatgccacaccttctggtattatgaagacagataacacagaagttcttctctctgctgacttcactggagcaatcaaagtgtttgttaataaaagaaaaaatgtatcttaatttgaaatggcatttaaaataaacatatcagtaagtttctatatgtatcaaaactgaaaaaatagtgttccaggctaacatacttttttaatttttattgaaagttgttcaaatataatatattttttgagaggcagtgttaatgatctaggaaaccctgggctgatagagtagaaaggaatatggctagaataacattgccaaacattaggctttatgttttgttatgtttgtgttttcgttgtataattatgaacatgcacaagtttctgcatgaaaagatattaatatattaatcacatgtatgtgccttttggttacatgcattaaatctaacagagttaaattatttcagtggctcttttggcctcttactaggggggatagtcttgtttctagcttaaacaattttttttttgcacaaaatttcatttttaataaaagtggtatcttttgactgagttattgttttgaaaatggtatataggtttccagtaggtcaacaaccatatgtaaatggtttttataaatttctcaatttggggacaagatttttttgtggtctaaattgtgggcttaagattcttttctttatatgtgtacatataatttttttttctttgccacactggagcacaatgtttctatgtaaagaattattttcattctttatccatgagcaccaggctttgctcacttaaaaaaaaattaagccacattaaggagtgagtcttcttttttacaataatgtaaaaattaaactgtttacatttttttaaagcattgtagtttttaaaaattaagctgttttgttttgtgttgttgaatttgaaagcctttgtaaatatcaatataatgtaccaatgaaataacatctggggcaatgaaaccctgatcatgttgttgatggttagcatatgtttctgaaaattaaatatgtattattaaaagttggtctccaacacttgttt

SEQ ID NO: 7976 - DNA, 4029 bp, Homo sapiens
aattgctgctgcgggagaaactggagccgctgtagccggcgcgcccttcttcccttactgcgaggagccaccgcctctttcgcgctccttatacacctatcactgggagcggtggcagcaacattccctggaccaaccgccgcctcttcaggcggccgctttgccggtcattcccgaagcccggcaactgagggcggccccctttccttaacagtctcctcgctacagatcgtctgctccctcagcctcgcccgagacccacttccccagtctcgcccgggtggaggtcgacgaggaggagacaagagtcacccttcctccaggcggcgccggccccctcacccgcgggtgtgtcctataaatggcgtcggaaagcgacaccgaggaattctatgatgcccctgaagatgtgcacctagggggcggctaccccgtggggtctccaggaaaagttgggctttcaacattcaaggaaacagagaacactgcatacaaagttggaaatgagtcccctgtacaagaattgaaacaagatgtgtctaaaaagattattgaaagtattattgaggagagtcagaaagtactacagcttgaagatgactctttggattccaaaggaaaagaactctctgatcaagctactgccagtcctattgtggctagaacagatctgagcaatatacccggactgttagccatagatcaagtactaccggaagaatcccaaaaggcagagagtcagaatacatttgaagagactgaattagaattaaaaaaatgctttccttctgatgaaacctgtgagaaaccagtagatgaaaccacgaagttaactcaaacaagttcaactgagcagcttaatgtgcttgaaactgaaacagaagtattgaacaaggaagcagtggaagtcaaaggaggtggtgatgttttagagcctgtgtcctcagactccttatctactaaagattttgccgctgtggaagaagtggcccctgccaaacccccaagacaccttactccagagcctgatatagtggctagtacaaagaagcctgttccagcacgcccacctcctccaactaatttcccacctcctagacccccacctccttctcgacctgctccaccaccaagaaaaaggaaaagcgaattggaatttgagactctgaaaactcctgatatagatgttcccaaagagaatattacgtctgattctctcctaaccgcaagcatggcttcagaaagtacggttaaggattctcagccttctcttgatttggcaagtgctaccagtggagataaaatagttaccgcccaggaaaatggaaaagcacctgatgggcagactgtagcaggtgaagtgatgggccctcagagacctagatccaactctgggagagagcttactgatgaggaaattttagccagtgtaatgattaagaacctggatactggagaagaaatacctttgagtcttgcagaagagaaactaccaacaggcattaatcctctcactctacacatcatgagaaggacaaaagaatatgtaagtaatgacgcggcacagtcagatgatgaagagaagttacagtctcagccaacagatactgatggtggaaggttaaaacagaaaacgactcaactaaagaagtttcttggaaaatcagtaaagagagcaaagcaccttgctgaggaatatggtgaacgtgctataaataaagttaaaagtgttagagatgaagtgtttcatactgatcaagatgatccttcatcaagtgatgatgaaggaatgccatacacaagaccagttaaattcaaagcagcacacggtttcaaaggaccttatgattttgatcagatcaaagtggtgcaagatcttagtggtgaacatatgggagctgtttggaccatgaaattttctcactgtggccgattacttgcctcagctggacaagacaatgtagtgagaatatgggctttaaaaaatgcttttgactatttcaacaatatgcgaatgaaatacaatactgaaggacgtgtgtccccatcaccctctcaggaaagtctaagttcatcaaaatcggatacagatacaggggtatgcagtggaactgatgaagaccctgatgataaaaacgcaccctttcggcaacggccattttgcaaatataaaggacatactgctgatctccttgatctttcatggtctaaaaactactttcttctttcttcttcaatggataaaacagtcagattatggcacatttctcgaagagaatgcctttgctgttttcaacatatagattttgtcactgccatagcttttcatccaagagatgacaggtattttctaagtgggtctttggatggaaagctccgcctttggaacatacctgacaaaaaagtggctttgtggaatgaagtagatggtcagacaaaattgatcacagctgcaaatttctgtcagaatggcaaatatgcagtgattgggacatatgatggcagatgtattttctatgatacagagcatttgaaataccatacacaaatacatgtccgatctactagagggcgcaacaaggttggaagaaaaattactggcattgagcctttacctggagaaaataagatattggtaacctcaaatgactccagaatcagactatatgatttgagagatttgtcactatccatgaagtataagggttacgtcaatagcagcagccagatcaaagcaagtttcagtggttcagaagataagtatgtttatatctggagtacctaccatgacctaagcaagtttacttcagtcaggagagatcgtaatgacttctgggaaggtattaaagcccacaatgcagttgttacatcagccatctttgcaccaaacccaagtttgatgttatctttggatgtgcaatctgaaaaatcagaagggaacgagaaaagtgaagatgctgaagttttggatgccacaccttctggtattatgaagacagataacacagaagttcttctctctgctgacttcactggagcaatcaaagtgtttgttaataaaagaaaaaatgtatcttaatttgaaatggcatttaaaataaacatatcagtaagtttctatatgtatcaaaactgaaaaaatagtgttccaggctaacatacttttttaatttttattgaaagttgttcaaatataatatattttttgagaggcagtgttaatgatctaggaaaccctgggctgatagagtagaaaggaatatggctagaataacattgccaaacattaggctttatgttttgttatgtttgtgttttcgttgtataattatgaacatgcacaagtttctgcatgaaaagatattaatatattaatcacatgtatgtgccttttggttacatgcattaaatctaacagagttaaattatttcagtggctcttttggcctcttactaggggggatagtcttgtttctagcttaaacaattttttttttgcacaaaatttcatttttaataaaagtggtatcttttgactgagttattgttttgaaaatggtatataggtttccagtaggtcaacaaccatatgtaaatggtttttataaatttctcaatttggggacaagatttttttgtggtctaaattgtgggcttaagattcttttctttatatgtgtacatataatttttttttctttgccacactggagcacaatgtttctatgtaaagaattattttcattctttatccatgagcaccaggctttgctcacttaaaaaaaaattaagccacattaaggagtgagtcttcttttttacaataatgtaaaaattaaactgtttacatttttttaaagcattgtagtttttaaaaattaagctgttttgttttgtgttgttgaatttgaaagcctttgtaaatatcaatataatgtaccaatgaaataacatctggggcaatgaaaccctgatcatgttgttgatggttagcatatgtttctgaaaattaaatatgtattattaaaa

SEQ ID NO: 7977 - DNA, 2844 bp, Homo sapiens
aacagatctgagcaatatacccggactgttagccatagatcaagtactaccggaagaatcccaaaaggcagagagtcagaatacatttgaagagactgaattagaattaaaaaaatgctttccttctgatgaaacctgtgagaaaccagtagatgaaaccacgaagttaactcaaacaagttcaactgagcagcttaatgtgcttgaaactgaaacagaagtattgaacaaggaagcagtggaagtcaaaggaggtggtgatgttttagagcctgtgtcctcagactccttatctactaaagattttgccgctgtggaagaagtggcccctgccaaacccccaagacaccttactccagagcctgatatagtggctagtacaaagaagcctgttccagcacgcccacctcctccaactaatttcccacctcctagacccccacctccttctcgacctgctccaccaccaagaaaaaggaaaagcgaattggaatttgagactctgaaaactcctgatatagatgttcccaaagagaatattacgtctgattctctcctaaccgcaagcatggcttcagaaagtacggttaaggattctcagccttctcttgatttggcaagtgctaccagtggagataaaatagttaccgcccaggaaaatggaaaagcacctgatgggcagactgtagcaggtgaagtgatgggccctcagagacctagatccaactctgggagagagcttactgatgaggaaattttagccagtgtaatgattaagaacctggatactggagaagaaatacctttgagtcttgcagaagagaaactaccaacaggcattaatcctctcactctacacatcatgagaaggacaaaagaatatgtaagtaatgacgcggcacagtcagatgatgaagagaagttacagtctcagccaacagatactgatggtggaaggttaaaacagaaaacgactcaactaaagaagtttcttggaaaatcagtaaagagagcaaagcaccttgctgaggaatatggtgaacgtgctataaataaagttaaaagtgttagagatgaagtgtttcatactgatcaagatgatccttcatcaagtgatgatgaaggaatgccatacacaagaccagttaaattcaaagcagcacacggtttcaaaggaccttatgattttgatcagatcaaagtggtgcaagatcttagtggtgaacatatgggagctgtttggaccatgaaattttctcactgtggccgattacttgcctcagctggacaagacaatgtagtgagaatatgggctttaaaaaatgcttttgactatttcaacaatatgcgaatgaaatacaatactgaaggacgtgtgtccccatcaccctctcaggaaagtctaagttcatcaaaatcggatacagatacaggggtatgcagtggaactgatgaagaccctgatgataaaaacgcaccctttcggcaacggccattttgcaaatataaaggacatactgctgatctccttgatctttcatggtctaaaaactactttcttctttcttcttcaatggataaaacagtcagattatggcacatttctcgaagagaatgcctttgctgttttcaacatatagattttgtcactgccatagcttttcatccaagagatgacaggtattttctaagtgggtctttggatggaaagctccgcctttggaacatacctgacaaaaaagtggctttgtggaatgaagtagatggtcagacaaaattgatcacagctgcaaatttctgtcagaatggcaaatatgcagtgattgggacatatgatggcagatgtattttctatgatacagagcatttgaaataccatacacaaatacatgtccgatctactagagggcgcaacaaggttggaagaaaaattactggcattgagcctttacctggagaaaataagatattggtaacctcaaatgactccagaatcagactatatgatttgagagatttgtcactatccatgaagtataagggttacgtcaatagcagcagccagatcaaagcaagtttcagccatgattttacttacctcgttagtggttcagaagataagtatgtttatatctggagtacctaccatgacctaagcaagtttacttcagtcaggagagatcgtaatgacttctgggaaggtattaaagcccacaatgcagttgttacatcagccatctttgcaccaaacccaagtttgatgttatctttggatgtgcaatctgaaaaatcagaagggaacgagaaaagtgaagatgctgaagttttggatgccacaccttctgcaatgagttctcgttatgttgcccaggctggtctcgaacttctagcctcaaaaaggtattatgaagacagataacacagaagttcttctctctgctgacttcactggagcaatcaaagtgtttgttaataaaagaaaaaatgtatcttaatttgaaatggcatttaaaataaacatatcagtaagtttctatatgtatcaaaactgaaaaaatagtgttccaggctaacatacttttttaatttttattgaaagttgttcaaatataatatattttttgagaggcagtgttaatgatctaggaaaccctgggctgatagagtagaaaggaatatggctagaataacattgccaaacattaggctttatgttttgttatgtttgtgttttcgttgtataattatgaacatgcacaagtttctgcatgaaaagatattaatatattaatcacatgtatgtgccttttggttacatgcattaaatctaacagagttaaatta

SEQ ID NO: 7978 - DNA, 1392 bp, Homo sapiens
ccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggccgcccaccccaccccccatcttcacaccctagggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttcccccca

SEQ ID NO: 7979 - DNA, 1688 bp, Homo sapiens
ggctcccacaccactgcctcgtgtggggttgttcgcccgtgaaggggcaggacagggtgcgcgctggtggaggttgaaattgttacattttggccgggcgcggtggctcacgcctgtaatcccagcactttgggaggccgaggcaggtggatcacgaggtcaggagatcgagaccatcctggctaacacagtgaaaccccgtctctactaaaaaaatacaaaaaatcagccgggcgtggtgacgggcgcctgtagtcccagctactcaggaggctgaggcaggaggatggcgtgaacccgggaggcggagcttgcagtgagccgagatcgcgccagtgcactccagcctgggcgacagagcgaaactacgtctcaaaaaaaaaaaaaaagaaagaaaagaaattgttacattttatatatataggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttcccccca

SEQ ID NO: 7980 - DNA, 1341 bp, Homo sapiens
gtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaa

SEQ ID NO: 7981 - DNA, 1626 bp, Homo sapiens
tccctcccccggaagtagggcctgatgtaaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgctggctcgcgtgggcaaggtggggcctatgattgggcagtacgtggactctcagtggagcctggcgagcttcactgtgcctgctgagtcagcttgcatctgcgccttcggtcgcaatacttccaagaacgtcaactctgtcattgccatctgcgtagatgggaccttccacaaatatgtcttcactcctgatggaaactgcaacagagaggctttcgacgtgtaccttgacatctgtgatgatgatgacttttaaggaccctgggggctgtgctagggacctgcagtggcagaactgcagagctgagccttggcagtggggcgtgcttggaagccaccagccagcaagcattaatggggctggtgcccactttccactcagcagagctatgtctaaataaagagctcacttccccccagcacttcttgatgactgtgtgccccaagggccaggccagagacccaggaaggcagcgaccccttgggatccctaacctggaggaaattgccagggacccagagggagtgccctaatccaacctggggattttttaaaagcttcctaggaagagatgatctccgatgtgatgaatacgaataaaaggcccttaatggca

SEQ ID NO: 7982 - DNA, 501 bp, Homo sapiens
aaccggtgcggctactctcggccgccgcggaggtccgcgtcttgttagcagggaaggtttactcccccattgtgggtgaccaaggggctgagggcttggccggtttcgctttgctgggggcaaggcacgctctctctccccacccttccgggttccctcagacagtctcggccttgaggaacccccttcgcctccggtcccccagccaaccttcctccgctccccgcgccctccccggagaaccccactgtcactcgcgatgctccgaagacccgggaactaggcgaggaaggcggtggccgcctttttccagctgggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggaga

SEQ ID NO: 7983 - DNA, 580 bp, Homo sapiens
tccccggagaaccccactgtcactcgcgatgctccgaagacccgggaactaggcgaggaaggcggtggccgcctttttccagctgggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggaccacgagcaggtgggcagcatgggcttggtggagatgctgcaccgctccaaccttctggccttggtgggcggtggtagtagtcccaagttctcagagatctcagtgctgatctgggacgatgcccgggagggcaaggactccaaggagaagctggtgctggagttcaccttcaccaagccagtgctttctgtgcgcatgcgccatgacaagatcgtgatcgtgctgaagaaccgcatctatgtgtactccttccccgacaatccccgaaagctgtttgagtttgatacccgggacaaccccaaggccgcccaccccaccccccatcttcacaccctagggctctg

SEQ ID NO: 7984 - DNA, 1176 bp, Homo sapiens
aaacacccgagccgggctccaaggcccgggaggtcagaaaaccgggccgcgggcggcaccgacagctggggcccgggtcagggacacgcggaggtcaggccggtgaaggcggcaggaagctggagcacgatcccaggaggaacaatcctgcaccatgactcaacagccacttcgaggagtgaccagcctgcgtttcaaccaagaccaaagctgcttttgctgcgccatggagacaggtgtgcgcatctacaacgtggagcccttgatggagaaggggcatctggggctctgtgacctctgccccagcctggagaagcaactgctagtgttcccgggacacaagtgtgggagtctgcaacttgtggacctggcgagcacaaagcctggcacctcgtctgctccattcacgatcaatgcacatcagagtgacatagcctgtgtgtctctaaaccagccaggcactgtagtggcctcagcctcccagaagggtacccttattcgcctctttgacacacaatccaaggagaaactggtggagctgcgccgaggcactgaccctgccaccctctactgcattaacttcagccacgactcctccttcctctgcgcttccagtgataagggtactgtccatatctttgctctcaaggatacccgcctcaaccgccgctccgcgtacgtgcggccacttcatacgctcctgagcgcgctggtagtggcggtggccctcggcgtgctggtgtgggcagctgagacccgcgcagctgtgcgccgctgccgccgcagccaccctgcagcctgcctggccgcagtgcttgccgtcggcctcctggtgctctgggtcgcgggcggcgcttgcaccttcctgttcagcatcgccgggccggtgcttctgatcctggtgcacgcctcgttgcgcctgcgcaaccttaagaacaagattgagaacaagatcgagagcattggtctcaagcggacgccaatgggcctgctactagaggcactgggacaagagcaggaggctggatcctaggcccctgggatctgtacccaggacctggagaataccaccccacccccagcccataattgggacccagagccctttcccagcacttaaaacaggagcctagagccccctgcccaaacaaaacaggacatctgtgaccgccctac

SEQ ID NO: 7985 - DNA, 861 bp, Homo sapiens
ggcatttcggtgatcgggttggaactattgaagcccgctttcaggttcttttccccattttccctttgaaaggaagacttctggcttctcctaaatctccgttctctgggtaaggggagtccaagcctctgtcatgaggaacggaaatgcgagggcctcgggtgttactctaaaatccgccctcagcttgcacgccggaagctgcgattcctgcagcggaagaggcgtgatctggccttcgactcgctatgtccactaacaatatgtcggacccacggaggccgaacaaagtgctgaggtacaagcccccgccgagcgaatgtaacccggccttggacgacccgacgccggactacatgaacctgctgggcatgatcttcagcatgtgcggcctcatgcttaagctgaagtggtgtgcttgggtcgctgtctactgctccttcatcagctttgccaactctcggagctcggaggacacgaagcaaatgatgagtagcttcatgctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctggctgtc

SEQ ID NO: 7986 - DNA, 2562 bp, Homo sapiens
tttagaaatcattttatctttttttttttgagatggagtctcactttgtcgcccaggctggagtgcagtggcacaatctcggctcactgcaacctccaactcccgggttcaggcgattctcctgcctccgcctcccgagtggctgggattacaggctcccgtcaccacacctggctaatttttgcatttttagtagagacggggtttcaccatgttggccaggctgatctcaacctcctgacctcaagtgatctgcccaccttggcctcccaaagtgctgggattacaggtgtgagccaccgtgcccggccagattattattattttgtagacagtctgtctttcacccagcatggagtgcaatggtgcctcgaactcttggactcaagtgatccttccacttcagcctcccaagtagctgggattacagctgtgtgccactgtgcccagctgagagtaggttttaatctgagcatgggggcagctatgattccccgtagcacctggggtgagaccaggtcctggctccactcaccctgccaggatctcgtggtctgacaccttcacactggacacgccatctctggcctcatccagcgtctgcactggctcaggcctccgtgagcggcaatcccaacagcggatactggaatcaatagagcctgtgaggccagcatgatggtgaggtcaggtttggagggggagggcagcaccctgggcccccgtgcttaggccccagactcaccggacaggataactgtggcctcttcattaaactgcaccgtgttcaccttctgagaaagttattgccactcagaggaggctggactttggaggactgggataaaggcagggttcccagtgtcggttaaagcaagggcgaaggggaggtgaaaggttttgggggaacagcaaggacaggggttggtgactgcctagcctggcatgcggagtgggggatcgtcatctggggaagggatccttacggtgtaatgggggtggccgtgtcaccacctatgcgctaatacgggtcccctccactcaaatgagggtctccaggctttcactcacccctgcgtggccccggaatttgcgcacgacctgccctgatgccacatcccacagaaccaccgccttgtccccgccgccggagcagagactactgttgtcaaaggagctggagtaaaggaggaggaggatcagcatcgacctcggatcccagcctcagcgctcccatcccagcctggtccccggctcacccggccgcatccagcacctcgtagccgtggccgctgtacgtccgcagcagcgtcccccgaagcgggttccacagcttcagcgtcttgtcactgccgcacgtcaggcagtaattgccatccactggggaacaccaggcgggggttactgggccgtcgatctcaggaggcgggaggaggacccggaatgaagacgaaggcgctcaccattaaatcgtacggctcgcactgccccctgcccgcagtccagcgtcttcaaccgtttctgcggcagctctggaggccgcggctttggctcagggaaagccatgctcccaggactccttccttgcagccttaaatcggtctgtacggaaaattccgcgccttagaaacccacgcttgggtgtaaccttattattgttcttcctgacctacttcctgtttatcacttccgggttcatcattttggcatttcggtgatcgggttggaactattgaagcccgctttcaggttcttttccccattttccctttgaaaggaagacttctggcttctcctaaatctccgttctctgggtaaggggagtccaagcctctgtcatgaggaacggaaatgcgagggcctcgggtgttactctaaaatccgccctcagcttgcacgccggaagctgcgattcctgcagcggaagaggcgtgatctggccttcgactcgctatgtccactaacaatatgtcggacccacggaggccgaacaaagtgctgaggtacaagcccccgccgagcgaatgtaacccggccttggacgacccgacgccggactacatgaacctgctgggcatgatcttcagcatgtgcggcctcatgcttaagctgaagtggtgtgcttgggtcgctgtctactgctccttcatcagctttgccaactctcggagctcggaggacacgaagcaaatgatgagtagcttcatgctgtccatctctgccgtggtgatgtcctatctgcagaatcctcagcccatgacgcccccatggtgataccagcctagaagggtcacattttggaccctgtctatccactaggcctgggctttggctgctaaacctgctgccttcagctgccatcctggacttccctgaatgaggccgtctcggtgcccccagctggatagagggaacctggccctttcctagggaacaccctaggcttacccctcctgcctcccttcccctgcctgctgctgggggagatgctgtccatgtttctaggggtattcatttgctttctcgttgaaacctgttgttaataaagtttttcactctggc

SEQ ID NO: 7987 - DNA, 2409 bp, Homo sapiens
cggacttccggttcaagccggaagttgtggttaccaaggcgacgcaacgccgcccggccagcttttcagtttcatagaggttcccagtgccaccttctgtgatgtcattcccaagaggaagtcagacccagaaaataaagcaccccattggtacacgaaagggaccattggaggtgccacccccaacagagaaggactggcctaaagacgatgaacaggatcatgtcctcgtggatccagatgaggagctggattccttgcctcagccttatcgaatgatcaacaagctggtgaaccttctgtttgaccagtcttgggaaattattgaagagagaaacgcactgagggaagctgagagcagccagatccagcccaccgtctaccctccacttggagaaatccagctcaacaaaatgccaaattgtatggctgtttcccaagactatgtgtttattggaggagccaaaggattctcaatttataatctgtacagtgctaaacaaatatatgcgtgggagaagcttaaggttgatgtcacttccatctgggccacagatttagggaatgaaatactcattgctcctgtggatgaaatgggtatcattagactcttttatttttataaggaaggactttacctagtcaaagccatcaatgaagtggatgataccagcaagcaaactacctgtataaagatggagatctctcaaggaggggactttgcagccttcctcctacaaggagccggagatatttggctggatgtgtataaattgcccaaggagacttggctcaagaaactagagcacccccaactcacttcaaatccaaagaaaaaagtcagacagccgcaactgaactcccttggtcccatttctgcagatcctttagaaatggatgcaaatgttagttttaaaggagacattaaattgagtcttccagtttacataatgaagatcaaaccacctaagcctgttacaggcaccacattcaaaagccccctggaagtctttgcaaagatcaaggactgctacggactgggctccgggcagaatcatttcatcaaggacagtcagtgggagcagcaagctgagatcttcaacgcttcctacaagaagtacctagatagggagtgggaggaagagccactcagtacggccaccttctatttccttcttcctagctgcctatttgcaatgccaccggaagtcaagggcccctcaggaatggcctgtgtccttggtatacactggaccagaagtcacaatttcttcctgtattcactaaaccgaactctaaaggataaagctgaccccgagggtgtgtggccctgtgctgcgcccattgcagtctctcagctcagctgctcctcctcctacctggtgctggcctgcgaggatggtgtgctcacgctgtgggacctggccaaaggattccctcttggggtcgctgctcttcctcagggatgtttctgccaaagcattcacttcctaaaatatttctcggtccacaaaggacagaatatgtatcctgaaggtcaagtgaaatcccaaatgaaatgtgtggtgctgtgcacagacgcctccctccatctggtggaggctagcgggacccaaggacccaccatcagtgtgcttgttgagaggcctgtaaagcacctggataaaaccatctgtgccgtggccccagtcccagccttacctggcatggtgctcatcttttccaagaatggctctgtgtgccttatggatgtggccaagcgtgaaatcatctgtgcctttgcccctccgggagcctttcctctggaggtcccctggaagccagtgtttgctgtgtctccagaccatccatgtttcctgctccgaggagactattcacatgaaactgcgtccaccgacgatgctggaatccaatattctgttttctattttaattttgaggcctgcccactcctggaaaatatctcaaaaaattgtaccattcctcaaagggacttggataacatggccttcccccaagcactgccactggagaagagatgtgagcgtttcctccagaagagctatcggaagctggagaagaacccagagaaggaggaggagcactgggcccggcttcagaggtactccttgtcgctccagagagagaacttcaagaagtgaggctgccaccgccctgggatctctgaaaaggaggtttcagccacgaggcagctgctcccaggacactgaggccaagagaaatgtaacagagccacagctccacaggcctgcactcggagtctggggcctctgcagagccagcaaggggaaaagtataatctgggggaccttcaaccactaagcctcttgtcagagccctcaggcaggcagatgtgtcacccaaataaacagtgatattgtctccaga

SEQ ID NO: 7988 - DNA, 2293 bp, Homo sapiens
accaaggcgacgcaacgccgcccggccagcttttcagtttcatagaggttcccagtgccaccttctgtgatgtcattcccaagaggaagtcagacccagaaaataaagcaccccattggtacacgaaagggaccattggaggtgccacccccaacagagaaggactggcctaaagacgatgaacaggatcatgtcctcgtggatccagatgaggagctggattccttgcctcagccttatcgaatgatcaacaagctggtgaaccttctgtttgaccagtcttgggaaattattgaagagagaaacgcactgagggaagctgagagcagccagatccagcccaccgtctaccctccacttggagaaatccagctcaacaaaatgccaaattgtatggctgtttcccaagactatgtgtttattggaggagccaaaggattctcaatttataatctgtacagtgctaaacaaatatatgcgtgggagaagcttaaggttgatgtcacttccatctgggccacagatttagggaatgaaatactcattgctcctgtggatgaaatgggtatcattagactcttttatttttataaggaaggactttacctagtcaaagccatcaatgaagtggatgataccagcaagcaaactacctgtataaagatggagatctctcaaggaggggactttgcagccttcctcctacaaggagccggagatatttggctggatgtgtataaattgcccaaggagacttggctcaagaaactagagcacccccaactcacttcaaatccaaagaaaaaagtcagacagccgcaactgaactcccttggtcccatttctgcagatcctttagaaatggatgcaaatgttagttttaaaggagacattaaattgagtcttccagtttacataatgaagatcaaaccacctaagcctgttacaggcaccacattcaaaagccccctggaagtctttgcaaagatcaaggactgctacggactgggctccgggcagaatcatttcatcaaggacagtcagtgggagcagcaagctgagatcttcaacgcttcctacaagaagtacctagatagggagtgggaggaagagccactcagtacggccaccttctatttccttcttcctagctgcctatttgcaatgccaccggaagtcaagggcccctcaggaatggcctgtgtccttggtatacactggaccagaagtcacaatttcttcctgtattcactaaaccgaactctaaaggataaagctgaccccgagggtgtgtggccctgtgctgcgcccattgcagtctctcagctcagctgctcctcctcctacctggtgctggcctgcgaggatggtgtgctcacgctgtgggacctggccaaaggacagaatatgtatcctgaaggtcaagtgaaatcccaaatgaaatgtgtggtgctgtgcacagacgcctccctccatctggtggaggctagcgggacccaaggacccaccatcagtgtgcttgttgagaggcctgtaaagcacctggataaaaccatctgtgccgtggccccagtcccagccttacctggcatggtgctcatcttttccaagaatggctctgtgtgccttatggatgtggccaagcgtgaaatcatctgtgcctttgcccctccgggagcctttcctctggaggtcccctggaagccagtgtttgctgtgtctccagaccatccatgtttcctgctccgaggagactattcacatgaaactgcgtccaccgacgatgctggaatccaatattctgttttctattttaattttgaggcctgcccactcctggaaaatatctcaaaaaattgtaccattcctcaaagggacttggataacatggccttcccccaagcactgccactggagaagagatgtgagcgtttcctccagaagagctatcggaagctggagaagaacccagagaaggaggaggagcactgggcccggcttcagaggtactccttgtcgctccagagagagaacttcaagaagtgaggctgccaccgccctgggatctctgaaaaggaggtttcagccacgaggcagctgctcccaggacactgaggccaagagaaatgtaacagagccacagctccacaggcctgcactcggagtctggggcctctgcagagccagcaaggggaaaagtataatctgggggaccttcaaccactaagcctcttgtcagagccctcaggcaggcagatgtgtcacccaaataaacagtgatattgtctccaga

SEQ ID NO: 7989 - DNA, 1923 bp, Homo sapiens
accggcgacccggcccgtggagccggcgcgggcgggctgctgaggtggctgtcgccggctccgagctgcggcttcccgggccgagcccccgatggaggccgaggccgcggacgctcccccgggcggggttgagtcggcgctcagctgcttctctttcaaccaggactgcacatccctagcaactggaactaaagccgggtataagctgttttctctgagttctgtggagcagctggatcaagtccacggaagcaatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaaccatattggtatataaccggaattttatattaaaaggggcctcctttttaaatatatgccgtgtaaaaaatgtacttataggaacatctctttgaattgtatttcttgtatattacatacttagagagagactcttttagccaggcaaagtcttttttggctgtggctggaataaatcatttattacttgggagtcccattttggacactaataataaaatcatggcaatgc

SEQ ID NO: 7990 - DNA, 1575 bp, Homo sapiens
gggctgctgaggtggctgtcgccggctccgagctgcggcttcccgggccgagcccccgatggaggccgaggccgcggacgctcccccgggcggggttgagtcggcgctcagctgcttctctttcaaccaggactgcacatgaaatcccggacgtctacatcgtggagcgcctcttctccagcagcctggtggtggtagtcagtcacacaaaaccacggcagatgaacgtgtatcacttcaagaaaggcacagagatctgtaattacagctactccagcaacatcttgtccataaggctgaaccggcaaaggctgctggtttgcctagaagagtccatttatattcacaacattaaagacatgaagctgttgaagaccctcctggatattcctgcaaacccaacaggtctatgtgctctctctatcaaccattccaattcttacctggcctatcctggaagcctgacttcaggggagattgtgctttatgatggaaactccctgaaaacagtctgcactattgctgcccatgagggaacactagctgccatcaccttcaatgcctcaggctccaaactagcaagtgcgtctgaaaaaggcacagtcatccgggtgttctctgtccctgatgggcaaaagctctatgagttccggagagggatgaaaaggtatgtgacaatcagctctctagtgttcagtatggattcacaattcctctgcgcctccagtaacaccgagacggtacacatcttcaagctggaacaggtcaccaacagtcgaccagaagagccttcgacctggagtggctacatgggaaagatgtttatggctgctaccaactacctccctacccaggtgtcagacatgatgcatcaggacagggcttttgccactgcacgcttgaacttctccggacagaggaacatctgtaccctctcaacgatccagaagttgccacggctgctagttgcgtcatccagtggacacctttatatgtacaatttggatcctcaggatggaggagagtgtgtcttaatcaaaacccacagcttgcttggctcaggaacaacagaagagaataaagaaaatgacctcagaccttccttacctcagtcttatgcagcgaccgtagccagaccaagtgcatcttcagcctccacggtgccaggttattctgaggacggcggggcgctgcgaggagaagttattcctgaacatgagtttgcgacgggaccagtgtgtcttgatgatgagaatgagtttcctcctataatcttgtgccgtggaaatcagaagggcaaaacgaagcagtcatgatgagaagcacacctcagaaatcaggacatcccccctatcaggtggttttggagaaaacaaggaaggcggaagaatggagtgcaattgtgtgagcagaaaggggggcaggaatcccgggtgctccactgcttaaaccacaggacctggttaactcctcaccaagcttcccacgaccctggttgccaatgggcgcgggagacattgtatacacatcatgctatttaaaatacgttcaaactatagtgtaaatgctaattaa

SEQ ID NO: 7991 - DNA, 4476 bp, Homo sapiens
tgcgccgctcgaggccgtgcgtcgcgggggcggggccgcgcaggcgtaccgggtgccccggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacagaagtgaaaggggcatcaagagcagctggtcttggccgtcgcgctgttgtctggtccctagctgttggtagtaagtccggttataaatttttctccctttcttctgtggataagctggaacagatctatgaatgcaccgatacggaagatgtgtgcattgtagagagattgttctccagcagcctagtggccatcgtcagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttcactcttcctgttgaaaaactgtgtgatttttttttttttttaagtaaagtttgtagctcctcccatgcccaggaaagcacagaactcaagtgtggtggccgtctgagctgtcctttcgctggccccgctgtccgcaggggcttcctacctgtgtgagaggtcgtagcgggagacagcaacagagagtaggcggctgggccacgtccttcacagggcgtcatgtgcctttctattttcatcttagaaaatttcctcagcaaaccgatgagagattgtggttgcaagcttcagtatttgcctcgcttcccttcccttttcatatttacagaattaaaacaacctcaagtacctcagactctgcattccaaaccaaggcacccagcagccaaagtgtcgagggcatttaagtggcattaatggcaggagagatggttttagaatctatggagtggtggaagttacggatagaagggaaaaggcaaaaactatttaccctgcctttgcaggctggggtttttgaaccgaggaaggctgggacgcctgtttccagatggttgtcatggtcacgctgggcgaagagctggaggggagttgtcccctcagctgagcggctgcggtgaaatgccccagtgttcctgggttggctttacggcaaactaaatgcaggggacgctggagtccgactcacctacaccggcttcctcccagccgctggtgtgcggcacacacaacatctgcattaggcagaggtgcaagtgggctgattgaacttttccttcaaaacctgcttgtctgtcctggacctttgatgaaatgggatcccggtcacgcaggctgagacagtggggaccgccgaggccagagtgggctatgcttgagcagggatgagaagggccgcggcagcacgcagccttgacccacgcctgcgtcttgtggtgcaaggccagagggctctctctagaacctgaccgtgcactccatctcctgggagccacttttggcaagagtgagtgtggggggaaaaagtgtgcacaagagatacggaaccctgagctagggtttcctgtcaccaaagagtgagctgcatttccagttctgcgttaaagtatcgtttgttctggtgcctgcctgtggtggtgatttggagactcaaatttcctttgccaggtctcttttgtctttctttgggattggtagtatagaagatgctgggaattgtcttcctcgctcagcctcggcttcccgcactgtaagatgaggcagttgcagaggaggcctcggacgtcctgtgaccctcggcccacactcccccttgggtggccctggcagggctggctaggtgcgttccctgcagaccacgggaagccctgtgcttgcctgggtcagggctaagctgtgcgccctagaggagggaggaggactgcagattcttggtcgagaagaatgaagaggatttctgtgtttgctgagcagccattgtggagggttacccgcctccactttcccgttgcccatttcactgccaccagctcctcttcctctgctcgaacctatgagtcccagcctcactggcggcctcagacatgctcaggagtgacggggacagagggaggccgctgagttgcccgttagaactcttactgctgcgccagtgacccaggtggagagggaccctgaaccaaacagaacgtgtgctaattttccgaactccaaactgtacactcatattcatttttaaattgtatttttccaaacttcaaaaaggacgatgagcgtgggggataggaaacaaaacctgtaaacgttgtgaatgggctcagtggactctgggaccaaaccttctgtaatctctaaaacaatgggaccaagagctggatggaacctggagtcaaaaagaactgcttcagtccccgctgtaccgcctgcctagctgtgggagcaggcagggcgcctgggagcctgcgttttctggaccgttccatgggactcatccctacctcacagggctgttgtgaggtgttgtgtgactgcgtgtcctgcaaacgcccagctcggtgcccagccagcggtgggcacccaataaacgctacaacataaatgtgt

SEQ ID NO: 7992 - DNA, 2090 bp, Homo sapiens
atgctcctgaggctccagcgaatcaagaccctcagacccccgggctgtccccaccccatgaccacatgttccgcaggcaccctcagcgctgtgccctgcgtgtcgcccaggcaggtgtttgtttttgagcgcagattctgcctgtggagccatgtggagatgttcacgcatgtacttccctttgtgatttcagccgatacggaagatgtgtgcattgtagagagattgttctccagcagcctagtggccatcgtcagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaagcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattggatcgctctgggatttcttccatggtggacttttgtttctgatcttgttttccctgtggatattggaggacagcgaggttctttctgatactaaaaacctttctttcaggcagcaaatgaacttgaaaggttgcctggactcgctggagcaaaggaaagcgattttgtttgtataattaaatgatctgttcttctacttc

SEQ ID NO: 7993 - DNA, 1948 bp, Homo sapiens
gacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacgtccctagctgttggtagtaagtccggttataaatttttctccctttcttctgtggataagctggaacagatctatgaatgcaccgatacggaagatgtgtgcattgtagagagattgttctccagcagcctagtggccatcgtcagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaagcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggcccca

SEQ ID NO: 7994 - DNA, 2112 bp, Homo sapiens
tcgaggccgtgcgtcgcgggggcggggccgcgcaggcgtaccgggtgccccggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacgtccctagctgttggtagtaagtccggttataaatttttctccctttcttctgtggataagctggaacagatctatgaatgcaccgatacggaagatgtgtgcattgtagagagattgttctccagcagcctagtggccatcgtcagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaaggtacttacgtgccttcatccccaacgagacttgcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataacgctgaggaaatacatcattttcacttcagtggcttttaaatcctgcttatgaattttagctttttgtttgtttgttttctctttttgccaaaattaactgtttggtgaagcccgcaaaacctcctcgctttgcatgcatgaacgtgccaagccagcataggggagctagaagccactttccagccacctgccgttgggttttttcatatctgtacataatgccgagtgcgtaaggaaaccgtggcgtcgcgcacagtgggtctgcttgtcaaggccagttctgcagtgacaggcccaggggctgcccaccaggtgtgctgggcagacttcagctgggacagaagtccgatctccctagggccccacctggaccattttccctccgttttattttgttaattaaattctttccaaattgg

SEQ ID NO: 7995 - DNA, 1663 bp, Homo sapiens
cggctctggagcataaacaagagcggggacgggatgaggcggcggttgatcccagggtggcgagtggcggcgaccgaggcggcgagcggggcccggcgccgaccctgagtgcagcctgacccgccctcgcgcgcgcgccctccccggccgggcccactcgccgcgcgcccagccatgaacctggcgagccagagcggggaggccggcgccggccagctgctcttcgccaacttcaaccaggacaacacagaagtgaaaggggcatcaagagcagctggtcttggccgtcgcgctgttgtctggtccctagctgttggtagtaagtccggttataaatttttctccctttcttctgtggataagctggaacagatctatgaatgcaccgatacggaagatgtgtgcattgtagagagattgttctccagcagcctagtggccatcgtcagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaagcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttattaaaaaaaaaaaaagattgtagtggtagtctaactccataa

SEQ ID NO: 7996 - DNA, 1504 bp, Homo sapiens
acagaactgactgaaaggaacctttgtctttcgtgtgaatgctcgtgaggggccatccttagagtggaaatgctcctgaggctccagcgaatcaagaccctcagacccccgggctgtccccaccccatgaccacatgttccgcaggcaccctcagcgctgtgccctgcgtgtcgcccaggcaggtgtttgtttttgagcgcagattctgcctgtggccatagccatgtggagatgttcacgcatgtacttccctttgtgatttcagccgatacggaagatgtgtgcattgtagagagattgttctccagcagcctagtggccatcgtcagccttaaagcaccaaggaagctaaaggtttgccactttaagaagggaactgagatctgcaactacagctactccaacacgattctggctgtgaagctcaacaggcagaggctgatagtatgcctggaggagtccctgtacatccacaacattcgggacatgaaggtgctgcatacgatcagggagacgcctccaaaccctgcaggcctgtgtgcgctgtcaatcaacaacgacaactgctacttggcgtacccagggagcgcgaccatcggagaggtgcaggtcttcgataccattaatttgagagctgcaaacatgattccggctcacgacagtcctttagcggcactggcctttgacgcaagtggaactaaacttgccacggcttcggagaaggggaccgtgattagggtattttccattccagaaggacaaaaactctttgagtttcggagaggagtaaagaggtgcgtgagcatctgctccctggccttcagcatggacggcatgttcctctccgcctccagcaacactgagaccgtgcacatcttcaaactcgagactgtgaaagaaaaacccccagaggagcccaccacctggaccgggtacttcgggaaagtgctcatggcctccaccagctacctgccttcccaagtgacagaaatgttcaaccagggcagagccttcgccacggtccgcctgccattctgcggccacaaaaacatctgctcgctagccacaattcagaagatcccgcggttgttggtgggtgccgccgacgggtacctgtacatgtacaacctggacccccaggagggcggcgagtgtgccctgatgaagcagcaccggctggacggcagtctggaaacgaccaatgagatcttggactctgcctctcacgactgccccttagtcactcagacatacggcgcagctgcaggaaaagcctacacagacgacctgggtgctgtgggtggcgcctgcctggaggacgaggccagcgccctgcgcctggatgaggacagcgagcacccgcccatgattcttcggactgactgaacttgacctgtgacctctgacccggggagcagagaacactggcttcacagaggactttgtgcattgctgctatgaactttgacctgagtcgggggagaggatggcagagactttatt

SEQ ID NO: 7997 - DNA, 2587 bp, Homo sapiens
gtggggcgcgggcgcgcgcacggacgtccagcacgcacgcacgcacgtccagcacacacgcacatccagcacgcacgcacgtacgtccggcacttccggccgcggcggcctcagcgccggcccgaagggaccaggccgccgtccccagcgagaggcatgcagcgctgaggagcggcgacccagcacggcggcgccatgaacctcctgccgtgtaaccctcacggcaacgggctgctctacgccggcttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctgggggcgccacagcacccaccacctgccgccttcagactctcggggctggtgccagtgccccaggggcctcctgggccacgggctggaggggctgcccagggaccttggtctcgaagccatacgtggttgtctgctttcctaaggactcccatttccagtattaaagagagaatcatcatcaaggcaccgtaggtaactcagtggctgtgaccagctcgactggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaatgacctgaccctgtagagagaacacagtgtgaatgtttcccctcgtgtgagcccagcctgtggtcttctccgtacccgcaacgtggtcatctgtgcccgtgacgtcacctgtgcccgtgcgtggcgtccccgtctccgttggggccattagaatgaggcagacaccaggccactctagaagccgagccgtcacacctcaggcgtgtgcggggcggggacggggggtctcctggttacattttggattaaacctgtttcccggttatgtgtagggaacagcagagtgatgcacgaactttgaacattcgttatggggaaaacatcctttaacttcggggtcgtctgccagagcagggtctgggagggtccatgcagttcccgctggtgtggagggaaatgccctggtctggcctccgagcccccaggtccaccgtctcccctcccctcatttgtaagaatagctacacactaacattttgggaaggagaggcacataactttttttaacatttggtaactaggttatgggctctacattgtcagctacttgggatatatatttaattttcttaaattcccgttaaactctattttatggttttgatttcagattgcaaacatgtaaaacctgcatagcagcgagttctcggttttgccggtttctttagttctttactgtcactgtcatgtaatcagctaattctctgtggatgttgctgtaaagtatgcatgttcctttcatgtgtatttaatcatgatgtttaattttgcacacttatttgtaatgtttcttttaaataaaagtgactaattttgttgtagtctggacctgtaa

SEQ ID NO: 7998 - DNA, 1322 bp, Homo sapiens
ttcaaccaggaccacggatgctttgcgtgtgggatggaaaatggattccgagtctataacactgatccactaaaagaaaaagagaaacaagaatttctagaaggaggagttggccatgttgaaatgttatttcgctgcaactatttagctttagttggtggtggaaaaaagccgaaataccctcccaacaaagtaatgatctgggatgacctgaagaagaagactgttattgaaatagaattttctacagaagtcaaggcagtcaagctgcggcgagatagaattgtggtggttttggactccatgattaaggtgttcacattcacacacaatccccatcagttgcacgtcttcgaaacctgctataaccccaaaggcctctgtgtcctttgtcccaatagtaacaactccctcctggcctttccgggcacgcacacgggccatgtgcagcttgtggacctggccagcacggagaagccacccgtggacattcctgcacacgagggtgtcctgagctgcattgcactcaacctgcagggaacaagaattgcaactgcatccgagaaagggacgcttataagaatatttgatacttcatcagggcatttaatccaggaactgcgaagaggatctcaagcagccaatatttactgcatcaacttcaatcaggatgcgtccctcatctgcgtatccagcgaccacggcacagtgcatatttttgcagctgaagatccaaaaaggaataaacagtccagtttggcctcagccagtttccttccaaaatacttcagttccaagtggagtttctccaagtttcaggttccctcaggctctccgtgcatttgtgcctttggaacagagccaaacgccgtcattgcaatttgtgcagacggcagctactacaaattcctgttcaaccccaagggggagtgcatccgagatgtctacgcgcagtttctagagatgaccgatgacaagctgtgactccagctggcggccactggctgttcccatgagttcagctgtgacgttagcttcagtggctccgccgcatcctcacactgacgggggctccatacggacctggggactgggctgagagggtggacgagttcaggtttgtttttgcagcagattccgtcgttcttactgagtctgcagcgggggagtgaacaagtgtgcagatgtaagttcttacatgataagcagattgaatacaacaccagcagcttgccttagaaaaggagaaaggaattccttttcccgcccgaacatgaagaaaaatgacctgaccctgtagagagaacacagtgtgaatgttt

SEQ ID NO: 7999 - DNA, 2300 bp, Homo sapiens
gttaagggtcacgcaagatggcggcgcccagaggctgctgaggcgcggaacggaggatggcgctggtggcgttggtggctggggctcggctggggcggcggctgagcgggccggggctggggcgagggcactggacggcggccaggcgctcccggagccggcgcgaagcggcagaagccgaggcggaggtgcccgtggtccagtacgtgggcgagcgcgctgcccgcgccgatcgcgtcttcgtgtggggcttcagcttctcgggggcgctgggcgtgccttcctttgtggtgcccagctccgggcccgggccccgcgccggcgcccgaccgcgccgcaggatccagcccgtgccctatcgcctggagctggaccaaaagatttcatctgctgcttgcggctatggattcacactgctgtcctctaagactgcggatgttacgaaagtctgggggatgggactcaacaaagattctcagcttggatttcacaggagccggaaagataaaacgaggggctacgagtatgtgttggagccctcacccgtctccctgcctctggacagacctcaggagacacgggtgctgcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacggagaaggacatgtttttgtctggggctatggaattcttgggaaaggtccaaacctagtggaaagtgccgtccctgaaatgattccacccactctctttggcttgacggagttcaacccagaaatccaggtttcccgcatccgatgtggactcagccactttgctgcactgaccaacaaaggagagctgtttgtatggggcaagaacatccgagggtgcctgggaatcggtcgcctggaggaccagtatttcccatggagggtgacgatgcctggggagcctgtggacgtggcatgtggcgtggaccacatggtgaccctggccaagtcattcatctaaacctccctcacctgcttgggcggccccgtcccgggaaccactggcactccttggcagaggccagcgcgtggccagccccccggggttcttggatggtggtggcggaggaccctgcgtgcagtgtgacgctctgtcctgaatcccttagcgggtacctaccaggaggatcagggcaaggtccctctccagctgcaggtgaggcctgcggaactcagcttggatggcagcctttggtgggccgctgtggcccgcacgtctctgttctctccaagtaacatgcgacggtgtctggtgtcacgtctcgcctgagaagcccgtcttaggaaagcttagcttgaacacagtgctcgggaggtttctgctctgtctgtcatggcagtctcttggtttgtgtctggccaaggccatgcgtgtgcctcggaccgagccccagcttaggcgagggagtcaggctggcttcggccctcggttttcattcaggccaccctgctcatggcccttcctggccgcctgccacaccgcaagctcgctggggggacactagaagcaccgtggcctgggattccatctggagctgtccgcaggcaccagccccagcctcccaccacgctcactgcctggcttggaaaagttaagaagcccctcaggaagagaatcgaggctaagttcctctgcgccgagggccccgagcatatccgccaaggctcagctgcagtgccaggcggaggaggaagatccagaaattgtgaacaatgtttgatttagtagcgtgacttgcctttccctttaaaaacatcttttacaaatctgtcttggaataaagtctattttctgccttttggtttttaa

SEQ ID NO: 8000 - DNA, 2345 bp, Homo sapiens
cggcgaggactggtgttaagggtcacgcaagatggcggcgcccagaggctgctgaggcgcggaacggaggatggcgctggtggcgttggtggctggggctcggctggggcggcggctgagcgggccggggctggggcgagggcactggacggcggccaggcgctcccggagccggcgcgaagcggcagaagccgaggcggaggtgcccgtggtccagtacgtgggcgagcgcgctgcccgcgccgatcgcgtcttcgtgtggggcttcagcttctcgggggcgctgggcgtgccttcctttgtggtgcccagctccgggcccgggccccgcgccggcgcccgaccgcgccgcaggatccagcccgtgccctatcgcctggagctggaccaaaagatttcatctgctgcttgcggctatggattcacactgctgtcctctaagactgcggatgttacgaaagtctgggggatgggactcaacaaagattctcagcttggatttcacaggagccggaaagataaaacgaggggctacgagtatgtgttggagccctcacccgtctccctgcctctggacagacctcaggagacacgggtgctgcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacggagaaggacatgtttttgtctggggctatggaattcttgggaaaggtccaaacctagtggaaagtgccgtccctgaaatgattccacccactctctttggcttgacggagttcaacccagaaatccaggtttcccgcatccgatgtggactcagccactttgctgcactgaccaacaaaggagagctgtttgtatggggcaagaacatccgagggtgcctgggaatcggtcgcctggaggaccagtatttcccatggagggcacctgccccatccgccagcgccaagacaacaggcccactcctctgattacctccgggggatggacggcaaacaggtaaggagttccatgcaactgcggatggagcccctctgagaaacacatgcccctccaagtggggtctggggcctggagagaccctcccacccagcagaccaggagatagctgggggacaagggcagacggcccctgcctgggaaaaaccacactcacaccccaccccgaagagctgtggagaccaaaccaagactacgctacacacagaacgccgagaagataaaccaagctttacacgagcaggatggggatgggaaaactaaaggggccccctgtgaccgaggagcagggtccccagggggcagctcccacggagcgggcttgaacagggaccacccctgcagagccagccagggcggagagccataccctggccccagcgcgccccgacacacatgcttttctccatgacacgaggccagtccccaggagcagccccaggagcacaacctgagatttctaagcttgcaggttacaaaaaacaaaaaaaacagagaagctgcctgcgtaaaaagtgccacccacggaggcaggacacaggcagcgtgtggcccattcagcaggcccaggtcttcagggtgaggctgctggcgagggcaggggagagggggcattctggttaaaagcaagaaattccaaatactcctccctcgggatcaacatccccccaaataagggcgcccagggatcttgcctggggaaagtggggtgcagaaggcatgacccacgccacagcgggctctcagcacccttcccacgtcccatgtcacaggctctttgagctgctggctttgttctctcaagtcaggtctgagggaacccatcggcttctgtaataatcgtattgcctatatacttgaattaaaaatatatggtggctc

SEQ ID NO: 8001 - DNA, 1391 bp, Homo sapiens
ggctgccgtcagcgcctttgccttcaaccaggagtaaaagtggccgtagcctcttccggcgaggactggtgttaagggtcacgcaagatggcggcgcccagaggctgctgaggcgcggaacggaggatggcgctggtggcgttggtggctggggctcggctggggcggcggctgagcgggccggggctggggcgagggcactggacggcggccaggcgctcccggagccggcgcgaagcggcagaagccgaggcggaggtgcccgtggtccagtacgtgggcgagcgcgctgcccgcgccgatcgcgtcttcgtgtggggcttcagcttctcgggggcgctgggcgtgccttcctttgtggtgcccagctccgggcccgggccccgcgccggcgcccgaccgcgccgcaggatccagcccgtgccctatcgcctggagctggaccaaaagatttcatctgctgcttgcggctatggattcacactgctgtcctctaagactgcggatgttacgaaagtctgggggatgggactcaacaaagattctcagcttggatttcacaggagccggaaagataaaacgaggggctacgagtatgtgttggagccctcacccgtctccctgcctctggacagacctcaggagacacgggtgctgcaggtctcctgcggccgagctcactctcttgtgttgactgacagggaaggagtcttcagcatgggaaacaattcttatgggcaatgtggaagaaaggtggtcgaaaatgaaatttacagtgaaagtcacagagtccacaggatgcaggacttcgatggccaggtggtccaggtcgcctgtggtcaggatcatagtctgttcctgacggataaaggagaagtctattcttgtggatggggtgctgatgggcaaacaggtctgggtcactacaatatcaccagctcgcccaccaagctgggtggagacctggcgggagtgaacgttatccaagttgccacctacggtgattgctgcctggccgtgtccgccgacggaggactttttggttggggaaactcggagtacctgcagctggcctctgtcactgactccacacaggtgaatgtgccccgctgcttacacttctcaggagtggggaaggtgcgacaggctgcatgcggtggcacgggctgtgcagtgttaaacgatacatggccacagagctgagtcatcctagagcaaacctctggagtggagagcgaactacttcattcccctcccttagcctgggccagagagactccagctctgccttctccagccaaaaaatcaaaggcagatgggagaacagccttcagctttggataacgatgaaatatctggcaccactgatgaatattaaactttctataacc

SEQ ID NO: 8002 - DNA, 3884 bp, Homo sapiens
tggaggatgcgggctccccgagcgggcttcccctctgcccggcgcgatggagcgggtcggtgagcggaacaaaggcgcctgcccgggggagcgggtcttccgctgaagagcgcgggtggcgcgccgcgacggccgcctgcgggccaaggtgggaggctgtgcggccccaggcgcggcgcgctccgccgtgggcgggcggcgatccctgagtccggcacctgtgcgccgctccctctgtgcctcccgggcagccccgcctgccggcctcggagtccgcggcgccggcggctagaggtccagaggcgaaccacttgctggtgcagaagagaaaccctcaaatccctggcctttcgcggagacgcctggacggggccgtgcgccgtggactgagcaggcgtctcggggagcacttctgcagagcgaggacttccatgtgagcgattccgttctccccaccaccaatccgacctcccagccgtctccgccgcccgagcatccttgaggtgggacgagcaggggcttggatccctgccggccgtctggtgtgtgaggcttgcacggcccctggctgccccgcgcctcgccggagcccgagggggcgcaggtccggggcgagggccggccgggctgtttgatggcttcactgagaagagtcaaagtgctgttggtgttgaacttgatcgcggtagccggcttcgtgctcttcctggccaagtgccggcccatcgcggtgcgcagcggagacgccttccacgagatccggccgcgcgccgaggtggccaacctcagcgcgcacagcgccagccccatccaggatgcggtcctgaagcgcctgtcgctgctggaggacatcgtgtaccggcagctgaatggcttatccaaatcccttgggctcattgaaggttatggtgggcggggtaaagggggccttccggctactctttccccggctgaagaagaaaaggctaagggaccccatgagaagtatggctacaattcatacctcagtgaaaaaatttcactggaccgttccattccggattatcgtcccaccaagtgtaaggagctcaagtactccaaggacctgccccagatatccatcatattcatcttcgtgaacgaggccctgtcggtgatcctgcggtccgtgcacagtgccgtcaatcacacgcccacacacctgctgaaggaaatcattctggtggatgacaacagcgacgaagaggagctgaaggtccccctagaggagtatgtccacaaacgctaccccgggctggtgaaggtggtaagaaatcagaagagggaaggcctgatccgcgctcgcattgagggctggaaggtggctaccgggcaggtcactggcttctttgatgcccacgtggaattcaccgctggctgggctgagccggttctatcccgcatccaggaaaaccggaagcgtgtgatcctcccctccattgacaacatcaaacaggacaactttgaggtgcagcggtacgagaactcggcccacgggtacagctgggagctgtggtgcatgtacatcagccccccaaaagactggtgggacgccggagacccttctctccccatcaggaccccagccatgataggctgctcgttcgtggtcaacaggaagttcttcggtgaaattggtcttctggatcctggcatggatgtatacggaggagaaaatattgaactgggaatcaaggtatggctctgtgggggcagcatggaggtccttccttgctcacgggtggcccacattgagcggaagaagaagccatataatagcaacattggcttctacaccaagaggaatgctcttcgcgttgctgaggtctggatggacgattacaagtctcatgtgtacatagcgtggaacctgccgctggagaatccgggaattgacatcggtgatgtctccgaaagaagagcattaaggaaaagtttaaagtgtaagaatttccagtggtacctggaccatgtttacccagaaatgagaagatacaataataccgttgcttacggggagcttcgcaacaacaaggcaaaagacgtctgcttggaccaggggccgctggagaaccacacagcaatattgtatccgtgccatggctggggaccacagcttgcccgctacaccaaggaaggcttcctgcacttgggtgccctggggaccaccacactcctccctgacacccgctgcctggtggacaactccaagagtcggctgccccagctcctggactgcgacaaggtcaagagcagcctgtacaagcgctggaacttcatccagaatggagccatcatgaacaagggcacgggacgctgcctggaggtggagaaccggggcctggctggcatcgacctcatcctccgcagctgcacaggtcagaggtggaccattaagaactccatcaagtagagggagggagctggggcactggagcctggcccccaggacatggctgctccccccaacatctggaccagctgccctggcggagagacagcaaggggccggcaggtgctcgatgggccccccagggcttctccagggcagcacagggaccccggatgaagactctgtcccccctcaggcattcagctgcccacaagtttcctgcaccctggaaaagccccccacccttcctctgggaaactgacagctgtcttccacagcctctgatgtggacctggtactgaggagcaagactgtccagttctcctccacatctcccatcccagaatcaggatctgggactggcagggtcccctcctgtgtctcatctcttgcagcagcagctgctgaactccagccatcaacacggtgggaggcagcgggggcttcagccatgtcctagctccccgccctaaaaggaggcagtgaggaccaggcactatttcctccgaggttacttctacccagatgacacctgcctgttcacgccccaaggcagctactgcccctaacccttcccaccagggtagctttgggcactgcagctctggacttttctggcccctcctgagatgacctgatggagctgatgctttctctcctaatccctgggcactaggctcttatcagtgtgcttgggccagctctcctgcctgtgtctagaggaagccagagacagaaataggctaagcctgcagtaggatctcagccacaagggccccgcaggatggagctgggtcaaggaccagggagccctgactcccagaggctgccaccggggagaagcagcggtcctccatccagaacctaagggctgaagcaaaggctgccaggacccttgaagatgcttttggctcacctcatttcaccccacgctctgctggctggcagaggagaaggcagtcgtttcctctctgaagagtatttttttcgattgccctctggttagggtgcacatataaatcagagttaatatatgaacgcgtgtgcatgcacaagtgtgtgtgtgcctgcgtgctgtgcgtggcagggtgtgtgtgtgtgtgtctggctgtgcgttccggagtgtgtgacgatgctgacctagctgtgtggccttgggcttgctgcttcattactcacctggatggggacgagggatgagaagggtgtgggtttggccccatgtcactggccggaaggatgtgtctcagccctgccctgtggggtgcccccgatgggaggctgtcccatctcccagtccccatctctttttccccacactgtccctggccaagccctgcccagagctgaaccctgtagctgcccccttgccctgtgtgggattcgcagtgtctcatttggtgacgtcttactggtgatcatctcctcaccccatctcccaccttgtggaataaatacatgttagcacttccca

SEQ ID NO: 8003 - DNA, 5819 bp, Homo sapiens
ggcgcgggtgcgggcgccccagccggccgcgatcgcgggatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgaggcacctacattggatgcttcagtgacgatggccacgagaggactctgaaaggagctgtgttttatgacttgagaaagatgactgtctcccactgccaggatgcgtgtgctgagcggtcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacatgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggctgcgctccccactctgatgctcaggcccgtggcctcactgggacgaacggtgggtggggggctcaccctggtgctgcctcccgcacaaggagacctggacacaacagacacacatcacaaggcgaacacaaatggacacacatacctggccacgaacccacacctcctcagacactcagacaccactccaggctcatagccccgtcttgatgcagagaagccacccacgtggggtgtgccaggcacccccagatacaaatgcagccacgcacagacgtaacacacaggtgccaggccgtgtgctcctggaggctggctggctgtctctctcacacagatacacgtgcgctccctgggatccgggaggccctgggcttcctgtgtgtagccctggcatagacttgctcgtcagggtgttcgactctgggatgctgggccgggcagacatttatgctctgagcagcaaggaccattgggatggaggtgggcacaaagactgctgcttccagggtgtgcggccctggccgtgtgtctgacatcccataaatgtgtgtgtggtgtgactacgggcaccacaaactccgcagccttgcctctcttttctctgtggctgggctggctgcaccatgggcagggttgaggactgccccccaccccgcccaagccaatgcagacactgacctcaagaccagccacaccaagtctgtgcactgcccaccacccccttcaacccctcctacaccatgctccggggcctggggcctccttgcctggcttcttcctccagctatcctcagggaagctggagattcaagtcatgccccagaagcaaggtgtaagcatgggggcgtggggaagagggcaggagctgaagttccaggggagcccaggacccctggggacctgtacactagcaggatgggtcttgggagttggcatggggagattgtaagggctgtatctccgcgattactggtactggtgctccacccataggggccctgttctctctggggtcccacactggggtcatgagagctagttagtactcagcctgacccctaggtctggtcctgccagcctgggatgggggtcaatgtatgctacacatcttgggctcacaagtgaggctgtggaggccaggaggttcaagtatggagggtaggagtgcaacccaggagcaacgctcaaggtggccgagatgcagggaggattgtggcgatccggttgcacactggcctctgtggaggtcagggaggtgggaaggtgggtgggcctgaactcaggcagcccttcagtggcttcttcaggcctaggataaccctggccaggccccatggtcctgctctgggtcagctgtcagggagacctcccttcagcctgagccaagctgcattgggaggagaaggcagggtgagggatctgggagagcaggacgttgagatatcctgaccctctgcttcctagcctgatgatggggaacccagagccacccgctatgagcacaggccgggggtggaaggcccagtagagctgcccttccccagatggaagcttcctccaaccttcagtttggccagtgggtgggtttgggcatctgtgcccctggtggcctccaaatccttcctgggattcccccaaacccacactgatgcgaagctgttcttgaccctcccatagcatcaactcagttcagctcaaagctagaaacaccaaggtctttgaaaatgtttattggctcaggatagcttcggcatccaatctgcgaaggcccctgatggagctatttcttcctagtatcaggagcaattgagacccctcaggagtttccacactgctgtggacgggatagccagggcagacctgcatcccagagcaagcctagatccttgaaagcaatgtcaggcgtggcagtggggaagccatggaggctgggaagggcaaagtgtggagagaggagtgaccgggactggagccagggtctggggagagcaacagcaccaggcttttcctggtagttggattggtacattcactgctgccaggtacccagagatgtcatctctctccaggtagagcatcaccagctcctgtggccttgtagatgactctgtacctcagtgaagagtgcaggcaagtagagtgatggggtcagtgtccatccagtttacgctgagtcagtccatacagcaagacacctggcacttggcaggtactcctggatgttgatgagcaaggaagagcaacggccctgtcagctggcagtggtcctcacagccttcatcccaggtctgcctacgtgggagatctcatcagaaacaggaacggggatctgtctgtgcttgcaggaaagtccatttgtttttctccaagttaggtctcatctacagctcttagcttctcagtaaagaggatactctcccaaccagccaaggaataaaagctgatctgtatgtagggcagaagtgtggcaaatgcatcaggaaccggttagaacagaacagagaaaccctgactgtctacagattccaactttaatagcaagcctgtggagttacacaaacctgtgttaaaacatgtaatttttatggatttcatctcccgttgtggatcaatttggaaaaaccaaaatatgtaattttaaaaaactaaaacacatcctggtagtcccagtgatgtgtaaatgagagagaagaatagacaggcttccaaaccctgggaagaaagctgcttaattatgtgaacatcttataatgaagtctcttgcagctaaaattagattttgagtgcatgaatctgtgataatgtttgcatatcagaatgcattctccccttaaaagtagcagtagccacttggttcttagggggccccaagaggagaggagaagtgctgaggttgatgttacgactgcaagaattcttgggacacaggtttgttttctgctgacttgctcggaaacccattggaggtatctgaaatgtgatgactccaaaggggttcatttcactatagggagaaattgattcgtctgacttcctatttatcaccactcaatattgggtgagttggtctgaacaaggtggggataaagtagagtggaaataatgtagagtcgtcagactgaaaggccaggttgtagtcccagctcttatctgccatcttggacaaagcttttcccatctccagtctcagtttcccatccataaaatgggggaagtggtaggtcttgctgattgcatccacattcattcctccatttcctttcccagcaaccccccatttctgtttgggaattcatatgatctgccagagcctctccaggggtggaatacatgtcctggactaagccaatgacaccttccatctttccagctatggtgactgggttaggtatgatcttgtgagttaagacaatgaagccagagggaatttcaagacttatgggaatgctgggtagaagctgttttaattcccctgttgaatgtgaaaaaggtagtagtattcctgggtctttatgatgaccaccttgggccttgggatcatgaccaggaatcacgtgaagctgacaccactgaagggagagttgagaggcagaaagagatcaagtccttggtgaaattgtttaagtacaggatcaagccttgcttgagattggccttacctctggactttttttgttatatgagctaataaattctgtttattgttt

SEQ ID NO: 8004 - DNA, 2665 bp, Homo sapiens
ggtcagcggagggtttgctccgtctcttggtgaacttgaacagaggcagaggcaaaagcaaaacatttctgcgccaggagatgaggggcggtagagccctggaatggagatgtccttgacgcctgggcagaggctgcagctgcaggaccctgtggccactggagataagtaatggtgccatttgaacacctactggaaacggggcaggaacagtgagtgaccccaggcgagcacaggcaggtgccaggagccaggatgcaaggatgacgcctccggaggccctggcctcactcccacctgggcgctaggagccatcccggggctccagccaggagccctgctgcccaggggcatggccaaacctttcttccgactccagaagtttctccgccgaacacagttcctgctgttcttcctcacggctgcctacctgatgaccggcagcctgctgctgctgcagcgggtccgcgtggctctcccacagggcccccgggcacccggccccctgcagaccttgccagtggccgccgtggcgctgggcgtgggcttgctggacagcagagccctgcacgaccctcgagtcagcccagagctgctgctgggtgtggacatgctgcagagccccctgacccggccccggcccggcccccgctggctccggagccgcaactcggagctgcgtcagttgcgtcgccgctggttccaccacttcatgagtgactcccagggaccgcccgccctgggccccgaggctgccaggcccgccatccacagccgaggcacctacattggatgcttcagtgacgatggccacgagaggactctgaaaggagctgtgttttatgacttgagaaagatgactgtctcccactgccaggatgcgtgtgctgagcggtcctatgtctacgccggcttggaggccggggcggagtgttactgcgggaaccggctgccagcggtgagcgtggggctggaagagtgtaaccatgagtgcaaaggcgagaagggctctgtgtgcggggctgtggaccggctctccgtgtaccgtgtggacgagctgcagccgggctccaggaagcggcggaccgccacctaccgcggatgcttccgactgccagagaacatcacacatgccttccccagctccctgatacaggccaatgtgaccgtggggacttgctcgggcttttgttcccagaaagagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaagacactcgttgtacagacaggaggttcctgcctaacaaatccaaagtgtttgtggctttgtcaagcttcccaggagccgggaacacatgggcacggcacctcattgagcatgccactggcttctatacagggagctactactttgatggaaccctctacaacaaagggttcaagggcgaaaaggaccactggcggagccgacgcaccatctgtgtcaaaacccacgagagtggcaggagggagattgagatgtttgattcagccatcctgctaatccggaacccatacaggtccctggtggcagaattcaacagaaaatgtgccgggcacctgggatatgcagctgaccgcaactggaagagcaaagagtggccggactttgtcaacagctacgcctcgtggtggtcctcgcacgtcctggactggctcaagtacgggaagcggctgctggtggtgcactacgaggagctgcggcgcagcctggtgcccacgttacgggagatggtggccttcctcaacgtgtctgtgagcgaggagcggctgctctgcgtggagaacaacaaggagggcagcttccggcggcgcggccggcgctcccacgaccctgagcccttcaccccggagatgaaagacttgatcaatggctacatccggacggtggaccaagccctgcgtgaccacaactggacggggctgcccagggagtatgtgcccagatgataggcctggcccacgccgccgcccccgctgagtgacgcaatcgcaccacggggctgcgctccccactctgatgctcaggcccgcacaaggagacctggacacaacagacacacatcacaaggcgaacacaaatggacacacatacctggccacgaacccacacctcctcagacactcagacaccactccaggctcatagccccgtcttgatgcagagaagccacccacgtggggtgtgccaggcacccccagatacaaatgcagccacgcacagacgtaacacacaggtgccaggccgtgtgctcctggaggctggctggctgtctctctcacacagatacacgtgcgctccctgggatccgggaggccctgggcttcctgtgtgtagccctggcatagacttgctcgtcagggtgttcgactctgggatgctgggccgggcagacatttatgctctgagcagcaaggaccattgggatggaggtgggcacaaagactgctgcttccagggtgtgcggccctggccgtgtgtctgacatcccataaatgtgtgtgtggtgtgactacgggcaccacaaactccgc

SEQ ID NO: 8005 - DNA, 4693 bp, Homo sapiens
cccagggcccggcaggaggagccttggtggcgagaaaggaaatccaggctcccctttccttaaagccactgcagcagctgggaaggcgcccacagagcgggcgcgccaagcgggacgcgggagtcgcagagagggaccccgggcgcctgctgagctcagctggcagagtttgcaagtggcggagacccttcaggtggcatccctgagtcctgatgcctgactggatggaggcccaccagcttctgttcccatgaggtagaaaggccaagcttggtcttcagctggggaagaggccagaaacaaggcccccagtgaaataacccagatccattggcctgaggagcagagaaagggcaagaagtgaactgcagctgctggtaaccctcagaaaccttctccaagtgctattctcacagttctttaggaacactctgaagtgaagaacaatatgtaggaaaatgggaccaacttatgtgtgttctgagcctcaaaacccccttgttggcccaaagaagctcaccttcagtttgggagggctggtaagctccatcctttctcatggcctcagccaagcattgaacttgccctccccttctggccttggtgatcactttttcaggaagagtgagactgaggacccccaagtgttccatccctaaggaaagcttgggaaaccaagccccttccatcctctcccaagcaccccagccaagccccagagagccagtccggaatgatcccactatggccaagctctggttcaaattccagcggtacttccgccggaaacctgtgcgcttctttaccttcctggcactctacctgactgctgggagccttgtcttccttcactctggctttgtgggccagcccgctgtctcggggaaccaggcgaaccccgctgctgcaggaggcccagctgagggtgctgagctgtccttcttgggtgacatgcatctgggcagaggtttccgggacacaggtgaagcctcaagcattgctcgcaggtacggaccctggttcaagggcaaggatgggaatgagagagccaagcttggcgactacggtggagcctggagccgagccctcaaggggagggttgtccgggagaaggaggaagagcgagccaagtacatcggctgctacctggatgacacccagagtcgggcccttcgaggagtgtccttttttgactacaaaaagatgaccatcttccgttgccaggacaactgtgctgaacggggttacctgtatggcgggctggagttcggcgccgagtgctactgcggccacaagatccaggcgacgaacgtgagcgaggcagagtgcgacatggagtgcaagggcgagcgaggcagcgtgtgcggcggcgccaaccgcctctctgtctaccggctgcagctggcccaggagtcggcccgcaggtatggaagtgcagtgttccggggctgcttccgcaggcccgacaacctttccctggccttacccgtgacagctgccatgctgaacatgtctgtggacaaatgcgtggacttctgcactgagaaggagtacccgctggcagctcttgcaggcaccgcctgccactgtgggtttcccaccacccgattcccgctccatgacagagaggatgagcagctctgtgcccagaagtgcagcgcggaggagtttgagagctgcgggactcctagttacttcattgtgtaccagacacaagtccaagacaaccgttgcatggacagaaggttcctgccaggcaagtccaagcagctcattgctttggccagcttcccaggtgctggcaacacgtgggctcgccacctcattgaattggccacaggcttctacactggcagctactacttcgatggctccctctacaacaaagggtttaaaggtgagcgggaccactggcgcagcggacggaccatctgcatcaagacgcacgaaagcggccagaaagagatcgaggccttcgacgccgccatcctgctcatccgcaacccctacaaagccctcatggctgagttcaaccgcaagtacggcggccacataggctttgctgcgcatgcccactggaagggcaaaggagccgtaccaggatctttgcaaatcttatttcgctcgatttgcacagcatctgtaggagagtggccagagttcgtgaggaactatgccccgtggtgggccactcacacactggactggctcaagtttggcaagaaggtgctggtggtgcactttgaggacctgaagcaggacctctttgtccagctgggccggatggtcagcctgctgggcgtggctgtcagggaggaccggctgctctgtgtggagagccagaaggatggcaacttcaagcgctcagggctccggaagctcgagtatgacccctatactgcggacatgcagaagaccatctctgcctacatcaagatggtggatgcagccctcaaagggcggaacctaacgggtgtccccgatgactactacccaagatgatgcgtccacacagggggagggtagactgggagtcctgaccacgcaggccctggggactcaagacccctggttacccccactcatctgtcctctctttggtctggggacaatccccttggctgctctttgccttcaatgagtttcctgcatgacagaggaggctcaagggaagagattgcccaggcactaccactctgctcacatgttccccccttggcaatgtggggcatcttgtttagggggttctagttacatggactcttttctgtctcctgggtccctgcccccaccactctgggttccatttgtgggagggagggctcatccacatcatggagacttgctggatgccccatggcaattgtcaaggctcttgatgcaagagcccagggggctattgtaaaaacttggccccagatgcttgtcccttctgggctgagatttcgcagcccccttctcatctccacccaagaagtgctggcaccgatgtttaactcaggccaccttctgttctaaagaaagattgctgggaagtttctccgtggccttaggtttctgacatcctggatagtgtggggaggtaatggtgctcacagtaggttaattggagacaccatgtggggccattggtgttatgagccccccaggccacactgcttctcagaaatgagctgcttgcctttccacctccagggcatgaaccctgcccctttctatccatgctgtgtccaggaggtgaccttgagatcctgataccaccttcaaggaacctcaggcaccaacagtgagcccacgaggatggtcacatgccatgtgcagaatttgacttaagagagagccccagtgacacatctctccatggtgggctccagtcagtcttacactgcccttctgacccctacaaatgggtcctttgctatccaggtgagacagcaagagtgttcttaatcagatggaaccacacccaaaatggacccccactaccttcccagaccatatatctccccttgatcatagtccaacagggccagcttcccttgggggccctttaaggaatggggtgaatgaaattgtgtcatttctatacaaacactgctctcttgatgctgaaatgccaaaccgaaggatttctgaggacctaaatcacggagcatcaatcttacaaagtgttggtccagagtcccatctcttccccaaccctggataccagtagcttcccacccagtccaaacctgcaccatccatcattatgtagatgaaaaagccataggtcatagcctctttgctattctattggagtagcctccctaggcagtccctctgaagccttggagtgcaggtaaatgctcattcccaagtagcaaagagaccatggagaaggtgcgtgtaaagagatatatttttgtaagaggaatatgattaatacattccgccccttggaacctggccatgcaaagcaagggcacagggattagacctgtggcacacttccccaattccctcatctgtaggatttgggctgccccaggcccacccagggggctctgaatgtattttgtaccgtgtttctttcccccaggagaatttttagtcttctttcatgaagcagtggaggggttggcctcccttctactgggaggttgactctctctgggagactcttggtccaagacctgggtcagttctttgctggtggtcccctctgaccacaagcttctgcctgaagattcctcaggtcaacaccatcattaaatgcgagttttgttgatgattctaccatgtggtagagtgttgtgtaagacaggttcacaaatgggatgttttcctagtgtgtgtgtgtgtgtgtgtgtgtgtgtatgagagagagagagagagacaacagagacagagagaggcagagaggcatagagagacagagagagagacaagaaacagagatagacagaaaatgttcggggtggcaggcgggttggtgtataactgctttgtgcctgtgtgactctggcatagctgctcagggagaattacgtgcctctgtgtgtaaaattgcctttgtgttctcctgcctttctatgttttgaaactgtatcccacaagttgccggtatgaccatcttatttgtaatgagtctgtgcaggtccttgtgtatggaattgcacccgtgtaaaggaggaaatggtcagtgtgcatg

SEQ ID NO: 8006 - DNA, 4710 bp, Homo sapiens
tttctcataaaatctctgctggaccagccactcctagtggggagcccagggtggtctgggagtgctgcatgcacccagctgctgtatcaccaggacatcaggaggtggagatgttcgcttgtgtgttctccactgcccaaacccaggtggttattctgcaacagctacaacttgagtaagaccaaaacacaactcaagtggactttctaaaaagagaataatttattttggctcccagacatcaaaattcgcaagggattgcttcaggtggcatccctgagtcctgatgcctgactggatggaggcccaccagcttctgttcccatgaggtagaaaggccaagcttggtcttcagctggggaagaggccagaaacaaggcccccagtgaaataacccagatccattggcctgaggagcagagaaagggcaagaagtgaactgcagctgctggtaaccctcagaaaccttctccaagtgctattctcacagttctttaggaacactctgaagtgaagaacaatatgtaggaaaatgggaccaacttatgtgtgttctgagcctcaaaacccccttgttggcccaaagaagctcaccttcagtttgggagggctggtaagctccatcctttctcatggcctcagccaagcattgaacttgccctccccttctggccttggtgatcactttttcaggaagagtgagactgaggacccccaagtgttccatccctaaggaaagcttgggaaaccaagccccttccatcctctcccaagcaccccagccaagccccagagagccagtccggaatgatcccactatggccaagctctggttcaaattccagcggtacttccgccggaaacctgtgcgcttctttaccttcctggcactctacctgactgctgggagccttgtcttccttcactctggctttgtgggccagcccgctgtctcggggaaccaggcgaaccccgctgctgcaggaggcccagctgagggtgctgagctgtccttcttgggtgacatgcatctgggcagaggtttccgggacacaggtgaagcctcaagcattgctcgcaggtacggaccctggttcaagggcaaggatgggaatgagagagccaagcttggcgactacggtggagcctggagccgagccctcaaggggagggttgtccgggagaaggaggaagagcgagccaagtacatcggctgctacctggatgacacccagagtcgggcccttcgaggagtgtccttttttgactacaaaaagatgaccatcttccgttgccaggacaactgtgctgaacggggttacctgtatggcgggctggagttcggcgccgagtgctactgcggccacaagatccaggcgacgaacgtgagcgaggcagagtgcgacatggagtgcaagggcgagcgaggcagcgtgtgcggcggcgccaaccgcctctctgtctaccggctgcagctggcccaggagtcggcccgcaggtatggaagtgcagtgttccggggctgcttccgcaggcccgacaacctttccctggccttacccgtgacagctgccatgctgaacatgtctgtggacaaatgcgtggacttctgcactgagaaggagtacccgctggcagctcttgcaggcaccgcctgccactgtgggtttcccaccacccgattcccgctccatgacagagaggatgagcagctctgtgcccagaagtgcagcgcggaggagtttgagagctgcgggactcctagttacttcattgtgtaccagacacaagtccaagacaaccgttgcatggacagaaggttcctgccaggcaagtccaagcagctcattgctttggccagcttcccaggtgctggcaacacgtgggctcgccacctcattgaattggccacaggcttctacactggcagctactacttcgatggctccctctacaacaaagggtttaaaggtgagcgggaccactggcgcagcggacggaccatctgcatcaagacgcacgaaagcggccagaaagagatcgaggccttcgacgccgccatcctgctcatccgcaacccctacaaagccctcatggctgagttcaaccgcaagtacggcggccacataggctttgctgcgcatgcccactggaagggcaaagagtggccagagttcgtgaggaactatgccccgtggtgggccactcacacactggactggctcaagtttggcaagaaggtgctggtggtgcactttgaggacctgaagcaggacctctttgtccagctgggccggatggtcagcctgctgggcgtggctgtcagggaggaccggctgctctgtgtggagagccagaaggatggcaacttcaagcgctcagggctccggaagctcgagtatgacccctatactgcggacatgcagaagaccatctctgcctacatcaagatggtggatgcagccctcaaagggcggaacctaacgggtgtccccgatgactactacccaagatgatgcgtccacacagggggagggtagactgggagtcctgaccacgcaggccctggggactcaagacccctggttacccccactcatctgtcctctctttggtctggggacaatccccttggctgctctttgccttcaatgagtttcctgcatgacagaggaggctcaagggaagagattgcccaggcactaccactctgctcacatgttccccccttggcaatgtggggcatcttgtttagggggttctagttacatggactcttttctgtctcctgggtccctgcccccaccactctgggttccatttgtgggagggagggctcatccacatcatggagacttgctggatgccccatggcaattgtcaaggctcttgatgcaagagcccagggggctattgtaaaaacttggccccagatgcttgtcccttctgggctgagatttcgcagcccccttctcatctccacccaagaagtgctggcaccgatgtttaactcaggccaccttctgttctaaagaaagattgctgggaagtttctccgtggccttaggtttctgacatcctggatagtgtggggaggtaatggtgctcacagtaggttaattggagacaccatgtggggccattggtgttatgagccccccaggccacactgcttctcagaaatgagctgcttgcctttccacctccagggcatgaaccctgcccctttctatccatgctgtgtccaggaggtgaccttgagatcctgataccaccttcaaggaacctcaggcaccaacagtgagcccacgaggatggtcacatgccatgtgcagaatttgacttaagagagagccccagtgacacatctctccatggtgggctccagtcagtcttacactgcccttctgacccctacaaatgggtcctttgctatccaggtgagacagcaagagtgttcttaatcagatggaaccacacccaaaatggacccccactaccttcccagaccatatatctccccttgatcatagtccaacagggccagcttcccttgggggccctttaaggaatggggtgaatgaaattgtgtcatttctatacaaacactgctctcttgatgctgaaatgccaaaccgaaggatttctgaggacctaaatcacggagcatcaatcttacaaagtgttggtccagagtcccatctcttccccaaccctggataccagtagcttcccacccagtccaaacctgcaccatccatcattatgtagatgaaaaagccataggtcatagcctctttgctattctattggagtagcctccctaggcagtccctctgaagccttggagtgcaggtaaatgctcattcccaagtagcaaagagaccatggagaaggtgcgtgtaaagagatatatttttgtaagaggaatatgattaatacattccgccccttggaacctggccatgcaaagcaagggcacagggattagacctgtggcacacttccccaattccctcatctgtaggatttgggctgccccaggcccacccagggggctctgaatgtattttgtaccgtgtttctttcccccaggagaatttttagtcttctttcatgaagcagtggaggggttggcctcccttctactgggaggttgactctctctgggagactcttggtccaagacctgggtcagttctttgctggtggtcccctctgaccacaagcttctgcctgaagattcctcaggtcaacaccatcattaaatgcgagttttgttgatgattctaccatgtggtagagtgttgtgtaagacaggttcacaaatgggatgttttcctagtgtgtgtgtgtgtgtgtgtgtgtgtgtatgagagagagagagagagacaacagagacagagagaggcagagaggcatagagagacagagagagagacaagaaacagagatagacagaaaatgttcggggtggcaggcgggttggtgtataactgctttgtgcctgtgtgactctggcatagctgctcagggagaattacgtgcctctgtgtgtaaaattgcctttgtgttctcctgcctttctatgttttgaaactgtatcccacaagttgccggtatgaccatcttatttgtaatgagtctgtgcaggtccttgtgtatggaattgcacccgtgtaaaggaggaaatggtcagtgtgcatgaaa

SEQ ID NO: 8007 - DNA, 4481 bp, Homo sapiens
atccccggggcgggtgcccgcgcggggcctcgccgcggctcggggcacccgcagtgccgcccgcccgagcgccaggctcacaggagcccggctttcacttcctctcgcttccgcccgcctccctggctcgccggctggcgtcgccaccgcctcctcgtccccggccaccgctgtcgccgctgctgcaattcaaggcgcacactatcccactttcccgctggaggcgcagaggatgccccttgagccagacctggagaaatagccccagggcccggcaggaggagccttggtggcgagaaaggaaatccaggctcccctttccttaaagccactgcagcagctgggaaggcgcccacagagcgggcgcgccaagcgggacgcgggagtcgcagagagggaccccgggcgcctgctgagctcagctggcagagtttgcaagtggcggagacccttcaggtggcatccctgagtcctgatgcctgactggatggaggcccaccagcttctgttcccatgaggtagaaaggccaagcttggtcttcagctggggaagaggccagaaacaaggcccccagtgaaataacccagatccattggcctgaggagcagagaaagggcaagaagtgaactgcagctgctggtaaccctcagaaaccttctccaagtgctattctcacagttctttaggaacactctgaagtgaagaacaatatgtaggaaaatgggaccaacttatgtgtgttctgagcctcaaaacccccttgttggcccaaagaagctcaccttcagtttgggagggctggtaagctccatcctttctcatggcctcagccaagcattgaacttgccctccccttctggccttggtgatcactttttcaggaagagtgagactgaggacccccaagtgttccatccctaaggaaagcttgggaaaccaagccccttccatcctctcccaagcaccccagccaagccccagagagccagtccggaatgatcccactatggccaagctctggttcaaattccagcggtacttccgccggaaacctgtgcgcttctttaccttcctggcactctacctgactgctgggagccttgtcttccttcactctggctttgtgggccagcccgctgtctcggggaaccaggcgaaccccgctgctgcaggaggcccagctgagggtgctgagctgtccttcttgggtgacatgcatctgggcagaggtttccgggacacaggtgaagcctcaagcattgctcgcaggtacggaccctggttcaagggcaaggatgggaatgagagagccaagcttggcgactacggtggagcctggagccgagccctcaaggggagggttgtccgggagaaggaggaagagcgagccaagtacatcggctgctacctggatgacacccagagtcgggcccttcgaggagtgtccttttttgactacaaaaagatgaccatcttccgttgccaggacaactgtgctgaacggggttacctgtatggcgggctggagttcggcgccgagtgctactgcggccacaagatccaggcgacgaacgtgagcgaggcagagtgcgacatggagtgcaagggcgagcgaggcagcgtgtgcggcggcgccaaccgcctctctgtctaccggctgcagctggcccaggagtcggcccgcaggtatggaagtgcagtgttccggggctgcttccgcaggcccgacaacctttccctggccttacccgtgacagctgccatgctgaacatgtctgtggacaaatgcgtggacttctgcactgagaaggagtacccgctggcagctcttgcaggcaccgcctgccactgtgggtttcccaccacccgattcccgctccatgacagagaggatgagcagctctgtgcccagaagtgcagcgcggaggagtttgagagctgcgggactcctagttacttcattgtgtaccagacacaagtccaagacaaccgttgcatggacagaaggttcctgccaggcaagtccaagcagctcattgctttggccagcttcccaggtgctggcaacacgtgggctcgccacctcattgaattggccacaggcttctacactggcagctactacttcgatggctccctctacaacaaagggtttaaaggtgagcgggaccactggcgcagcggacggaccatctgcatcaagacgcacgaaagcggccagaaagagatcgaggccttcgacgccgccatcctgctcatccgcaacccctacaaagccctcatggctgagttcaaccgcaagtacggcggccacataggctttgctgcgcatgcccactggaagggcaaagagtggccagagttcgtgaggaactatgccccgtggtgggccactcacacactggactggctcaagtttggcaagaaggtgctggtggtgcactttgaggacctgaagcaggacctctttgtccagctgggccggatggtcagcctgctgggcgtggctgtcagggaggaccggctgctctgtgtggagagccagaaggatggcaacttcaagcgctcagggctccggaagctcgagtatgacccctatactgcggacatgcagaagaccatctctgcctacatcaagatggtggatgcagccctcaaagggcggaacctaacgggtgtccccgatgactactacccaagatgatgcgtccacacagggggagggtagactgggagtcctgaccacgcaggccctggggactcaagacccctggttacccccactcatctgtcctctctttggtctggggacaatccccttggctgctctttgccttcaatgagtttcctgcatgacagaggaggctcaagggaagagattgcccaggcactaccactctgctcacatgttccccccttggcaatgtggggcatcttgtttagggggttctagttacatggactcttttctgtctcctgggtccctgcccccaccactctgggttccatttgtgggagggagggctcatccacatcatggagacttgctggatgccccatggcaattgtcaaggctcttgatgcaagagcccagggggctattgtaaaaacttggccccagatgcttgtcccttctgggctgagatttcgcagcccccttctcatctccacccaagaagtgctggcaccgatgtttaactcaggccaccttctgttctaaagaaagattgctgggaagtttctccgtggccttaggtttctgacatcctggatagtgtggggaggtaatggtgctcacagtaggttaattggagacaccatgtggggccattggtgttatgagccccccaggccacactgcttctcagaaatgagctgcttgcctttccacctccagggcatgaaccctgcccctttctatccatgctgtgtccaggaggtgaccttgagatcctgataccaccttcaaggaacctcaggcaccaacagtgagcccacgaggatggtcacatgccatgtgcagaatttgacttaagagagagccccagtgacacatctctccatggtgggctccagtcagtcttacactgcccttctgacccctacaaatgggtcctttgctatccaggtgagacagcaagagtgttcttaatcagatggaaccacacccaaaatggacccccactaccttcccagaccatatatctccccttgatcatagtccaacagggccagcttcccttgggggccctttaaggaatggggtgaatgaaattgtgtcatttctatacaaacactgctctcttgatgctgaaatgccaaaccgaaggatttctgaggacctaaatcacggagcatcaatcttacaaagtgttggtccagagtcccatctcttccccaaccctggataccagtagcttcccacccagtccaaacctgcaccatccatcattatgtagatgaaaaagccataggtcatagcctctttgctattctattggagtagcctccctaggcagtccctctgaagccttggagtgcaggtaaatgctcattcccaagtagcaaagagaccatggagaaggtgcgtgtaaagagatatatttttgtaagaggaatatgattaatacattccgccccttggaacctggccatgcaaagcaagggcacagggattagacctgtggcacacttccccaattccctcatctgtaggatttgggctgccccaggcccacccagggggctctgaatgtattttgtaccgtgtttctttcccccaggagaatttttagtcttctttcatgaagcagtggaggggttggcctcccttctactgggaggttgactctctctgggagactcttggtccaagacctgggtcagttctttgctggtggtcccctctgaccacaagcttctgcctgaagattcctcaggtcaacaccatcattaaatgcgagttttgttgatgattcta

SEQ ID NO: 8008 - DNA, 3534 bp, Homo sapiens
atggccaagctctggttcaaattccagcggtacttccgccggaaacctgtgcgcttctttaccttcctggcactctacctgactgctgggagccttgtcttccttcactctggctttgtgggccagcccgctgtctcggggaaccaggcgaaccccgctgctgcaggaggcccagctgagggtgctgagctgtccttcttgggtgacatgcatctgggcagaggtttccgggacacaggtgaagcctcaagcattgctcgcaggtacggaccctggttcaagggcaaggatgggaatgagagagccaagcttggcgactacggtggagcctggagccgagccctcaaggggagggttgtccgggagaaggaggaagagcgagccaagtacatcggctgctacctggatgacacccagagtcgggcccttcgaggagtgtccttttttgactacaaaaagatgaccatcttccgttgccaggacaactgtgctgaacggggttacctgtatggcgggctggagttcggcgccgagtgctactgcggccacaagatccaggcgacgaacgtgagcgaggcagagtgcgacatggagtgcaagggcgagcgaggcagcgtgtgcggcggcgccaaccgcctctctgtctaccggctgcagctggcccaggagtcggcccgcaggtatggaagtgcagtgttccggggctgcttccgcaggcccgacaacctttccctggccttacccgtgacagctgccatgctgaacatgtctgtggacaaatgcgtggacttctgcactgagaaggagtacccgctggcagctcttgcaggcaccgcctgccactgtgggtttcccaccacccgattcccgctccatgacagagaggatgagcagctctgtgcccagaagtgcagcgcggaggagtttgagagctgcgggactcctagttacttcattgtgtaccagacacaagtccaagacaaccgttgcatggacagaaggttcctgccaggcaagtccaagcagctcattgctttggccagcttcccaggtgctggcaacacgtgggctcgccacctcattgaattggccacaggcttctacactggcagctactacttcgatggctccctctacaacaaagggtttaaaggtgagcgggaccactggcgcagcggacggaccatctgcatcaagacgcacgaaagcggccagaaagagatcgaggccttcgacgccgccatcctgctcatccgcaacccctacaaagccctcatggctgagttcaaccgcaagtacggcggccacataggctttgctgcgcatgcccactggaagggcaaaggagccgtaccaggatctttgcaaatcttatttcgctcgatttgcacagcatctgtaggagagtggccagagttcgtgaggaactatgccccgtggtgggccactcacacactggactggctcaagtttggcaagaaggtgctggtggtgcactttgaggacctgaagcaggacctctttgtccagctgggccggatggtcagcctgctgggcgtggctgtcagggaggaccggctgctctgtgtggagagccagaaggatggcaacttcaagcgctcagggctccggaagctcgagtatgacccctatactgcggacatgcagaagaccatctctgcctacatcaagatggtggatgcagccctcaaagggcggaacctaacgggtgtccccgatgactactacccaagatgatgcgtccacacagggggagggtagactgggagtcctgaccacgcaggccctggggactcaagacccctggttacccccactcatctgtcctctctttggtctggggacaatccccttggctgctctttgccttcaatgagtttcctgcatgacagaggaggctcaagggaagagattgcccaggcactaccactctgctcacatgttccccccttggcaatgtggggcatcttgtttagggggttctagttacatggactcttttctgtctcctgggtccctgcccccaccactctgggttccatttgtgggagggagggctcatccacatcatggagacttgctggatgccccatggcaattgtcaaggctcttgatgcaagagcccagggggctattgtaaaaacttggccccagatgcttgtcccttctgggctgagatttcgcagcccccttctcatctccacccaagaagtgctggcaccgatgtttaactcaggccaccttctgttctaaagaaagattgctgggaagtttctccgtggccttaggtttctgacatcctggatagtgtggggaggtaatggtgctcacagtaggttaattggagacaccatgtggggccattggtgttatgagccccccaggccacactgcttctcagaaatgagctgcttgcctttccacctccagggcatgaaccctgcccctttctatccatgctgtgtccaggaggtgaccttgagatcctgataccaccttcaaggaacctcaggcaccaacagtgagcccacgaggatggtcacatgccatgtgcagaatttgacttaagagagagccccagtgacacatctctccatggtgggctccagtcagtcttacactgcccttctgacccctacaaatgggtcctttgctatccaggtgagacagcaagagtgttcttaatcagatggaaccacacccaaaatggacccccactaccttcccagaccatatatctccccttgatcatagtccaacagggccagcttcccttgggggccctttaaggaatggggtgaatgaaattgtgtcatttctatacaaacactgctctcttgatgctgaaatgccaaaccgaaggatttctgaggacctaaatcacggagcatcaatcttacaaagtgttggtccagagtcccatctcttccccaaccctggataccagtagcttcccacccagtccaaacctgcaccatccatcattatgtagatgaaaaagccataggtcatagcctctttgctattctattggagtagcctccctaggcagtccctctgaagccttggagtgcaggtaaatgctcattcccaagtagcaaagagaccatggagaaggtgcgtgtaaagagatatatttttgtaagaggaatatgattaatacattccgccccttggaacctggccatgcaaagcaagggcacagggattagacctgtggcacacttccccaattccctcatctgtaggatttgggctgccccaggcccacccagggggctctgaatgtattttgtaccgtgtttctttcccccaggagaatttttagtcttctttcatgaagcagtggaggggttggcctcccttctactgggaggttgactctctctgggagactcttggtccaagacctgggtcagttctttgctggtggtcccctctgaccacaagcttctgcctgaagattcctcaggtcaacaccatcattaaatgcgagttttgttgatgattcta

SEQ ID NO: 8009 - DNA, 6460 bp, Homo sapiens
cagagacctggagccagggcagcaagaaggtgtctgttggagccagcagaacagaaccaatttgaacaagaacctccagaggaacgacgaaccctgagaccacagctgctacagaccacaaacaccccatcagccaagagagacccttgcatccagcctctaccctgctgaacatctagatctaaggctcccaatcccatcctcatctctgccccttcttctcagaaggatggccgacacccagacacaggtggcccccacaccaaccatgaggatggcaactgcagaggacctgcccctccctccacccccagccctggaggacctgccactgccgccacccaaggaatccttctccaagttccatcagcagcggcaagctagtgagctccgccgcctctacaggcacatccaccctgagctccgcaagaatctggctgaggctgtggccgaggatctggctgaggtcctgggctctgaggaacccaccgagggtgacgttcagtgcatgcgctggatctttgagaactggagactggatgccattggagaacacgagaggccagctgccaaggagcccgtgctgtgtggtgacgtccaggccacctcccgcaagtttgaggaaggctcctttgccaacagcacagaccaggagccaaccaggccccagccaggtggaggagacgttcgtgcagcccgctggctatttgagacaaagccactggacgagctgacagggcaagccaaggaactggaggccactgtgagggagcctgcagccagcggagatgtgcagggtaccaggatgctctttgagacgcggccgctggaccgcctgggctcccgcccctccctgcaggagcagagccccttggaactgcgctcagagatccaggagctgaagggtgatgtgaaaaagacagtgaagctcttccaaacggagcccctgtgtgccatccaggatgcagagggcgccatccatgaggtcaaggccgcatgccgggaggagatccaaagcaacgcggtgaggtctgcccgctggctctttgagacccggcctctggacgccatcaaccaggaccccagccaggtgcgggtgatccgggggatttccctggaggagggggcccggcccgacgtcagtgcaactcgctggatctttgagacacagcccctggatgccatccgggagatcttggtagatgagaaggacttccagccatccccagaccttatcccacctggtccagatgttcagcagcagcagcatctgtttgagacccgagcgctggacactctgaagggggacgaagaggctggagcagaggccccacccaaggaggaagtggtccctggtgatgtccgctccaccctgtggctatttgaaacaaagcccctggatgctttcagagacaaggtccaagtgggtcacctacagcgagtggatccccaggacggtgaggggcatctatccagtgacagctcctcagcactgcccttctctcagagtgccccccagagggatgagctaaagggggatgtgaagacttttaagaacctttttgagacccttcccttggacagcattggacagggtgaggttctggcccatgggagtccaagcagagaagaaggaactgattctgctgggcaggcccagggcatagggtccccagtgtatgccatgcaggacagcaagggccgcctccatgccctgacctctgttagcagagagcagatagtcggaggtgatgtgcagggctacaggtggatgtttgagacacagcccctagaccagctcggccgaagccccagtaccatcgacgtggtgcggggcatcacccggcaggaagtggtggctggggacgttggcacagctcggtggctttttgagacccagcccctggagatgatccaccaacgggagcagcaggaacgacagaaagaagaagggaagagtcagggagacccccagcctgaggcacccccaaagggcgatgtgcagaccatccggtggttgttcgagacttgcccaatgagtgagttggccgaaaagcaggggtcagaggtcacagatcccacagccaaggctgaggcacagtcctgcacctggatgttcaagccccaacctgtggacaggccagtgggctccagggagcagcacctgcaggttagccaggtcccggctggggaaagacagacagacagacacgtctttgagaccgagcctcttcaggcctcaggccgtccctgtggaagacggcctgtgagatactgcagccgcgtggagatcccttcagggcaggtgtctcgtcagaaagaggtttttcaggccctggaggcaggcaagaaggaagaacaggagccccgggtaatcgctgggtccatccccgcgggttctgtccacaagttcacttggctttttgagaattgtcccatgggctccctggcagctgagagcatccaagggggcaacctcctggaagagcagcccatgagcccctcaggcaacaggatgcaagagagccaggagactgcagctgaggggaccctgcggactctgcatgccacacctggcatcctgcaccatggaggcatcctcatggaggcccgagggccaggggagctctgtcttgccaagtatgtgctctcgggcacagggcaggggcacccttatatacgaaaggaggagctggtgtcaggtgaacttcccaggatcatctgccaagtcctgcgccggccagatgtggaccagcaggggctgctggtgcaggaagacccaactggccagctccaactcaagccgctgaggctgccaactccaggcagcagtgggaatattgaagacatggaccctgagctccagcagctgctggcttgcggtcttgggacctccgtggcaaggactgggctggtgatgcaggagacagagcagggcctggtcgcactgactgcctactctctgcagccccggctaactagcaaggcctctgagaggagcagcgtgcagctgttggccagctgcatagataaaggagacctgagtggcctgcacagtctgcggtgggagcccccggctgacccgagtccagtgccagccagcgagggggcccagagcctgcacccaactgagagcatcatccatgttcccccactggaccccagcatggggatggggcatctgagagcctcaggggccaccccttgccctcctcaggccattggaaaggcagtccctctggctggggaagctgcagcaccagcccaattgcaaaacacagaaaagcaggaagacagtcactctggacagaaagggatggcagtcttgggaaagtcagaaggagccacgactacccctccggggcctggggccccagacctcctggccgccatgcagagtctgcggatggcaacagctgaagcccagagcctgcaccagcaagttctgaacaagcacaagcagggccccaccccaacagccacttccaaccccatccaggacggtcttcggaaagctggggctacccaaagcaacataaggcctgggggtggaagtgatccccggatcccagcagcccccagaaaggtcagtagggaagagcaagcactacccagagggctgcctggggggtgggtgacaattcaggatggcatctacaccgctcatcccgtgaggacctttgacccacctgggggtgtccagctttctcagagggaaccccagtcaaggcacagggagactgccctctcagtccaggctccccgcccactccagggaggcccaggtcagagtactgggccagggcgggaggagcctgggggctgcacacagatggcctgggggccaccagggaaggcgatggcagaagtctgcccagggggcctccaagctgcagagaccaccctgaagactgcccctctaggccgccacattctggcctctgggccccaagctgcaggtgccagcccgcacccccataatgcctttgttcctcctcctcctactctcccagctgctgtgacaggacctgactttccagctggagcccaccgtgctgaggactccatccagcaagcctctgagcccctgaaggacccccttcttcactcccacagcagccctgctggccagagaacccctggagggtcacagacaaagaccccaaaactggaccccaccatgcccccaaagaagaagccgcagctgccccctaaacctgcacacctaacccagagccaccctcctcagaggctgcccaagcccttgcctctatctcccagcttttcctcggaggtggggcaaagagaacaccaacgaggtgagagagatacagccatccctcagccagccaaggttcccactactgtagaccagggccacatacctctggccagatgtcccagtggacatagccagcccagcttacaacatggcctcagcaccacggcccccaggcccaccaagaatcaggctacaggcagcaatgcccagagctctgagccccccaagctcaatgccctcaaccatgatcccacctcaccacagtggggccccggcccctcaggagagcagcccatggaaggttcccaccaaggggcccctgagagccctgacagtctgcaaagaaaccagaaagagctccagggcctcctgaaccaggtgcaagccctggagaaggaggccgcaagcagtgtggacgtgcaggccctgcggaggctctttgaggccgtgccccagctgggaggggctgctcctcaggctcctgctgcccaccaaaagcccgaggcctcagtggagcaggcctttggggagctgacacgggtcagcacggaagttgctcaactgaaggaacagaccttggcaaggctgctggacattgaagaggctgtgcacaaggcactcagctccatgtctagcctccagcctgaggccagtgccagaggccatttccagggacctccaaaagaccacagtgcccacaagatcagtgtcacagtcagcagtagcgccaggcccagtggctcaggccaggaggtcggaggtcaaactgcagtcaagaaccaagccaaggttgaatgccacactgaggcccagagtcaagtcaagatcagaaatcacacagaggccagaggtcacacagcctcaactgccccttccaccaggaggcaggagacatcaagagagtatttgtgccctcctcgggttttaccttccagccgagattctccctcctccccaacatttatctccatccagtcggccacaaggaagcctctagagactcccagctttaagggcaaccctgatgtctcagtgaaaagcacacaactggctcaggacataggccaggccctgctccaccagaaaggtgtccaagacaaaactgggaagaaggacatcacccagtgctctgtgcaacctgaacctgcccctccctcagccagtcccctgcccagagggtggcaaaagagtgttctggagctacagacggggccagggagctcacaacactatggagccatgagaaccgtgactgaacagtatgaggaggtggaccagtttgggaacacagtcctcatgtcttccaccacagtcaccgagcaggcagagccacccaggaacccaggctcccacctcgggctccacgcctcccccttgctgaggcagttcctgcacagcccagctgggttcagcagtgacctgacagaagctgagacggtgcaggtgtcctgcagctactcccagccagctgcccagtgaggcccaccgcctcccaccacacctgccacctgttcctggcctccactgccccaggactgaagtgggtacctgcctcctgtacactggagcaaggaccaagaggaaatggcatcttcagaggattactgtgggccatttccctttcgcagttctttcaataggcccagttcttccaaatggaaaaagaaaggtctggaagaggcccacagagttgcacaggcgtgggggtaggatgggggctcccagctgcttgtggaggatgtaatatatacagacacacacatgtttttcacacaggcctggcccacgcatcgacatgtgtgaatttgcacaccactgcctgaattggagccccccagagtgtccctctacccagagtttttatttctttaattagtctgagtgttcccagccatctgctccttaatccctggagaggaacagagccaactggacacagcgttggtctctgtttggaatcactgtgaggtctccagaaggacctggccgccagccccttcatcaccatctccatcattcagctggtcatctggtggcccaaaggtcacccaaagagtcagcaatcagcatgtccctagaagccaaatgcactgcctttctctgtccccatgactgtcccccactctgcaccccaaatgggaagcatacggtctgaataaatccaagttttattctcta

SEQ ID NO: 8010 - DNA, 6040 bp, Homo sapiens
gacagagacctggagccagggcagcaagaaggtgtctgttggagccagcagaacagaaccaatttgaacaagaacctccagaggaacgacgaaccctgagaccacagctgctacagaccacaaacaccccatcagccaagagagacccttgcatccagcctctaccctgctgaacatctagatctaaggctcccaatcccatcctcatctctgccccttcttctcagaaggatggccgacacccagacacaggtggcccccacaccaaccatgaggatggcaactgcagaggacctgcccctccctccacccccagccctggaggacctgccactgccgccacccaaggaatccttctccaagttccatcagcagcggcaagctagtgagctccgccgcctctacaggcacatccaccctgagctccgcaagaatctggctgaggctgtggccgaggatctggctgaggtcctgggctctgaggaacccaccgagggtgacgttcagtgcatgcgctggatctttgagaactggagactggatgccattggagaacacgagaggccagctgccaaggagcccgtgctgtgtggtgacgtccaggccacctcccgcaagtttgaggaaggctcctttgccaacagcacagaccaggagccaaccaggccccagccaggtggaggagacgttcgtgcagcccgctggctatttgagacaaagccactggacgagctgacagggcaagccaaggaactggaggccactgtgagggagcctgcagccagcggagatgtgcagggtaccaggatgctctttgagacgcggccgctggaccgcctgggctcccgcccctccctgcaggagcagagccccttggaactgcgctcagagatccaggagctgaagggtgatgtgaaaaagacagtgaagctcttccaaacggagcccctgtgtgccatccaggatgcagagggcgccatccatgaggtcaaggccgcatgccgggaggagatccaaagcaacgcggtgaggtctgcccgctggctctttgagacccggcctctggacgccatcaaccaggaccccagccaggtgcgggtgatccgggggatttccctggaggagggggcccggcccgacgtcagtgcaactcgctggatctttgagacacagcccctggatgccatccgggagatcttggtagatgagaaggacttccagccatccccagaccttatcccacctggtccagatgttcagcagcagcagcatctgtttgagacccgagcgctggacactctgaagggggacgaagaggctggagcagaggccccacccaaggaggaagtggtccctggtgatgtccgctccaccctgtggctatttgaaacaaagcccctggatgctttcagagacaaggtccaagtgggtcacctacagcgagtggatccccaggacggtgaggggcatctatccagtgacagctcctcagcactgcccttctctcagagtgccccccagagggatgagctaaagggggatgtgaagacttttaagaacctttttgagacccttcccttggacagcattggacagggtgaggttctggcccatgggagtccaagcagagaagaaggaactgattctgctgggcaggcccagggcatagggtccccagtgtatgccatgcaggacagcaagggccgcctccatgccctgacctctgttagcagagagcagatagtcggaggtgatgtgcagggctacaggtggatgtttgagacacagcccctagaccagctcggccgaagccccagtaccatcgacgtggtgcggggcatcacccggcaggaagtggtggctggggacgttggcacagctcggtggctttttgagacccagcccctggagatgatccaccaacgggagcagcaggaacgacagaaagaagaagggaagagtcagggagacccccagcctgaggcacccccaaagggcgatgtgcagaccatccggtggttgttcgagacttgcccaatgagtgagttggccgaaaagcaggggtcagaggtcacagatcccacagccaaggctgaggcacagtcctgcacctggatgttcaagccccaacctgtggacaggccagtgggctccagggagcagcacctgcaggttagccaggtcccggctggggaaagacagacagacagacacgtctttgagaccgagcctcttcaggcctcaggccgtccctgtggaagacggcctgtgagatactgcagccgcgtggagatcccttcagggcaggtgtctcgtcagaaagaggtttttcaggccctggaggcaggcaagaaggaagaacaggagccccgggtaatcgctgggtccatccccgcgggttctgtccacaagttcacttggctttttgagaattgtcccatgggctccctggcagctgagagcatccaagggggcaacctcctggaagagcagcccatgagcccctcaggcaacaggatgcaagagagccaggagactgcagctgaggggaccctgcggactctgcatgccacacctggcatcctgcaccatggaggcatcctcatggaggcccgagggccaggggagctctgtcttgccaagtatgtgctctcgggcacagggcaggggcacccttatatacgaaaggaggagctggtgtcaggtgaacttcccaggatcatctgccaagtcctgcgccggccagatgtggaccagcaggggctgctggtgcaggaagacccaactggccagctccaactcaagccgctgaggctgccaactccaggcagcagtgggaatattgaagacatggaccctgagctccagcagctgctggcttgcggtcttgggacctccgtggcaaggactgggctggtgatgcaggagacagagcagggcctggtcgcactgactgcctactctctgcagccccggctaactagcaaggcctctgagaggagcagcgtgcagctgttggccagctgcatagataaaggagacctgagtggcctgcacagtctgcggtgggagcccccggctgacccgagtccagtgccagccagcgagggggcccagagcctgcacccaactgagagcatcatccatgttcccccactggaccccagcatggggatggggcatctgagagcctcaggggccaccccttgccctcctcaggccattggaaaggcagtccctctggctggggaagctgcagcaccagcccaattgcaaaacacagaaaagcaggaagacagtcactctggacagaaagggatggcagtcttgggaaagtcagaaggagccacgactacccctccggggcctggggccccagacctcctggccgccatgcagagtctgcggatggcaacagctgaagcccagagcctgcaccagcaagttctgaacaagcacaagcagggccccaccccaacagccacttccaaccccatccaggacggtcttcggaaagctggggctacccaaagcaacataaggcctgggggtggaagtgatccccggatcccagcagcccccagaaagctgctgtgacaggacctgactttccagctggagcccaccgtgctgaggactccatccagcaagcctctgagcccctgaaggacccccttcttcactcccacagcagccctgctggccagagaacccctggagggtcacagacaaagaccccaaaactggaccccaccatgcccccaaagaagaagccgcagctgccccctaaacctgcacacctaacccagagccaccctcctcagaggctgcccaagcccttgcctctatctcccagcttttcctcggaggtggggcaaagagaacaccaacgaggtgagagagatacagccatccctcagccagccaaggttcccactactgtagaccagggccacatacctctggccagatgtcccagtggacatagccagcccagcttacaacatggcctcagcaccacggcccccaggcccaccaagaatcaggctacaggcagcaatgcccagagctctgagccccccaagctcaatgccctcaaccatgatcccacctcaccacagtggggccccggcccctcaggagagcagcccatggaaggttcccaccaaggggcccctgagagccctgacagtctgcaaagaaaccagaaagagctccagggcctcctgaaccaggtgcaagccctggagaaggaggccgcaagcagtgtggacgtgcaggccctgcggaggctctttgaggccgtgccccagctgggaggggctgctcctcaggctcctgctgcccaccaaaagcccgaggcctcagtggagcaggcctttggggagctgacacgggtcagcacggaagttgctcaactgaaggaacagaccttggcaaggctgctggacattgaagaggctgtgcacaaggcactcagctccatgtctagcctccagcctgaggccagtgccagaggccatttccagggacctccaaaagaccacagtgcccacaagatcagtgtcacagtcagcagtagcgccaggcccagtggctcaggccaggaggtcggaggtcaaactgcagtcaagaaccaagccaaggttgaatgccacactgaggcccagagtcaagtcaagatcagaaatcacacagaggccagaggtcacacagcctcaactgccccttccaccaggaggcaggagacatcaagagagtatttgtgccctcctcgggttttaccttccagccgagattctccctcctccccaacatttatctccatccagtcggccacaaggaagcctctagagactcccagctttaagggcaaccctgatgtctcagtgaaaagcacacaactggctcaggacataggccaggccctgctccaccagaaaggtgtccaagacaaaactgggaagaaggacatcacccagtgctctgtgcaacctgaacctgcccctccctcagccagtcccctgcccagagggtggcaaaagagtgttctggagctacagacggggccagggagctcacaacactatggagccatgagaaccgtgactgaacagtatgaggaggtggaccagtttgggaacacagtcctcatgtcttccaccacagtcaccgagcaggcagagccacccaggaacccaggctcccacctcgggctccacgcctcccccttgctgaggcagttcctgcacagcccagctgggttcagcagtgacctgacagaagctgagacggtgcaggtgtcctgcagctactcccagccagctgcccagtgaggcccaccgcctcccaccacacctgccacctgttcctggcctccactgccccaggactgaagtgggtacctgcctcctgtacactggagcaaggaccaagaggaaatggcatcttcagaggattactgtgggccatttccctttcgcagttctttcaataggcccagttcttccaaatggaaaaagaaaggtctggaagaggcccacagagttgcacaggcgtgggggtaggatgggggctcccagctgcttgtggaggatgtaatatatacagacacacacatgtttttcacacaggcctggcccacgcatcgacatgtgtgaatttgcacaccactgcctgaattggagccccccagagtgtccctctacccagagtttttatttctttaattagtctgagtgttcccagccatctgctccttaatccctggagaggaacagagccaactggacacagcgttggtctctgtttggaatcactgtgaggtctccagaaggacctggccgccagccccttcatcaccatctccatcattcagctggtcatctggtggcccaaaggtcacccaaagagtcagcaatcagcatgtccctagaagccaaatgcactgcctttctctgtccccatgactgtcccccactctgcaccccaaatgggaagcatacggtctgaataaatccaagttttattctctactctg

SEQ ID NO: 8011 - DNA, 2596 bp, Homo sapiens
acagagacctggagccagggcagcaagaaggtgtctgttggagccagcagaacagaaccaatttgaacaagaacctccagaggaacgacgaaccctgagaccacagctgctacagaccacaaacaccccatcagccaagagagacccttgctgctgtgacaggacctgactttccagctggagcccaccgtgctgaggactccatccagcaagcctctgagcccctgaaggacccccttcttcactcccacagcagccctgctggccagagaacccctggagggtcacagacaaagaccccaaaactggaccccaccatgcccccaaagaagaagccgcagctgccccctaaacctgcacacctaacccagagccaccctcctcagaggctgcccaagcccttgcctctatctcccagcttttcctcggaggtggggcaaagagaacaccaacgaggtgagagagatacagccatccctcagccagccaaggttcccactactgtagaccagggccacatacctctggccagatgtcccagtggacatagccagcccagcttacaacatggcctcagcaccacggcccccaggcccaccaagaatcaggctacaggcagcaatgcccagagctctgagccccccaagctcaatgccctcaaccatgatcccacctcaccacagtggggccccggcccctcaggagagcagcccatggaaggttcccaccaaggggcccctgagagccctgacagtctgcaaagaaaccagaaagagctccagggcctcctgaaccaggtgcaagccctggagaaggaggccgcaagcagtgtggacgtgcaggccctgcggaggctctttgaggccgtgccccagctgggaggggctgctcctcaggctcctgctgcccaccaaaagcccgaggcctcagtggagcaggcctttggggagctgacacgggtcagcacggaagttgctcaactgaaggaacagaccttggcaaggctgctggacattgaagaggctgtgcacaaggcactcagctccatgtctagcctccagcctgaggccagtgccagaggccatttccagggacctccaaaagaccacagtgcccacaagatcagtgtcacagtcagcagtagcgccaggcccagtggctcaggccaggaggtcggaggtcaaactgcagtcaagaaccaagccaaggttgaatgccacactgaggcccagagtcaagtcaagatcagaaatcacacagaggccagaggtcacacagcctcaactgccccttccaccaggaggcaggagacatcaagagagtatttgtgccctcctcgggttttaccttccagccgagattctccctcctccccaacatttatctccatccagtcggccacaaggaagcctctagagactcccagctttaagggcaaccctgatgtctcagtgaaaagcacacaactggctcaggacataggccaggccctgctccaccagaaaggtgtccaagacaaaactgggaagaaggacatcacccagtgctctgtgcaacctgaacctgcccctccctcagccagtcccctgcccagagggtggcaaaagagtgttctggagctacagacggggccagggagctcacaacactatggagccatgagaaccgtgactgaacagtatgaggaggtggaccagtttgggaacacagtcctcatgtcttccaccacagtcaccgagcaggcagagccacccaggaacccaggctcccacctcgggctccacgcctcccccttgctgaggcagttcctgcacagcccagctgggttcagcagtgacctgacagaagctgagacggtgcaggtgtcctgcagctactcccagccagctgcccagtgaggcccaccgcctcccaccacacctgccacctgttcctggcctccactgccccaggactgaagtgggtacctgcctcctgtacactggagcaaggaccaagaggaaatggcatcttcagaggattactgtgggccatttccctttcgcagttctttcaataggcccagttcttccaaatggaaaaagaaaggtctggaagaggcccacagagttgcacaggcgtgggggtaggatgggggctcccagctgcttgtggaggatgtaatatatacagacacacacatgtttttcacacaggcctggcccacgcatcgacatgtgtgaatttgcacaccactgcctgaattggagccccccagagtgtccctctacccagagtttttatttctttaattagtctgagtgttcccagccatctgctccttaatccctggagaggaacagagccaactggacacagcgttggtctctgtttggaatcactgtgaggtctccagaaggacctggccgccagccccttcatcaccatctccatcattcagctggtcatctggtggcccaaaggtcacccaaagagtcagcaatcagcatgtccctagaagccaaatgcactgcctttctctgtccccatgactgtcccccactctgcaccccaaatgggaagcatacggtctgaataaatccaagttttattctct

SEQ ID NO: 8012 - DNA, 3981 bp, Homo sapiens
ctgggagggaagccggggcgaggcgaggaggtggcgggaggaggagacagcggggaaaggtgtcagataaaggagggctctcctccggtgtggaggcatcatggccgctaaatcagacgggaggctgaaaatgaagaaaagcagcgacgtggcgttcaccccgctgcagaactcggaccactcgggctcggtgcagggattggctccaggcttgccgtcggggtcgggagccgaggacgaggaggcggccgggggcggctgctgcccggacggcggcggctgctcgcgctgctgctgctgctgcgccgggagtggcggctccgcgggctcgggcggctccggcggcgtcgccggcccgggcggcggcggggcgggctcggctgcgctgtgcctgcgcctgggcagggagcagcggcgctactcactgtgggactgcctctggatcctggccgccgtggccgtgtacttcgcggacgtgggcacagacgtctggctcgccgtggactactacctgcgcggccagcgctggtggttcgggctcacgctcttcttcgtggtgctcggctctctgtcggtgcaagtgttcagcttccgctggtttgtgcacgatttcagcaccgaggacagcgccacggccgctgctgcctccagctgcccgcagcctggagccgattgcaagacggtggtcggcggtgggtctgcagccggggaaggcgaggctcgtccttccacgccgcaaaggcaagcatctaacgccagcaagagcaacatcgccgcggccaacagcggcagcaacagcagcggggctacccgggccagtggcaagcacaggtctgcgtcctgctccttctgcatctggctcctgcagtcactcatccacatcttgcagctcgggcaaatctggagatatttccacacaatatacttaggtattcgaagccgacagagtggggagaatgacagatggaggttttactggaaaatggtatatgagtatgcggatgtgagtatgctgcatttgctagccacctttctggaaagtgctccacagctggtcctgcagctctgcattatcgtacagactcatagcttacaggccctccaaggtttcacagcggcagcttccctcgtgtccctggcctgggccttggcctcctaccagaaggccctccgggactctcgagatgacaagaagcccatcagctacatggccgtcatcatccagttctgctggcacttcttcaccatcgccgccagggtcatcacgtttgccctctttgcctcggttttccagctgtactttgggatcttcatcgtccttcactggtgcatcatgaccttctggatcgtccactgtgagacagaattctgtatcaccaaatgggaagagattgtgttcgacatggtggtggggattatctatatcttcagttggttcaatgtcaaggaaggcaggacacgctgcaggctattcatttactattttgtgatccttttggaaaatacagccttgagtgccctctggtacctctacaaggctccccagattgcagacgcatttgccattccagcgctgtgtgtggtgttcagcagctttttaactggcgttgtttttatgctgatgtattatgccttctttcatcccaatggacccagattcgggcagtcaccaagttgtgcttgtgaggacccagccgctgccttcactttgcccccagacgtggccacaagcaccctacggtccatctccaacaaccgcagtgttgtcagcgaccgcgatcagaaattcgcagagcgggatgggtgtgtacctgtctttcaagtgaggcccactgccccatccaccccatcatctcgcccaccacggattgaagaatcagtcattaaaattgacttgttcaggaataggtacccagcatgggagagacatgttttggaccgaagcctccgaaaggctattttagcttttgaatgttccccatctcctccaaggctgcagtacaaagatgatgcccttattcaggagcggttggagtacgaaaccactttataaagcaaaaggagttgcaggacccacaacatccagatgaaggggtgacagcagggctgtggccataatgacacttcatcctagagcagggcagtgagccgtgaagttcctagtgggaccgtcatcaccattatcatttgatcctgtcggctgggggcggctggtctccttccaaagcagctgcacccgagagtctctgactccacctgaaagaatgacgctggcttaataggactctccattgctaccaaactcctcctgcacggtcttgggtgcacccaccagagggtactactattatggaaaaattttgcctccaatcattagggtgtcttgatggcgttaactgatctttccataaaaatagattcagtcatacacacatacacacactaacacacataagttacaccagtcctctgtcaaaaaagcttaggtgacttttcttgatgcaaagctctgattcccacaggaatataaaaacaaagaaagagggaaacatccctcgagaaaaaaaatagtattgcttagaaaagaaaccattttctcatttggaaatccataccatgtgtgaaaatcctatccaacggacagcaaacccaaatgttgtctacacatgtgttagcattgatggagtggttcattttctacacatttcaggatttgttttatattttaaattttcagttgcgaacatcctttttgacagaaatcctatgcagcccatgtacggctttcaacaagaccaaggagctcaataacttcatgatgtaaattaaatagtaatcatgattcagtattcaattgcaaaaatgtaacaggtacacaaagaggaagtggggaaaaaggcaaaatgagagtctgattcccaggcatgtgcagcgcccattgggacataacggcagtgcggcgcgagccagaggaatgggctggaaccggatctgtttccagacgcagaatgagtggctctgtgtgaccataggcagatgctgactctggaagactccgtgccactcctttctagtgccaaacaccatccaaccacaggactgacgtggaagccccaaacaactgagaatgagtggcatgagccccctaaaagcaggcgagagaacgagcaatcaagttctccactgtgtacagacttttcctccccccaatccaaggtcaaagtgatgtgtcttttagaggctttgggacactttttagtaagtatgagcagacaaatgcaatgaatatgctatgaaaaaacccttctgaactgagagagggcttatcactatatccagctaagatttgtatttgaatcatctgtaaagtcgcactcttacaacaagcttctgggttttaaatacctccgtacagcaagtaaacgttccccgctttctgttctcagtgtcctcggtcatggtgcttttcgttgcattaaaagtgccggtcaaactttgatagtatttttttatagttggtgcagagtggaataactcatggattatttcaatatttttgtaataaaaaatatagggtatacacataggcatcatcacattttttatagacctggaatcgtttaaaatactttaagcatcataattacttgggatgtcagaaactggtccacaaattccatcagcctgcctcagcagattgaaaacatttgtctcttgcaagatcaccctactttgcaagttggtgcccccaggaacctggccaggggtgctatcagaatatcaggtgaagagagaatcagcttaaatagaaagggcttgtcaagactggccaatgtttcccaggaaatcaaagatgtaaatgattactttcatccatccattataacaaacctgaccacagtggaagctgtcttaaacttccttccctggttttatattaacccaactgatagattaagtattagtcaaaccactaaaaaa

SEQ ID NO: 8013 - DNA, 3907 bp, Homo sapiens
aaaggagggctctcctccggtgtggaggcatcatggccgctaaatcagacgggaggctgaaaatgaagaaaagcagcgacgtggcgttcaccccgctgcagaactcggaccactcgggctcggtgcagggattggctccaggcttgccgtcggggtcgggagccgaggacgaggaggcggccgggggcggctgctgcccggacggcggcggctgctcgcgctgctgctgctgctgcgccgggagtggcggctccgcgggctcgggcggctccggcggcgtcgccggcccgggcggcggcggggcgggctcggctgcgctgtgcctgcgcctgggcagggagcagcggcgctactcactgtgggactgcctctggatcctggccgccgtggccgtgtacttcgcggacgtgggcacagacgtctggctcgccgtggactactacctgcgcggccagcgctggtggttcgggctcacgctcttcttcgtggtgctcggctctctgtcggtgcaagtgttcagcttccgctggtttgtgcacgatttcagcaccgaggacagcgccacggccgctgctgcctccagctgcccgcagcctggagccgattgcaagacggtggtcggcggtgggtctgcagccggggaaggcgaggctcgtccttccacgccgcaaaggcaagcatctaacgccagcaagagcaacatcgccgcggccaacagcggcagcaacagcagcggggctacccgggccagtggcaagcacaggtctgcgtcctgctccttctgcatctggctcctgcagtcactcatccacatcttgcagctcgggcaaatctggagatatttccacacaatatacttaggtattcgaagccgacagagtggggagaatgacagatggaggttttactggaaaatggtatatgagtatgcggatgtgagtatgctgcatttgctagccacctttctggaaagtgctccacagctggtcctgcagctctgcattatcgtacagactcatagcttacaggccctccaaggtttcacagcggcagcttccctcgtgtccctggcctgggccttggcctcctaccagaaggccctccgggactctcgagatgacaagaagcccatcagctacatggccgtcatcatccagttctgctggcacttcttcaccatcgccgccagggtcatcacgtttgccctctttgcctcggttttccagctgtactttgggatcttcatcgtccttcactggtgcatcatgaccttctggatcgtccactgtgagacagaattctgtatcaccaaatgggaagagattgtgttcgacatggtggtggggattatctatatcttcagttggttcaatgtcaaggaaggcaggacacgctgcaggctattcatttactattttgtgatccttttggaaaatacagccttgagtgccctctggtacctctacaaggctccccagattgcagacgcatttgccattccagcgctgtgtgtggtgttcagcagctttttaactggcgttgtttttatgctgatgtattatgccttctttcatcccaatggacccagattcgggcagtcaccaagttgtgcttgtgaggacccagccgctgccttcactttgcccccagacgtggccacaagcaccctacggtccatctccaacaaccgcagtgttgtcagcgaccgcgatcagaaattcgcagagcgggatgggtgtgtacctgtctttcaagtgaggcccactgccccatccaccccatcatctcgcccaccacggattgaagaatcagtcattaaaattgacttgttcaggaataggtacccagcatgggagagacatgttttggaccgaagcctccgaaaggctattttagcttttgaatgttccccatctcctccaaggctgcagtacaaagatgatgcccttattcaggagcggttggagtacgaaaccactttataaagcaaaaggagttgcaggacccacaacatccagatgaaggggtgacagcagggctgtggccataatgacacttcatcctagagcagggcagtgagccgtgaagttcctagtgggaccgtcatcaccattatcatttgatcctgtcggctgggggcggctggtctccttccaaagcagctgcacccgagagtctctgactccacctgaaagaatgacgctggcttaataggactctccattgctaccaaactcctcctgcacggtcttgggtgcacccaccagagggtactactattatggaaaaattttgcctccaatcattagggtgtcttgatggcgttaactgatctttccataaaaatagattcagtcatacacacatacacacactaacacacataagttacaccagtcctctgtcaaaaaagcttaggtgacttttcttgatgcaaagctctgattcccacaggaatataaaaacaaagaaagagggaaacatccctcgagaaaaaaaatagtattgcttagaaaagaaaccattttctcatttggaaatccataccatgtgtgaaaatcctatccaacggacagcaaacccaaatgttgtctacacatgtgttagcattgatggagtggttcattttctacacatttcaggatttgttttatattttaaattttcagttgcgaacatcctttttgacagaaatcctatgcagcccatgtacggctttcaacaagaccaaggagctcaataacttcatgatgtaaattaaatagtaatcatgattcagtattcaattgcaaaaatgtaacaggtacacaaagaggaagtggggaaaaaggcaaaatgagagtctgattcccaggcatgtgcagcgcccattgggacataacggcagtgcggcgcgagccagaggaatgggctggaaccggatctgtttccagacgcagaatgagtggctctgtgtgaccataggcagatgctgactctggaagactccgtgccactcctttctagtgccaaacaccatccaaccacaggactgacgtggaagccccaaacaactgagaatgagtggcatgagccccctaaaagcaggcgagagaacgagcaatcaagttctccactgtgtacagacttttcctccccccaatccaaggtcaaagtgatgtgtcttttagaggctttgggacactttttagtaagtatgagcagacaaatgcaatgaatatgctatgaaaaaacccttctgaactgagagagggcttatcactatatccagctaagatttgtatttgaatcatctgtaaagtcgcactcttacaacaagcttctgggttttaaatacctccgtacagcaagtaaacgttccccgctttctgttctcagtgtcctcggtcatggtgcttttcgttgcattaaaagtgccggtcaaactttgatagtatttttttatagttggtgcagagtggaataactcatggattatttcaatatttttgtaataaaaaatatagggtatacacataggcatcatcacattttttatagacctggaatcgtttaaaatactttaagcatcataattacttgggatgtcagaaactggtccacaaattccatcagcctgcctcagcagattgaaaacatttgtctcttgcaagatcaccctactttgcaagttggtgcccccaggaacctggccaggggtgctatcagaatatcaggtgaagagagaatcagcttaaatagaaagggcttgtcaagactggccaatgtttcccaggaaatcaaagatgtaaatgattactttcatccatccattataacaaacctgaccacagtggaagctgtcttaaacttccttccctggttttatattaacccaactgatagattaagtattagtcaaaccact

SEQ ID NO: 8014 - DNA, 3053 bp, Homo sapiens
gtctttttctcctgccttctcctggagatgaagagaactgcaaacactgtgtactgctgcacgcgggcctcccccaggccaacagaactgctgggtatatccgcaccatgtacctggggattcagagccagcggcggaaggaacaccagcgacgcttctactgggctatgatgtatgaatatgcagacgtcaacatgctgcgcctcctggagaccttcctggagagcgcgccccaactggtgctacagctctacatcatgctccagaagaacagcgccgagaccctgccctgtgtctcctctgtgacttccctgatgtccctggcttgggtgctagcctcctatcacaagctgctgcgggactccagggacgacaagaagagcatgagctacagaggggccatcatccaggtcttctggcgcctcttcaccatctcatcccgagtgatctcttttgccctctttgcttccatcttccagctctattttgggatcttcgtggtggttcactggtgcgccatggccttctggatcatccatggcggaacagacttctgcatgtccaagtgggaggagatcctcttcaacatggtggtagggatcgtgtacattttctgctggtttaacgtcaaggaagggcggactcgatatcgaatgtttgcatattatacgatagtcttgaccgagaatgctgccttgacgttcctttggtatttttacagagacccggagaccactgactcctatgcggtgccagcactgtgttgtgtctttattagctttgtggctgggatcgcaatgatgctcttatactatggcgtgctgcatcccacaggaccacgagctaagatccttgccagctcctgttgtgccgagctgctctggggcatccctttgccccccgatgttgagcccatggcgcctgagatccctgggtaccgggggacccaggttacgcccaccagagccgtaacggaacaacaggaggatctcacggctgacacttgcttgcctgttttccaagtgagacccatggggccccctaccccgttggggcgtccttacctcccagaagggcccctcattaagattgacatgccaagaaagcgatacccagcttgggatgctcattttgtagacaggaggctgagaaggactattaacattctacaatatgtcacccccaccgcagtaggcattcgatatcgagacggaccactcctctatgagttgctacagtatgagtcttcactctaagagcatcttgaccaagttgagaaggggaccttaagtttggtttgcggcaaacagcacttgcaagaaatataaccctcccttcccccaatacacagaaccaccgccaccaccaccaacaccgccacaccaacaccaccactacaaaaaaaaaagaattaataagtcacaaccccttcaaataagctttctttccagtcgctgtatgtatacaaagatattctctatgttttgtaagtaaaaacaaaaagaaaacctttcttttgttttttacacataagaaacagtattgaaaaatcccacgctatggttcatagggtggagaaggaggagttatctccactccaaaagaaaaaaaaaaagttttttaccttacaccaagtgtagatcatttatgggattggtgctgattgaaagaacaaaacaaaacaaaacaaacacaaacaaacaaaaaaccttcaactgccttatgcccttaggtgctgagtttcattaagtactgtcacgttttctcatgcaaaactctctggtgatttttgcaccagaagagggaaaattaaacaattaaatgaaacaaatctaaaagtgaaacaaaaaccaaccaacaaatacaacacaaagcaattattcttcctatctgattatttgtattgaagaaaacaaatttaccaaaagcaaaagcataaacccctccctcttttcagtttctccccctcctctcctgaccttctccccactttgcagagccttctaggagctcaagggctgtttgaaactcaaatggctggagaagctacttgaaggctgattatgtgccattttagcatttgcctagcaagaatcacattcgtttcccagtgaaaagcaaaccagaacaaaacaaaaagccaccgcaataattcggtaaggacaggatattctaaagcaaattaaaggagatttctgtacacatagtcagtaataataaaactcagcatagtagcaaaaagaacgacatcagtttaaaggcacaatacttaatcagtgactggcaacaacgattagttccatcattttaaggctgtgaatggtagacatttatcacatgtgatattgtgtaaagcctcttctgtttccatttggtgggaagccttaaattgatctggaaagaattcttcatttttcatttgtgcttttttaaaaaaaaaaataacacaaagaggaaaactagaatatatatatatatatacatatatataaaaagtcaaaattgtaataactgacccatttcaaagactgtttggtgcttctgtctttcaccattgtggttggctgaaaatcattcagctcacctggtgcatctgggttgaatgggaaattttgtgtgtgtagtatgtgtgtgtttgtgtgtgtatgtgtgtgtgtgcccatagcacacgtatatatgtgtgtgtccctgctgcaaagtcttgccagagatatacaaaactgatgtaagacgaacttggatcacggcttggttcagcagagcatgggggcgggggctctggagtggtggggaagtgatgctgcctgcccacgagccctggtttgggtggcaagactcacaccagcagcggactgcaggccttagaggccatgccatttgggtgaggatttgattccactgtttattttctcattgtatcaagttgaatttctgcaggtgttgcaagtatgttcaacgatttaaatttttttttatttttcaaagtattgttcctttaaagaatatttctgttctagggcatcgtttcaatcgcatcgtatctctacttgggc

SEQ ID NO: 8015 - DNA, 3382 bp, Homo sapiens
acctccggagctgggaagagagtcaagatggcggcgaaatccgatggcggtggcgtgggggtgggcttcgctcagctgcacaacctggacgaggcggtgggcagcggcggcgaggaggacggggagcccgggggaggcggctgcggcggcggcggcgacggcagcgagcccggcgagagcagctcgatgcacatctgccactgctgcaacacctcctcgtgctactggggctgccgctccgcctgcctgcgctccctcctgggcaggaagccgcgccgcagcgccgccgccgacgggggggaccagccgctgcagcctcccgcggcccccggcgccggccgccaacccccgacgccctcggccgcgcggccggagccgccgccgccgcaggtggagcggccgtggctcgactgcctgtggatcgtgctggcgctgctggtgttcttcggggacgtgggcaccgacctgtggctggccctcgactactaccgcaagggggactacgtctacttcgggctgaccctcttcttcgtgctggtgccgtcgctgctggtgcagagcctgagcttccgctggttcgtgcaggactacacgggcggcgggctgggcgccgtggaggggctcaccagccggggcccccccatgatgggggccggctacgtccacggcgcggcccgcggtggcccaggcgtgagggtctcccccacgccgggggcgcagcgcctgtgtcgcctctccgtgtggatctggcagtcggtcatccacctgctgcagatggggcaggtgtggaggtatatccgcaccatgtacctggggattcagagccagcggcggaaggaacaccagcgacgcttctactgggctatgatgtatgaatatgcagacgtcaacatgctgcgcctcctggagaccttcctggagagcgcgccccaactggtgctacagctctacatcatgctccagaagaacagcgccgagaccctgccctgtgtctcctctgtgacttccctgatgtccctggcttgggtgctagcctcctatcacaagctgctgcgggactccagggacgacaagaagagcatgagctacagaggggccatcatccaggtcttctggcgcctcttcaccatctcatcccgagtgatctcttttgccctctttgcttccatcttccagctctattttgggatcttcgtggtggttcactggtgcgccatggccttctggatcatccatggcggaacagacttctgcatgtccaagtgggaggagatcctcttcaacatggtggtagggatcgtgtacattttctgctggtttaacgtcaaggaagggcggactcgatatcgaatgtttgcatattatacgatagtcttgaccgagaatgctgccttgacgttcctttggtatttttacagagacccggagaccactgactcctatgcggtgccagcactgtgttgtgtctttattagctttgtggctgggatcgcaatgatgctcttatactatggcgtgctgcatcccacaggaccacgagctaagatccttgccagctcctgttgtgccgagctgctctggggcatccctttgccccccgatgttgagcccatggcgcctgagatccctgggtaccgggggacccaggttacgcccaccagagccgtaacggaacaacaggaggatctcacggctgacacttgcttgcctgttttccaagtgagacccatggggccccctaccccgttggggcgtccttacctcccagaagggcccctcattaagattgacatgccaagaaagcgatacccagcttgggatgctcattttgtagacaggaggctgagaaggactattaacattctacaatatgtcacccccaccgcagtaggcattcgatatcgagacggaccactcctctatgagttgctacagtatgagtcttcactctaagagcatcttgaccaagttgagaaggggaccttaagtttggtttgcggcaaacagcacttgcaagaaatataaccctcccttcccccaatacacagaaccaccgccaccaccaccaacaccgccacaccaacaccaccactacaaaaaaaaaagaattaataagtcacaaccccttcaaataagctttctttccagtcgctgtatgtatacaaagatattctctatgttttgtaagtaaaaacaaaaagaaaacctttcttttgttttttacacataagaaacagtattgaaaaatcccacgctatggttcatagggtggagaaggaggagttatctccactccaaaagaaaaaaaaaaagttttttaccttacaccaagtgtagatcatttatgggattggtgctgattgaaagaacaaaacaaaacaaaacaaacacaaacaaacaaaaaaccttcaactgccttatgcccttaggtgctgagtttcattaagtactgtcacgttttctcatgcaaaactctctggtgatttttgcaccagaagagggaaaattaaacaattaaatgaaacaaatctaaaagtgaaacaaaaaccaaccaacaaatacaacacaaagcaattattcttcctatctgattatttgtattgaagaaaacaaatttaccaaaagcaaaagcataaacccctccctcttttcagtttctccccctcctctcctgaccttctccccactttgcagagccttctaggagctcaagggctgtttgaaactcaaatggctggagaagctacttgaaggctgattatgtgccattttagcatttgcctagcaagaatcacattcgtttcccagtgaaaagcaaaccagaacaaaacaaaaagccaccgcaataattcggtaaggacaggatattctaaagcaaattaaaggagatttctgtacacatagtcagtaataataaaactcagcatagtagcaaaaagaacgacatcagtttaaaggcacaatacttaatcagtgactggcaacaacgattagttccatcattttaaggctgtgaatggtagacatttatcacatgtgatattgtgtaaagcctcttctgtttccatttggtgggaagccttaaattgatctggaaagaattcttcatttttcatttgtgcttttttaaaaaaaaaaataacacaaagaggaaaactagaatatatatatatatatacatatatataaaaagtcaaaattgtaataactgacccatttcaaagactgtttggtgcttctgtctttcaccattgtggttggctgaaaatcattcagctcacctggtgcatctgggttgaatgggaaattttgtgtgtgtagtatgtgtgtgtttgtgtgtgtatgtgtgtgtgtgcccatagcacacgtatatatgtgtgtg

SEQ ID NO: 8016 - DNA, 2910 bp, Homo sapiens
agctcaggcgggtgggggcggggcggggcggcgccgaggagaatgaataattgaagtggaggggaggaggaagaagaggagaaggaggaagaggagccgcccgcgcagggtcctccccacgccgcacccccctccgccgcccggaagtcgctccccgcctccctctccgccaacatggccgcgaagtcggatggagcggcggcctcggccagcccggacccggagggggctgccggtggagcccggggcagtgccggcgggcgcggggaggcggcggcggcggccgggcccccgggggtcgtcggggcgggcggcccggggccgcgctacgagctgcgggactgctgctgggtgctgtgcgcgctgctcgtgttcttctccgacggtgccacggacctgtggctggcggcctcctactacctgcagaatcaacacacctacttcagcctcaccttgctgttcgtgctcctgccctcgctggtcgtgcagttactgagcttccgctggttcgtctacgactactcggagcccgcagggtccccgggacccgccgtcagcaccaaggacagcgtagccggcggagccgccatcagcaccaaggacagcgccggcgccttccggaccaaagaaggcagccccgagccgggtccccagcctgcgccctcctcggccagcgcctaccgccgccgctgctgccgcctctgcatctggctgctgcagaccctcgtccacctcctgcagctcggccaggtctggaggtacctgcgcgccctgtacctggggctgcagagccgctggcgcggggagcggctgcggcgccacttctactggcagatgctgttcgagagcgccgacgtgagcatgctgcgcttgctggagaccttcctgcgcagcgcgccgcagctagtgctgcagctcagcctgctggtgcaccgcggtggcgcgcccgacctgctgccggccctctccacctccgcctccctcgtgtctctggcctggacgctggcctcctaccagaaggtgctgcgggactcgcgggacgacaagcggccgctgtcctacaagggcgccgtggcacaggtgctgtggcacctgttcagcattgccgcccgcggcctggccttcgcgctcttcgccagcgtctacaagctctattttggcatcttcatcgtggcccactggtgcgtcatgaccttctgggtcatccaaggggagacggacttctgcatgtccaagtgggaggagatcatctacaacatggtcgtgggcatcatctacatcttctgctggttcaacgtcaaggagggccgcagccgccgccgcatgaccctctaccactgcatcgtcctgctggagaacgccgcgctcaccggcttctggtactccagccgcaacttctcaaccgacttctactcgctcatcatggtctgcgtagtggcctccagctttgcgctgggcatattcttcatgtgtgtctactactgtctcctgcaccccaatgggcccatgctgggtccccaggcacctggttgcatcttccgtaaggcctcagagccctgtggcccacccgctgacgccatcacgagtccccccaggtccctgccaaggactacaggtgctgagcgggatggggcctcggcgggagagcgtgcagggacccccaccccacctgtcttccaggtgcggcctggcttgcctcccacaccagtggcccgcaccttgcggacagaggggcctgtcatccggattgacttgcctcgcaagaagtacccggcctgggatgctcattttattgaccgccggctccggaagaccatcctggcactggagtactcctcacctgccacgccccggttgcagtaccggagtgtggggacttcccaggagctgctggagtatgagaccacagtgtaggctacagtgtcccagcacaaaagggacaggcttggctgatcccacatccgccgcagtgttgtgccccgaatttcagggccaccaggctaagggggagtggatctgttggtccaagggtagagtggccccactcttgggttctttcaggggagggggcagccttgcggaggccccagccctgggccccgttttcagccttgtggcccattccctaaattcccctgacccagggcctggggaatcatctggtgctacacttttcgagctgccctgctttcatggggcctccacacctctcccctgcctggcgttgcccatgtgttgcccctgctggacttgccagagaaagggcactgtctggggtccatgacctagaccctgtgctcctcaggggttgtggagagtgggctgcctctatggtgggaaaagatctctgagaaggatggaggtggccgtggaagggatggggtgaggttggagcattgtgtggacagggatggcgtggctcctgtagcatctgaggcctggagccagggcaagagggagctgaagaagggagttggggtggggcagggtgttggggtggggggctggcagtgctggagatggataggagaaagaactggggggggggtctaggctggcagaagcatggaggggtggaagacttgggggaggggaacctgcaatccagagcatagcgaacaagaatgaactccttaggagacgtctcttgttgtgttgtgggctctgtgaaggatgaagttccacacacctcaggtgaaatgtttgaaggagccattttttgttctagatgtgcacctggaacgtggcttctagatacaggtcttcaacacagcagataagatgtctggaaagatctctgggctcaagtgcaggtgaggttttagcacagttatcagaggaactgatccagaagcaggcttagttctagattgagttctagagtgctaggctgataaaatgtcccaggga

SEQ ID NO: 8017 - DNA, 2692 bp, Homo sapiens
attcccttccgtatggaaatgaggttaactcatttgcaggaacctaacgcccgccctcccccgactcggatcgctggcgtgaacccagcggccccgtgctctccgggtatccctggatcgaggcgcacgcgttgttgcaaagtctcgcacttagggattagaatgtgcctttgcgtttcgttttgttttgcaacaatacaggtgtgagggatcgcagccctggtccaggctctagtctccccgccctctcgctttcttgggcctccgggcgcctcaaaggtaaaactaggccatttgaagcctgcgaagcgaagggcagtcggtcttcaggcctagcgggcttggctgggctgggtcggtggacccctgggctggcggcgggagcagagcatcgagcggcttttagctggggttcgggcggaggacctgggacaaccgcgggcctcgctcctccccggacggggcgggacggggaagtcccgcccaccaggcccaggccccgggccgccccgagggctgcgcccacctccttcctgcctcggcaaccccgggccctgagggcaggccccaaccgcggaggagcaggagagggcggaggccggcgggccatgccctggtcgtcccgcggcgccctccttcgggacctggtcctgggcgtgctgggcaccgccgccttcctgctcgacctgggcaccgacctgtgggccgccgtccagtatgcgctcggcggccgctacctgtgggcggcgctggtgctggcgctgctgggcctggcctccgtggcgctgcagctcttcagctggctctggctgcgcgctgaccctgccggcctgcacgggtcgcagcccccgcgccgctgcctggcgctgctgcatctcctgcagctgggttacctgtacaggtgcgtgcaggagctgcggcaggggctgctggtgtggcagcaggaggagccctctgagtttgacttggcctacgccgacttcctcgccctggacatcagcatgctgcggctcttcgagaccttcttggagacggcaccacagctcacgctggtgctggccatcatgctgcagagtggccgggctgagtactaccagtgggttggcatctgcacatccttcctgggcatctcgtgggcactgctcgactaccaccgggccttgcgcacctgcctcccctccaagccgctcctgggcctgggctcctccgtgatctacttcctgtggaacctgctgctgctgtggccccgagtcctggctgtggccctgttctcagccctcttccccagctatgtggccctgcacttcctgggcctgtggctggtactgctgctctgggtctggcttcagggcacagacttcatgccggaccccagctccgagtggctgtaccgggtgacggtggccaccatcctctatttctcctggttcaacgtggctgagggccgcacccgaggccgggccatcatccacttcgccttcctcctgagtgacagcattctcctggtggccacctgggtgactcatagctcctggctgcccagcgggattccactgcagctgtggctgcctgtgggatgcggctgcttctttctgggcctggctctgcggcttgtgtactaccactggctgcaccctagctgctgctggaagcccgaccctgaccaggtagacggggcccggagtctgctttctccagaggggtatcagctgcctcagaacaggcgcatgacccatttagcacagaagtttttccccaaggctaaggatgaggctgcttcgccagtgaagggataggtgaacggcgtcctttgaagcaggatcagacccagccagcagagatggagagtgactctgttggcagaaggcaggcgaggataagctaacgatgctgctgtggcctctatgcactcagcaagagcgggacgcctgtgctgggccgggcaccagggatggtgctgagtcgggcagaggcctcctttcaaggagttcacagtgaacaagatgagaagggctgggccctggagggtcaagagccccaattatgtacaagacactttgggaggaaagaagactaccttttccccctgccattggtatagctggtgccccaaaacttccacctccctccctggctacctctaaaatgactggtataggtgctgccccaccccttagctcccctatcctgggctaggaggccacaggggctgtcctctagaattcttccttccctcccccacaccattcattcaattcatgaaacaaatctttgccaagagcagtttatgtgccaggaacatcattctgtccttgcaacctggaacaagaccagctaccagcctagcttcatccgctacttgcaccaaccagtcccgggttagatcccaaatgctagaagccagggatgcccaactctgggtggccccagtcagaacctctgggatctcagtgaagctggcctggcctctgctcctgctctcaaggggctgcttttcaaccaagagccttgtgagcctggtctgagccttgcacagccactgagtattttttttgccttagccagtgtacctcctacctcagtctatgtgagaggaagagaatgtgtgtgcctgtgggtctctacaagtgacagatgtgttgttttcaacagtattattaggttatgaataaagcctcatgaaatcctccaa

SEQ ID NO: 8018 - DNA, 3174 bp, Homo sapiens
gcgcgggcagtggtgggaaggctggcgcgaggcgtgaggtggcgtgaggcgaagctggaatctgcctctgtcacgggggctggtgcctcacgggtttgtgtcctagacaggcgagtggatccaagtgggcgagagacattttaatctggaagagtcttgtgatttgggagacagtgaagaagaagtaaaatattcacaagatgaagatttttccagaagggactttgagtcaaagatggctttttatatttgacaagtcttgtcatctgtaatgaagatcattgtgaaacagaagattgattaaagccttgtaacattggacctagattagagatttagaaaagaaagtcaaaattagtcactttagtgttagtgttcccatttcataatatttattctttcttctaaatagatttagggagtagaaattaaaattcaatgctataccaaagggtatactaatatttgtttggctttttttccctttttgtgagggagaaaaaagtagataacgaaaagctatagtcattcgtaatgaaatatactaaacagaattttatgatgtcagttcttggcattataatctacgtaactgatttaattgtggacatatgggtatctgtcagatttttccatgaaggacagtatgtttttagtgctttagcgttaagctttatgctttttggaacacttgtggctcagtgttttagttattcttggttcaaggctgatttaaagaaagcaggccaagaaagtcagcattgttttcttctacttcattgcttgcaaggaggagtttttacaaggtattggtttgccttaaaaaggggttaccatgcagcttttaaatatgacagcaatactagtaacttcgtggaagaacaaattgatctacataaagaagttatagatagagtgactgatttgagcatgctcagactatttgagacctacctggaaggctgcccacaacttattcttcaactctacattcttctggagcatggacaagcgaatttcagtcagtatgcggccatcatggtctcttgctgtgctatttcttggtcaactgttgattatcaagtagctttaagaaaatccttgcctgacaaaaagcttcttaatggattatgtcccaaaatcacatatctcttttacaagttgtttacattattatcgtggatgctgagtgttgtacttctactattcttaaatgttaagattgctttatttctgttgttatttctttggttgttaggtataatatgggcatttaaaaacaacacccagttttgtacttgtataagtatggaattcttatataggattgttgttggattcattcttatctttacattttttaatattaagggacagaataccaagtgtccaatgtcttgttattatattgttagggtactgggcactttggggatattgactgtattctgggtttgccccctcactatttttaatccagactattttatacctatcagtataactatagttcttactcttcttcttggaattctttttcttattgtttattatgggagttttcacccaaacagaagtgcagaaacaaaatgtgatgaaattgatggaaaaccagttctaagagaatgtagaatgagatatttcctaatggaataagctattcatttatgatatatattttcttatattttgtttcattggttagtaaagaaaatgtgtgttatgtgggtgtgttgtctcttatttttgccacctttaatttgaaattagttcagtgaaataggagatacatagtagtattttatttttaaaattaatttctcatttggttttgaagatcttgagtactcagatatctttctactgcctggtagagctgccatcttgagcctgaaatataagaaatggtctggttttcataatgagaaggctggaattgagcttccctcccattttccttgttcctgaactaatactactgtacctgttatggaggactgcaaagggaagagaaaagcagaacactgtattattttttcctttattgtcttcagtgcatatatttgcagttggggacaggttgagtagaggaaaagggaaagaagggaaagcagaaaacaaatttttagcatctgctgtgctttcatccatgaaatctccaattcagtaagtgcaaaagagaattggtgtgcatctgagaggtctgacatttcattatttacttatttcctagcttttctgaattaatgcactcttaacatataattatattaatcctatttgtgctagaatagttgtatctaaatcatattttaaaattatttttatttttaaaaaattatggtaaaaacatataaaatttaccatcttaatcactttgagtgtacagttcatcagtgttaactgtattcaccttgtgcaacagatctcaaggactttttcaccttgtaaaactaagattctctatttattgaacaaatccccatttcctccttccccaagtctctctcaactgaaattataattttttgtttctatgagtttgaatactttagataccttgttgccatggtttgaatgtgccccccagatttcatgtgtgtgaaacttaatctccaaatttgtatgttgatggcatttggaagtggtggggactttgtttatttatttatttttaattttttaattttatattattattattattattatactttaaggtttagggtacatgtgcacaatgtgcaggttagttacatatgtatacatgtgccatgctggtgtgctgcacccattaactcgtcatttatcattaggtatatctcctaaagctatccctcccccctccccccaccccacaacagtccccagagtgtgatgatccccttcctgtgtccatgtgttctcattgttcagttcccacctatgagtgagaatatgcagtgtttggttttttgttcttgcgatagtttactgagaatgatgatttccagcttcatccatgtccctacaaaggacatgaactcatcattttttatggctgcatagtattccatggtgtatatgtgccacattttcttaatccagtctattgttgttggacatttgggttggttccaagtctttgctattgtgaatagtgctgcaataaacatacgtgtgcatgtgtcttta

SEQ ID NO: 8019 - DNA, 1799 bp, Homo sapiens
gtgaggtggcgtgaggcgaagctggaatctgcctctgtcacgggggctggtgcctcacgggtttgtgtcctagacaggcgagtggatccaagtgggcgagagacattttaatctggaagagtcttgtgatttgggagacagtgaagaagaagtaaaatattcacaagatgaagatttttccagaagggactttgagtcaaagatggctttttatatttgacaagattcaaaatctagtgcattagacttttgaactagctgttccttcaagctggaaggcttttccatctctatgcacatggccaatttcactactcaaatgccaccttctcagtcttgtcatctgtaatgaagatcattgtgaaacagaagattgattaaagccttgtaacattggacctagattagagatttagaaaagaaagtcaaaattagtcactttagtgttagtgttcccatttcataatatttattctttcttctaaatagatttagggagtagaaattaaaattcaatgctataccaaagggtatactaatatttgtttggctttttttccctttttgtgagggagaaaaaagtagataacgaaaagctatagtcattcgtaatgaaatatactaaacagaattttatgatgtcagttcttggcattataatctacgtaactgatttaattgtggacatatgggtatctgtcagatttttccatgaaggacagtatgtttttagtgctttagcgttaagctttatgctttttggaacacttgtggctcagtgttttagttattcttggttcaaggctgatttaaagaaagcaggccaagaaagtcagcattgttttcttctacttcattgcttgcaaggaggagtttttacaaggtattggtttgccttaaaaaggggttaccatgcagcttttaaatatgacagcaatactagtaacttcgtggaagaacaaattgatctacataaagaagttatagatagagtgactgatttgagcatgctcagactatttgagacctacctggaaggctgcccacaacttattcttcaactctacattcttctggagcatggacaagcgaatttcagtcagtatgcggccatcatggtctcttgctgtgctatttcttggtcaactgttgattatcaagtagctttaagaaaatccttgcctgacaaaaagcttcttaatggattatgtcccaaaatcacatatctcttttacaagttgtttacattattatcgtggatgctgagtgttgtacttctactattcttaaatgttaagattgctttatttctgttgttatttctttggttgttaggtataatatgggcatttaaaaacaacacccagttttgtacttgtataagtatggaattcttatataggattgttgttggattcattcttatctttacattttttaatattaagggacagaataccaagtgtccaatgtcttgttattatattgttagggtactgggcactttggggatattgactgtattctgggtttgccccctcactatttttaatccagactattttatacctatcagtataactatagttcttactcttcttcttggaattctttttcttattgtttattatgggagttttcacccaaacagaagtgcagaaacaaaatgtgatgaaattgatggaaaaccagttctaagagaatgtagaatgagatatttcctaatggaataagctattcatttatgatatatattttcttatattttgtttcattggttagtaaagaaaatgtgtgtt

SEQ ID NO: 8020 - DNA, 2727 bp, Homo sapiens
cccctttcatggccgccgcctggcgccggggctaagtggccgccggcgtccgggtacccgagggctctcccgcgttgctggcaccgctggcgccgcggtctcgtagcgcatgggcctcctccgaggcgggctcccatgcgctcgggccatggcgcgcctgggcgctgtgcgctcccactactgcgccctgctgctggccgcggcgctggccgtctgcgccttctactacctcggctcaggccgggagaccttctccagcgccaccaagaggctgaaggaggcccgcgccggggctcccgccgcgccctcgccgcccgcgctggagctagcgcggggctccgtggcgccagcccccggcgcgaaggccaagagcttggagggcggcggtgccgggccggtggactaccacctgctgatgatgttcaccaaggcggagcacaatgccgcgctgcaggccaaggcccgcgtcgcgctgcgctcactgctgcgcctcgccaagttcgaggcgcacgaggtgcttaaccttcacttcgtgagcgaggaggccagccgcgaggtggccaagggcctgctgcgggagctcctgccgcccgccgctggcttcaagtgcaaggtcatcttccacgatgttgctgtgctgacggataagctcttccccatcgtggaggccatgcagaagcacttcagtgctggcttgggaacctactacagtgactccatcttcttcctctcggtcgccatgcatcagatcatgcccaaagagatcctgcagatcattcagctggacctagacctgaagtttaagaccaacatccgggagttgtttgaggaatttgacagtttcctgccaggcgccatcatcggcatagcccgggagatgcagccagtttacaggcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccgtgccttgcccccggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctcaaaaaaaaaaaaaaaaccaaaaaggaacccagcaattcccaagtgtgaccatgtgggcttggaagacatgtcactcatgggctagtaagcattctagtttctttgtttaaaaaatccccttatcataccacgttagaccgtagaccttagcagaaattaaagcgtcatttcttttgatggggcctcctgtacgtaggctgcagacgtgaaagccccaggggtccatttgtatcaattttcatcttgttttgttttgatttcatttacgtttttctttttcccatgagtgaggatagccaataaatcatctttgagaacatgg

SEQ ID NO: 8021 - DNA, 1687 bp, Homo sapiens
atgtggccacctcgctgcaaggatccaggaaggcagagtgcggagatcctgcagatcattcagctggacctagacctgaagtttaagaccaacatccgggagttgtttgaggaatttgacagtttcctgccaggcgccatcatcggcatagcccgggagatgcagccagtttacaggcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccgtgccttgcccccggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctc

SEQ ID NO: 8022 - DNA, 564 bp, Homo sapiens
atgaatgggatgagtgtcctgatgaaagagaccctgaagagctctgtcaccccttcaccatatgaggagactggggaaaggcagccatctgtgaactgggcagtgagtcctcaccagacacagaatcagtgggcacgttggtcttggacttcccagcctctagaactgcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactag

SEQ ID NO: 8023 - DNA, 2149 bp, Homo sapiens
aattgaagtagtcacttctttcagaatgctaagttccctggaatattttcccagcctactgtgtctatgatagactcaaatattggaagttttaccggctgtgtgtggggtggggaaggaattctgttggttctccggtgagtcctgaagagaccttgtttctggagccaggaagaggagcatagaaagaaaaaggaacaggaaattgttcaaaagaagttcatgaaatgagaaaagcagcaggaaacagctcgggaatcggcgaggctgcagccgaaggaagacatcttccttttaagcagtgactcgggaatcgaggccacttccatcctgtaacgacgccatctggagcatgtggcttccaggggagcagtggctgaggccctgcagtggcttctcactgctacagtccagagttgcacacagcacttctgctcatagtccatcagccaggagctagtcatgtggccacctcgctgcaaggatccaggaaggcagagtgcggagatcctgcagatcattcagctggacctagacctgaagtttaagaccaacatccgggagttgtttgaggaatttgacagtttcctgccaggcgccatcatcggcatagcccgggagatgcagccagtttacaggcacacattctggcagttccgccatgagaacccccagacccgggttgggggcccgccccccgaggggctgccgggcttcaacagcggggtgatgttgctgaacctggaggccatgcgccagtccccgctctacagccgcctgctggagccggcgcaggtgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactaggcgctccccgtgccttgcccccggggcctccagatctgggggaaggacagggttccttgggacagacccaagggcagtgtctgacccgctagagagacaccgcagggaagtcctgtgattaaggtgctgagacctcctgccgggcaggtcactgtgctgaggccacccgccaaggactggcctgtgcactgctggtgcttgggaccttattcctccagggagcaggcgacacaaaggacacgcatgtccagtgggctgggaagcaagcacttgaagagaaggaaggggagaaagggtcccccttgctgtctgcctctgaggaatggaaatcctttagacccggccttttttggaccaatataaatttaatttaaattgacagccttccatttttcgagaaagtacaaacagaactgctttagcacccatcgagccccaaacgggtaaggtaagccaaggttttaatgaccagcccagtatctaagcttccaaacgaatgccagcccatcacatactcaccctgggaggctgctgcacgcgcattctcctgatgctcacgtcacttggtgtaggtttcaggatcgcctctttgaggaaggacttcaggaccaactggggcctgcataagaaaacttatctcattattagagtactcacagcttgtatctcccagctacatcctagaaccccattgtcctttattccaccaaaccagctccaggtgaccagactctactcagaaagcaaattcgtcatcaaagaacagagactggccaccacaaggacatgcaggagaactgtcgggaccaggaagactcattccaaaaagcccaggccgggcacagtcgtcaagcctgtaatcccaacactttgggagaccgaggtgggggtatcgattgagcctcggaggtcgagatcagcctgggaaacacagggaggcccccatcgctacaaaatattttaaaaattagccaggtgtggtggcttgtgcttgttgtcccggctacttgggaggctgaagtgggagggtggcttgagtccaggagttcactgcactgagctgtgatcacaccactgcactccagcctggacgacagagtgagacgtccatctc

SEQ ID NO: 8024 - DNA, 570 bp, Homo sapiens
atggtgagatgtgtcccttccgccgtgattgtgtgtttcctgaggcctccccagccaggcagaactgtcatcttccacgatgttgctgtgctgacggataagctcttccccatcgtggaggccatgcagaagcacttcagtgctggcttgggaacctactacagtgactccatcttcttcctctcggtcgccatgcatcagatcatgcccaaagagatcctgcagatcattcagctggacctagacctgaagtttaagaccaacatccgggagttgtttgaggaatttgacagtttcctgccaggcgccatcatcggcatagcccgggagatgcagcagctggccgacaagtaccacttccgcggccacctcggggaccaggacttcttcaccatgatcggcatggagcaccccaagctcttccatgtgctggactgtacctggaaccggcagctgtgcacctggtggagggaccatggctacagtgacgtcttcgaggcctatttcaggtgtgagggccacgtcaagatctaccacgggaactgcaacactcccatcccggaggactag

SEQ ID NO: 8025 - DNA, 1019 bp, Homo sapiens
gctctcgcgtcctttgctgggtccagacaccggtacgtccgggcgggtttttagtctcccaagcgagagcgtcgcattcacccgcgtgggtctgcgggcgccccagaccccagaggacccggcccccaacgcttacctgtcccctctcctgtccctcccccattccagccccttctctccccagccgttgcccctccccgcaccccgccgcgtccgcgcgcctctctccgcgcgcacccccaacccgcccccttttctctgggaaccgctccttccgctccgcccgcctggagtccttctggccggattccgcggcatccttccatagaccctcgttgttgcttcctccttgtggttccgttgcaaacatttttaaagggctggttattcttcctgaaatgagtttggtgattagaaatctgcagcgagtcatccccatcaggagagcgccacttcgcagtaagatcgagattgtaaggaggattttaggagtgcagaaatttgacctggggatcatctgtgttgacaacaagaatattcagcacattaatagaatctacagagatagaaatgtcccaaccgatgtgctttcttttccatttcatgagcatctgaaagcaggtgaatttccccagcctgattttccagatgactacaatttgggagacattttcctaggagtggagtatatcttccatcagtgtaaagaaaatgaagattacaatgacgtcctgactgtgacggccacccacggactctgtcacttgctgggattcacacacggcacggaggcagagtggcagcagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacgaataaataacgaatgaacgtacgaggggaacctcctcttatttccttca

SEQ ID NO: 8026 - DNA, 890 bp, Homo sapiens
gctctcgcgtcctttgctgggtccagacaccggtacgtccgggcgggtttttagtctcccaagcgagagcgtcgcattcacccgcgtgggtctgcgggcgccccagaccccagaggacccggcccccaacgcttacctgtcccctctcctgtccctcccccattccagccccttctctccccagccgttgcccctccccgcaccccgccgcgtccgcgcgcctctctccgcgcgcacccccaacccgcccccttttctctgggaaccgctccttccgctccgcccgcctggagtccttctggccggattccgcggcatccttccatagaccctcgttgttgcttcctccttgtggttccgttgcaaacatttttaaagggctggttattcttcctgaaatgagtttggtgattagaaatctgcagcgagtcatccccatcaggagagcgccacttcgcagtaagatcgagattgtaaggaggattttaggagtgcagaaatttgacctggggatcatctgtgttgacaacaagaatattcagcacattaatagaatctacagagatagaaatgtcccaaccgatgtgctttcttttccatttcatgaggtgacggccacccacggactctgtcacttgctgggattcacacacggcacggaggcagagtggcagcagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacgaataaataacgaatgaacgtacgaggggaacctcctcttatttccttca

SEQ ID NO: 8027 - DNA, 764 bp, Homo sapiens
ggaaccgctccttccgctccgcccgcctggagtccttctggccggattccgcggcatccttccatagaccctcgttgttgcttcctccttgtggtaaatgttccgttgcaaacatttttaaagggctggttattcttcctgaaatgagtttggtgattagaaatctgcagcgagtcatccccatcaggagagcgccacttcgcagtaagatcgagattgtaaggaggattttaggagtgcagaaatttgacctggggatcatctgtgttgacaacaagaatattcagcacattaatagaatctacagagatagaaatgtcccaaccgatgtgctttcttttccatttcatgagcatctgaaagcaggtgaatttccccagcctgattttccagatgactacaatttgggagacattttcctaggagtggagtatatcttccatcagtgtaaagaaaatgaagattacaatgacgtcctgactgtgacggccacccacggactctgtcacttgctgggattcacacacggcacggaggcagagtggcagcagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacgaataaataacgaatgaacgtacgaggggaacctcctcttatttccttca

SEQ ID NO: 8028 - DNA, 433 bp, Homo sapiens
gctctcgcgtcctttgctgggtccagacaccggttccgttgcaaacatttttaaagggctggttattcttcctgaaatgagtttggtgattagaaatctgcagcgagtcatccccatcaggagagcgccacttcgcagtaagatcgagattgtgacggccacccacggactctgtcacttgctgggattcacacacggcacggaggcagagtggcagcagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacgaataaataacgaatgaacgtacgaggggaacctcctcttatttccttca

SEQ ID NO: 8029 - DNA, 534 bp, Homo sapiens
gctctcgcgtcctttgctgggtccagacaccggttccgttgcaaacatttttaaagggctggttattcttcctgaaatgagtttggtgattagaaatctgcagcgagtcatccccatcaggagagcgccacttcgcagtaagatcgagattcatctgaaagcaggtgaatttccccagcctgattttccagatgactacaatttgggagacattttcctaggagtggagtatatcttccatcagtgtaaagaaaatgaagattacaatgacgtcctgactgtgacggccacccacggactctgtcacttgctgggattcacacacggcacggaggcagagtggcagcagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacgaataaataacgaatgaacgta

SEQ ID NO: 8030 - DNA, 744 bp, Homo sapiens
cccacaacccgctctgtggcggggcttccggtcgggagggtccgcccgctctcgcgtcctttgctgggtccagacaccggttccgttgcaaacatttttaaagggctggttattcttcctgaaatgagtttggtgattagaaatctgcagcgagtcatccccatcaggagagcgccacttcgcagtaagatcgagattgtaaggaggattttaggagtgcagaaatttgacctggggatcatctgtgttgacaacaagaatattcagcacattaatagaatctacagagatagaaatgtcccaaccgatgtgctttcttttccatttcatgagcatctgaaagcaggtgaatttccccagcctgattttccagatgactacaatttgggagacattttcctaggagtggagtatatcttccatcagtgtaaagaaaatgaagattacaatgacgtcctgactgtgacggccacccacggactctgtcacttgctgggattcacacacggcacggaggcagagtggcagcagatgttccagaaggagaaggcggtgctggacgagctgggccgacgcacggggacccggctgcagcccctgacccggggcctcttcggagggagctgagggccgcgttccttctgaaagcgggacgcgggaggggtggaggctgcggggagccggggtcgcacacgaataaataacgaatgaacgtacgaggggaacctcctcttatttccttca

SEQ ID NO: 8031 - DNA, 1803 bp, Homo sapiens
ccgaaaccggcgcggagcaactgaggcccgagccttctcgggacccgggggacgcctaaccccgcgagatgaggaaactgaggccgcgaggagcgcgcatacagcagagaagcagcagaatcgggaatcaaacccagctctgtctgaccccagagcctgtgcctttaaccactggctaggctgaactgcctttgttcttcactgtccccatcacctctttcaaacctcagcctctccttcctcatcgttacatctctaggctgcacctgctctctaaacattcacacaaaccctgcaaattttcttcctcataattgggagaagactcactggccgaatggcagcagtagatgacttgcaatttgaagaatttggcaatgcagccacttctctgacagcaaacccagatgccaccacagtaaacattgaggatcctggtgaaaccccaaaacatcagccaggatccccaagaggctcaggaagagaagaagatgatgagttactgggaaatgatgactctgacaaaactgagttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcaatactgtggattatcccccagaaagctgttcgttggattctagtcatgattgccctgggcatctcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaattctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagcacatgtgtctttcagctcttccttttcacccatggatgatcattgcgagcatgcgctgattggactgaaatgccagggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaaccgggagcttgaaaatttgtctttggtaacctgatactggacagctgaactgaatggctgcaaaataaatacctcacatg

SEQ ID NO: 8032 - DNA, 1503 bp, Homo sapiens
cgaaaccggcgcggagcaactgaggcccgagccttctcgggacccgggggacgcctaaccccgcgagaatttggcaatgcagccacttctctgacagcaaacccagatgccaccacagtaaacattgaggatcctggtgaaaccccaaaacatcagccaggatccccaagaggctcaggaagagaagaagatgatgagttactgggaaatgatgactctgacaaaactgagttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcaatactgtggattatcccccagaaagctgttcgttggattctagtcatgattgccctgggcatctcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaattctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagcacatgtgtctttcagctcttccttttcacccatggatgatcattgcgagcatgcgctgattggactgaaatgccagggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaaccgggagcttgaaaatttgtctttggtaacctgatactggacagctgaactgaatggctgcaaaataaatacctcacatga

SEQ ID NO: 8033 - DNA, 1042 bp, Homo sapiens
ggaggcggagaggttccgccccccggatctccggcttccggcaactgggctggaccgaaaccggcgcggagcaactgaggcccgagccttctcgggacccgggggacgcctaaccccgcgagatgaggaaactgaggccgcgaggagcgcgcatacagcagagaagcagcagaatcgggaatcaaacccagctctgtctgaccccagagcctgtgcctttaaccactggctaggctgaactgcctttgttcttcactgtccccatcacctctttcaaacctcagcctctccttcctcatcgttacatctctaggctgcacctgctctctaaacattcacacaaaccctgcaaattttcttcctcataattgggagaagactcactggccgaatggcagcagtagatgacttgcaatttgaagaatttggcaatgcagccacttctctgacagcaaacccagatgccaccacagtaaacattgaggatcctggtgaaaccccaaaacatcagccaggatccccaagaggctcaggaagagaagaagatgatgagttactgggaaatgatgactctgacaaaactgagttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcagta

SEQ ID NO: 8034 - DNA, 1683 bp, Homo sapiens
ccggatctccggcttccggcaactgggctggaccgaaaccggcgcggagcaactgaggcccgagccttctcgggacccgggggacgcctaaccccgcgagagaaccctgcaaattttcttcctcataattgggagaagactcactggccgaatggcagcagtagatgacttgcaatttgaagaatttggcaatgcagccacttctctgacagcaaacccagatgccaccacagtaaacattgaggatcctggtgaaaccccaaaacatcagccaggatccccaagaggctcaggaagagaagaagatgatgagttactgggaaatgatgactctgacaaaactgagttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcaatactgtggattatcccccagaaagctgttcgttggattctagtcatgattgccctgggcatctcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaagactcacttgagataccctctccttgctgaagtttttcttgacttctccagttctcttttgttttttggagcatggttctttgggaagtggcatccactgcaggaaagcagaatgagcagagccagcagaactgatggagtggcacaaattcccagtgtctggatggtgccacactggcgcctaatcacccgtttaacaagcagaaattaaatgttgctcagcacatgtgtctttcagctcttccttttcacccatggatgatcattgcgagcatgcgctgattggactgaaatgccagggaataggttaggcatgctcagtgccgtccctttgccaccacagtcaaatgacatgcttcactgtggtaccttaatacctgaaatagaaccatggaaaattctgatgtcctctctctgaattatgtacagactacctgggggatcctcttctctccaaatgttagccatcctgaagtagccgaacagtagaaactttggtggggattaaccgggagcttgaaaatttgtctttggtaacctgatactggacagctgaactgaatggctgcaaaataaatacctcacatgatgtctgtgtctgca

SEQ ID NO: 8035 - DNA, 1196 bp, Homo sapiens
acacttctgggatgcacctgtctgggtgctgattggctccagcaaggtcccatggccccatcgcatgaagaaacaagcctcgaagcagaaagtgagaagcctgaggcatagactggaggcaagctcactcaggttatatctgctgacgctggaataagatgagtggcggtgaaataagcagcagaaccctgcaaattttcttcctcataattgggagaagactcactggccgaatggcagcagtagatgacttgcaatttgaagaatttggcaatgcagccacttctctgacagcaaacccagatgccaccacagtaaacattgaggatcctggtgaaaccccaaaacatcagccaggatccccaagaggctcaggaagagaagaagatgatgagttactgggaaatgatgactctgacaaaactgagttacttgctggacagaagaaaagctcccccttctggacatttgaatactaccaaacattctttgatgtggacacctaccaggtctttgacagaattaaaggatctcttttgccaatacccgggaaaaactttgtgaggttatatatccgcagcaatccagatctctatggccccttttggatatgtgccacgttggtctttgccatagcaattagtgggaatctttccaacttcttgatccatctgggagagaagacgtaccattatgtgcccgaattccgaaaagtgtccatagcagctaccatcatctatgcctatgcctggctggttcctcttgcactctggggtttcctcatgtggagaaacagcaaagttatgaacatcgtctcctattcatttctggagattgtgtgtgtctatggatattccctcttcatttatatccccaccgcaatactgtggattatcccccagaaagctgttcgttggattctagtcatgattgccctgggcatctcaggatctctcttggcaatgacattttggccagctgttcgtgaggataaccgacgcgttgcattggccacaattgtgacaattgtgttgctccatatgctgctttctgtgggctgcttggcatacttttttgatgcaccagagatggaccatctcccaacaactacagctactccaaaccaaacagttgctgcagccaagtccagctaatgaggaaagactcacttgagataccctctccttgctgaagtt

SEQ ID NO: 8036 - DNA, 1502 bp, Homo sapiens
ggatgttgctgtcaggtctgagtcggttggagtctgacgggtaggcgagacgcgcaggcgcagagagccccagccacgccggcccaggtggcctcagcgagggatgcggagacgcccctgaacgaccatggcatcggccgacgagctgaccttccatgaattcgaggaggccactaatcttctggctgacaccccagatgcagccaccaccagcagaagcgatcagctgaccccacaagggcacgtggctgtggccgtgggctcaggtggcagctatggagccgaggatgaggtggaggaggagagtgacaaggccgcgctcctgcaggagcagcagcagcagcagcagccgggattctggaccttcagctactatcagagcttctttgacgtggacacctcacaggtcctggaccggatcaaaggctcactgctgccccggcctggccacaactttgtgcggcaccatctgcggaatcggccggatctgtatggccccttctggatctgtgccacgttggcctttgtcctggccgtcactggcaacctgacgctggtgctggcccagaggagggacccctccatccactacagcccccagttccacaaggtgaccgtggcaggcatcagcatctactgctatgcgtggctggtgcccctggccctgtggggcttcctgcggtggcgcaagggtgtccaggagcgcatggggccctacaccttcctggagactgtgtgcatctacggctactccctctttgtcttcatccccatggtggtcctgtggctcatccctgtgccttggctgcagtggctctttggggcgctggccctgggcctgtcagccgccgggctggtattcaccctctggcccgtggtccgtgaggacaccaggctggtggccacagtgctgctgtccgtggtcgtgctgctccacgccctcctggccatgggctgtaagttgtacttcttccagtcgctgcctccggagaacgtggctcctccaccccaaatcacatctctgccctcaaacatcgcgctgtcccctaccttgccgcagtccctggccccctcctaggaaggcccgggtcccacaggcaacacctaagtggaccaacccctctgcctgtcctgccccccagacgatgactgaaggctcctttgacaccttgagatgattctgctactttccagacttttcttacaaagcaaacacttttattttctatgcaaaggtgattcagagaatttatataaaggcgggcgaggggcagccgagcagggagctttgggacagggctggggcccccatatcccccccgggccacctgctttccctcctatggctcccctggaacaggagggagagccaagggggcggcccagcctggacagcgcccgctcctgcctgggtgcacacacggcgggcctgagctccagcatctgagtttgggggtatgagaaacaggggagcagaaggagaagaaaactgcctgtgctgc

SEQ ID NO: 8037 - DNA, 7288 bp, Homo sapiens
gttatggtcctgtcagggtgccggcgtcgtggtgcttgggtggtcgccaccaagaagactttggtggggtagtctcggggcagctcagcggcccgctgtgcccgtttctggcctcgctcgcagcttgcacgtcgagactcgtaggccgcaccgtagggcgagcgtgcgggtcgccgccgcggccgcctcggggtctgggcccagccgcagcctcttctaccgcggccggttgggagtcgccgcgagatgcagcctccgggcccgcccccggcctatgcccccactaacggggacttcacctttgtctcctcagcagacgcggaagatctcagtggttcaatagcatccccagatgtcaaattaaatcttggtggagattttatcaaagaatctacagctactacatttctgagacaaagaggttatggctggcttctggaagttgaagatgatgatcctgaagataacaagccactcttggaagaattggacattgatctaaaggatatttactacaaaatccgatgtgttttgatgccaatgccatcacttggttttaatagacaagtggtgagagacaatcctgacttttggggtcctctggctgttgttcttttcttttccatgatatcattatatggacagtttagggtggtctcatggattataaccatttggatatttggttcactaacaattttcttactggccagagttcttggtggagaagttgcatatggccaagtccttggagttataggatattcattacttcctctcattgtaatagcccctgtacttttggtggttggatcatttgaagtggtgtctacacttataaaactgtttggtgtgttttgggctgcctacagtgctgcttcattgttagtgggtgaagaattcaagaccaaaaagcctcttctgatttatccaatctttttattatacatttattttttgtcgttatatactggtgtgtgatccaagttatacatgaatagaaaaagatggtgttaaatttgtgtgtaggctgggaattcttgctgaaggaattggagaaaacctgttgctgcaaaattttacatgttccagatggaaagggaagtctaagcgctttttaaaacaatttttttttgtatttaattaagcaattgcagttatctgggatttttgggtcagaattttaaattctgtttgattctccatattccagtgaataaaatacaaaagcattgtgtttttaagattgtgtcgatattcacctaaaaacttgtgccaaaagcacctggattggtaattatatttcacttaaagggtaaatttgacaatatcttgataatcaaaagtgcaatttttttcttcaaaatgttttctccagcatcacagatcctgcagatatatatttatatttatacatatatatttatgaaataattcttactcacaaaatatatttctgataaacattaagatattaaatctgatgcacaaactttttaatttggccattaatcttttttatttaaaaatttaaatttgtttttaaaattgtatatagtttttaaaatctcacacatgcttcgatacttccttgttaagaattcttaataactactaaaactgatttttaatagttgctgatatatatttggtttgtttgggtatacttttcaaaaccatttttgaatgtccaaacatctgatttaaagtttctgtttatctttctgaccaaaggagcaagaggtataatggatatggcattcattaaaatctttactatgtacaaaaacagtaatatttacagcatcagtaaatatttttaagtggtacttctaaatcataaaagttggggaaagagacctttaaaatcttgtggtgttgaacaatgttatatgaagtagaaaaaataaaatacttcccagttgtgtgttttgttttacagcaccatgtcctgtattacttgatattttaacaagtatcaggtactctctaacaaatgtacagtttttgctaagggaaatattaagaaatttttatcagtgaaatatttgttgcaaataatttcataggtttttagatacacctgtagttaatattactttgtaaagtaggtaaatcattttatttatgtccataaaatatcaaatgtctgttaactattagcaaattattgtattatcctttctggtctcacctggaagagtttcctgctgtcctcagtatgataacatggcgacctcttggtatgtatttctttagcaaacttacccatcaggaaatatccagcacctctgaagcaaacctacaaatgagtgtgttatcaagcccagccgtcttcctttcccctaatcccaaaaggaaagaaagaaaaacttattttaagctgcagaaaaagtgtggagcacttttgagctagaataatgtagaaaattacatgtactgatttttttaaaaacaggtgagaagcaccagagggacaggacttctagaagttagaataatatgaagtaatcaggaaatatctatgcctacagaagcagcaaccgtaagataaacatttgttacacttaagaaattgctgaggttaatactttgttataatggattataatatttgacattcatagtgttgaccctggaatctttcacagaaagcttgggggtcaggaccaggaggtagaattttacaaggcaataaatgaaggtattttaagatcacctctattaaaaaatggtttaatttttaaaaactatcattgctttaaggtatgaattttaaaaatcacttatatggatcatgtttactcctaatgatataagataaaatgaggtatttttgttccaaaaagtattttaaaatagcatttaatcttgggaactatcttacttagggtttctataaatacaaattacaatgtttcgaactcaaccagtatcattttcgtgtgctaatgagcaaagtagttagaacagattgtcagtttaaaaacaggatttgtaggccaggcacagtggctcacgcctgtaatcccagcactttgggaggccaaagtggatgagcagcttgagtcaggagtttgagaccagcctggccaacatggcgaaaccccgtctctactaaaaatacaaaaattagccgggcgtggtggcaggcgcctgtataatcccagctactcaggaggctgaggcagggagaatcgcttgaacccttggaggtggaggttgcagtgagccaagattgtgccattgcactccagcctgggtaacagagcaagactctctcaaaaaaaaaaaaaaaaaaaaaaaaaaccatgatttgtagatgtgtgcaagacacagtactgctatggctaataatggtaagatgaccctaataatgtcctctccttgaatttttatataataatattttctgagtcataactaattttttaaataatgatttccaatctaattattaattagaattttgttgttgttgtttgagacagagtcactctgtcacccaagctggagtgcaatggcacgatctcggctcactgcaagctctgcctcccgggtttgcaccattcttctgcctcagcctcacgagtagctgggactacaggcgcccaccaccatgcctggctaattttttgtatttttagtagagatggggtttcaccgtgttaaccaggatggtctcgatctcctgacctcgtgatccgcccgcctcagcctcccaaagtgccgggattacaggtgtcagccaccgcaccaggccagttcattagaatttttaaaacaggctgggcatggtggcttacgcctgtaatcccagcagtttgggaggccgaggcaggtggatcacctgaggttgggagtttgagaccagcctgaccaatgtggagaaaccccatctctactaagaatacaaaattagccaggcatggtggtgcatacctgtaatctcagctactggggaagctgagacaggagaattgcttgaacccaggaggcagaggttgcggtgagctgagatcgcgccattgcactccagcctgggcaacaggagtgaaactccatctcaagaaaaacacaaaatacaaaacaaaacaaaacaaaaaaacagaactgggccgggcgcggtggctcacgcctgtaatcccagcactttgggaggccgaggcgggtggatcacgagatcaggagatcaagaccatggtgaaaccccgtctctactaaaaatacaataaattagccgggcatggtggcgggcgcctgtagtcccagctacttgggaggctgaggcaggagaatcgcttgaacccgggaggcagaggttgcagtgagccaagatcgtgccactgcactccagcctaggtgacagagtgagactccgtctcaaaaaaaaaaaaaaaaaaaatcaaaatctatataattaagcattgttttttaaaaagtagtttaggaagatttgtaaagcttatgaaccattgtaaaaccttatttctaaggtctgtaagacagttttatatgtaataatgtgtccatttccaggaattccccaaatactcatacagccattgagcaccccaatccaaaattcagaatgcttcagataagaacatttttgagtgccgatgtgacactttaaaggaaatgttcattggagcattttgcatttcagatttttggattaggaaaactcaaccactgtatttctgcacatattccaaaatctgaaaaagtctgaaacctgagaaactctggtcccaagcattttggaaagggtatactcaatctgtattaacatagacttctaaattagtgaaaatttgcattgaattaaaatgtgaagtaaatatttttgtttaaatattgtttaaaatttagtcatttaaaaattttgtgatgtaacaaaatgttgaatgaaataatgcttctacaacttaaaattatttttcatagtgaacaaaactagttgaatacttctaaatattcatttttgttagtgcacattttatccagttttaggctttagggaattgtgaccctttttttttttttttttttttttttggagacggagtcttgctctctcgcccaggctggagtgtgtggcgcaatctcagctcactgcaacctctgattcctgggttcaagcaattctcatgtctcagcctccctaatagctaggattaccggtgcccgccaccacgcccagctaattttttaaatttttaatggagacagggtttcaccatgttggccaggctggtcttaaactcctgacctcaggtgatccacccaccttggcctcccaaagtgctgggattacaggcttaagccaccgtgcccggcacttttgtttttaaaataatatcttactttcatatgattctttcagactgtggtatggcattctgaagcaagtcttaacagagctaaaaatcacccttacccaattctctgcactgacatatgtacacaaagtaatattttattattctccttcataaatggtttctttaattgaacctttgagccttatactatttttaaatttccctttaaaaattgaattacagccaggcatggtggctcatgcctgtaatcccagaactttgggaggccatggcaggaggattgcttgaacccaggagttgtagaccagcctgggcaagatagcgagatcctgcctctgaaaaaatcataataatactttaatttagaaaataccctgaattagaagtgcttcattcctcatttgtgtacagctgttcctctatatacgaaggggattggtaccagaaccactgcataccaaattccacccatactcaagtctcacagtcttccctgcagaatccaagtatacaaaaagtaggcctatcatttatatgggttttgcatcctgacagtactgtattttcaatcctagtttgtttgggaaaaaaaaattgtttgtatgcctgggtacagtatcatacctgtaatcccagcactttggaaggctgaggcgggaggactgttttgtggccaggagttcaaaatcagcctggtcgacgtagtgagaccccatctctacaaaagaaaaattagctgggcatgtggcacctgcctgtggtcccagctactcaggaggctgtgaggcaggagaattgcttgagcctgggaggttgaggctgcagtgagccgcgatcacaccactgcatgccagcctgggcgacagagtgagaccctgtctcagaaaagaaaaaaaaagtaaaaattgcatgtaagttgacccgcactattcaaatttgtggtgttcaaggttcaactgtaatttcctagcagcattttgtgtgtttgagaatctcttgacactcttcaagtaaatccctaaattacaactttgacatcaaaaaagctagacattcctacatttttgcactacaatacataaaaactcccatgctgatcggttgtgggatcgtgcctgtgaataaccactgcactccagcctgggcaacatagtaagtaagaccttgtctcttaaaaaaaatacattctgaagaaagttctacttatgaatacattttatttataacaaactggtgaaaattttagaccaaaccatgtctttctgggttgtagtgattaaaaaatggttaagagaatgttccctatacaaggcatatgttattaaacatgaaatttaggattagttttctctttgaaaattcttttgatatgctgaggttacagtttggaggttacattagagaaagaatatagggaagatggcagtggtaaaacatttccctgctttacatttttatattggcagtatcttggtttcaacttttctattttcagcaagatatttgcaagtttttactttgaagatgtttggtttatagtagtccatgctatactaatgctgttgctgagataattaagttagatactaatatgaaaaagaatatttgtgtaaaatattttgaagttgtaattagtgtatatacaagttgttaatacttacgaaaaaaggaagcattcccacctgtaataattttgttaacactagactatcagtaaattatcaagaataaaaaccttggtttttctgtaatatttgccactgagcaatttttattaaaaaccaaacagaagtatttacacaagaacaagtgaaattacacaaaatgataatggggagaaatttctcatctggtgataaagggaaaaagataatgtaaaagcagattgctgctatttgcataataagcacttgttgaagaataaatgattaagttcaata

SEQ ID NO: 8038 - DNA, 1435 bp, Homo sapiens
agaaggagggccaagatggcggaagcggaggagtctccaggagacccggggacagcatcgcccaggcccctgatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaaccagtgaattgaaagcacatctgaaagatgcaattcaccatggagctttgtctctggcccttatttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagatt

SEQ ID NO: 8039 - DNA, 1070 bp, Homo sapiens
ggcgcagagtcagaggggcaggggcggcggcggagggagcaggaggttggggcttgagcccgtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctgatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctca

SEQ ID NO: 8040 - DNA, 6741 bp, Homo sapiens
ttatcttttaagttattgtcacaatagttactctcttttagaccctgaacattttcagtacttgctccaaatggtttagcaacttttgaagtgggattaacaagtttggccaatgaagcttcttccctgcccaccgccagaggtgctggagaaaagtaatcctggagggtcggcgtggaggcagtagagaggtttataaaagtcaaggaagtgggaagaggcttgcgagcagcaggagaggcgcagagtcagaggggcaggggcggcggcggagggagcaggaggttggggcttgagcccgtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctgtttgcaggcctttcagatatatccatctcacaagacatccccgtagaaggagaaatcaccattcctatgagatctcgcatccgggagtttgacagctccacattaaatgaatctgttcgcaataccatcatgcgtgatctaaaagctgttgggaaaaaattcatgcatgttttgtacccaaggaaaagtaatactcttttgagagattgggatttgtggggccctttgatcctttgtgtgacactcgcattaatgctgcaaagagactctgcagatagtgaaaaagatggagggccccaatttgcagaggtgtttgtcattgtctggtttggtgcagttaccatcaccctcaactcaaaacttcttggagggaacatatctttttttcagagcctctgtgtgctgggttactgtatacttcccttgacagtagcaatgctgatttgccggctggtacttttggctgatccaggacctgtaaacttcatggttcggctttttgtggtgattgtgatgtttgcctggtctatagttgcctccacagctttccttgctgatagccagcctccaaaccgcagagccctagctgtttatcctgttttcctgttttactttgtcatcagttggatgattctcacctttactcctcagtaaatcaggaatgggaaattaaaaaccagtgaattgaaagcacatctgaaagatgcaattcaccatggagctttgtctctggcccttatttgtctaattttggaggtatttgataactgagtaggtgaggagattaaaagggagccatatagcactgtcaccccttatttgaggaactgatgtttgaaaggctgttcttttctctcttaatgtcatttctttaaaaatacatgtgcatactacacacagtatataatgcctccttaaggcatgatggagtcaccgtggtccatttgggtgacaaccagtgacttgggaagcacatagatacatcttacaagttgaatagagttgataactattttcagttttgagaataccagttcaggtgcagctcttaaacacattgccttatgactattagaatatgcctctcttttcataaataaaaatacatggtctatatccattttcttttatttctctctcttaagcttaaaaaggcaatgagagaggttaggagtgggttcatacacggagaatgagaaaacatgcattaaccaatattcagattttgatcaggggaaattctacacttgttgcaaaaaaaaaaaaaaaaaaagcaaagggcctctaaagaatcagcctctttggtccctttgtgctgtcacctttttgccatgtttaacagcatcttggttggcactctagtcttaatcttgctccttaactttgaatatgcagtctaaaatgtcagtagtcaacatgtaattttcctttgaaattctgaatattccagtgctggaacttatccaaaaagaagacctcagaaacttagattggtagatctctagtgcatattatcatgtgggcaccttctcttagggtggaatgaggcagtctggatgcagcatagttaaaaggagctgtttaatattctctgtagtctggcctcttaactagaaagtaaagctaaatcagaagcctgtatttaaccatgtgaacagggagggatttagtgttctgatggctgattaatagaacagctagatacttagagcatgacgtgggatgggatgagtttacagctgctgccttttcatggtgagcttagcagttttctcattagatgtgtttttttgggttggggaatagcaatttattttattgattttagactttatcaagctaattagctcccctttagataagtacatgttgcacatgtgcacctacttgtaatctcagatatttatgcacacaagtgtgaaggtttttcagggagcagagcatctgggacaggctgattctgagctaaacagggctcctttaaggcaatatgaactgttgccttctataaattgcacattgaggaactctaatagacaaagattaggtgtcaggcagaaaacactcattgtaaatatactattagttgataaacataggactttcttattccccagtttttctttatcatataatttaaatatttattcattttgtatttaaagactacctacacatagatatatgattccaaagtcatactttctccatccccacattagccaagtgaatacagggccaaatgggttcttggaatgataataacaaagcattacaaagtgggtccccttggttccagccttgtccagagtttttggttatatatttctatttattacaatttaccttttaaattgtaaaataaacctttgtgtggacagagccaatgtttcaatcttgaatgagtaaagaaaatactttggaactgatcctcattttgaaattggttctaaattattatccatttccaatgtctgaaattctcttacttcctgctaaaactctctttctgccaaagttgtttcgtaatctgtctcaatgactataatgtaaaattaaagaagtaaccatgcttctcaagggggaattaaaagtgtttattgaattttactcaggctaattgtttggtcagaaattcctaaggccacagctttggggggttcgtgtagatgtacatggtgggtgggttataaatattgggacttaaggcagcttgttctatgtatttatctttgctcttgggtgacttagggaatgattttatttgatttaaccttctttctgtttgccccgagaatactcgccagtggcgcttgcagttgtagcatttaccccaagataactttgcctacgaaatatttcgcttttattattttcacatcattctagtatatggactttggaaacaaaagacattgttctatttatagcattcttttttttttttagtagcggtatttccatttacaaaatatagtaactcttgattactgaaaatgtcaaatcctagaaaacgtagcatgcctatacatgatgttaacatcattctcgaacagttgttggccgaagattcatttgatgaatccaatttttttgaaatagacaattctgatgttctctttagaaataactcagtttttatcttttttcacattgaaaatcagttagatttgcttaagcctcaaagagaatgtttatgtaaattagcgctggcaatttttttttttctaaacaggaaaagggttaaatgaaggttgataaaatggatgttcaattgtctttctgaaagtgagtggcttgaagggatgaataaatattttcttaatatattcaaaaaagtgcattgctttctgtgatggaagttaagacctaaatgtctggaagttgtaaccctcaacacagcttttcctgatttgctgcaaaggcacatagctgattatagaagtgaagacggcaaggacggggactccaacaaaggaaaccctgttgcaggatttgggaactttcatgcttcagatgaaattcaggcatgtgagcatcactgcagaatgtggtgcatcattgccatcatgagtaatcacttgctgctcctacttctgagaccaagactcttttgtcatattctttagcaataggacgggtaaagactggatttaattgctgttcagagtataaaaactcaattgattccaacatatctgaatgtgcagtaaagtcttaaaagtcaaccgttaatcattaagtcttttgcctctaaagtcttttgcctctgaagaggtttattacatgagttgattttcatattttcattttggtggggttttcctgttgttgggcaaggtggggtcacaggacatgggactagtaagcattttactgtttactatatttgtctttttataaacagtatctcccaaaatgtgattagaaggctaccaagcctgtatttggacatttaattgtgtgctttatataatgtaactactaacagtatttggactgcctgttcattcctggagacaaaaatgaaaatctgtcagttcaagttcttgggtaacatcaagtcattagaatttatctaaagcttatcatgatttgataagacatccattgcatgcagctgttttagctcagtgcaaaacactgaaattgtgattcttagactgtttctgagacatttggatggaaataaatgtataaatgttaattcatgtatataaattagaaacacttttctagattctgtaggcttttgttaaaaatagagaatttcttggggtttacttaggccacagaatggccaaataataataatgacaatgatattactaataataatagctaacctttatttggcacttactgtgtgccaggcactattctatttttttaagaatttttaaaataacagctttattgaaatacactttaccataaacttcacctttttattttttatttttatgagacagggactcacccaggctggagtgcagtggagcagtcatggcacactgtagcctcgacctccctgggctcaagcaatcctcccacttcagtgtcccgagtagttgggactacaggcatgcgtcactacacctaattggctaatttttgtagtttttgtagagatagggtttcgccatgttgcctaggctggtcttgaattcctgggctcaagcgatccacctgctttggcctcccaaaacagtgggattgcaggcgtgagccaccatgcctggctgaaattcaccttttaagatgtacaattcagtggtttttagtatattcacacacaaaattgcacaactatcactaacatctaattttagatcattttgtaacttcaccaagaaaccccaggtctgtcagcagtcagttccattcccccttcatcccagcctctggcaaccactaatctgctttctgtcactattgatttggccagacactattcttctgtgcttctcatgcatctcctgtaataccagtgctacaattctcattttatgtggaaaattgaggcactgagaggttaagtaaattgcccacggtcacacagtaatttgatttacaacagtaataacacattagatgagaacacagtaggacacaattttgaattccatttttatgtacctgaaatgaatacacccctcccccaaggtattttccctattgttagcctttgtaccctaggtacaaatataggtattttccctattgtgttatgtacctgaaatgaatacacccttcccccaaggtattttccctattgttagcctttgtaccctagaactgactggatgtagataacatttgttttcagagtaatggaacactgtatcagcagcatctgagaacataagaacagttggacattggaaagaggtttgttgccctcatccctccttgaacctcttttctctcccgcttccaccaccaccacacatatatacccctttttctcagtcttaagcatcaaacaatttctgcctctttctttttaattctcccagagggatggttaatgcatcacaatttaacttgtctattcaggtattaatagtcaagggatgcatctgtttgcttatagtaccagttatattcctaggaccttagagagcagtagtgtgagaatagaatgcctttctatttgggttaaactatgtgggaggaaaaagtaacagagtaaaggctttgccttaatgaagtcaagtgttctgcctggtgggaagtggccacacgctgcactgcgctgctcttgtttactctgttctttcagagcctttgtactttgccatcactgctagtaatttcttggtccttttcaatactccattttaatcttgatttttttctataaataataaatctgtgaaaaatctgtaaaaagatttgtgactattaaatgtgcaactaaaaacactggaaaaagaa

SEQ ID NO: 8041 - DNA, 937 bp, Homo sapiens
atgtcatcttttcaccaatggatttgcttaaaatttctcacacaaagctacatttactggaggatctttctataaaaaataaacagaggatgtcaaacttggcacaatttgactctgatttttaccaatctaattttactattgataaccaggagcagagtggtaatgactctaatgcctatggaaatctttatggatctagaaaacaacaagctggtgagcagcctcagcctgcctcctttgttccatcagagatgctcatgtcatcgggttacgcaggacaattttttcagccagcatccaactcagattattattcacaatctccttacattgacagttttgatgaagagcctcctttgctagaagaacttggaatccattttgatcacatatggcaaaaaactttgacagtgttaaacccaatgaagccagtagatggcagcattatgaatgaaacggacctcactggacccattcttttttgcgtagccctgggagccaccttgcttctggcaggaaaagttcagtttggttatgtgtatggcatgagtgccattggctgccttgtgattcatgccttgctgaacctgatgagctcttcaggggtgtcgtacggctgtgtggccagcgtgctgggttactgcctgctccccatggtcatcctgtctggttgcgccatgttcttttcactgcagggcatctttggaatcatgtcatccctggtcatcattggctggtgtagtctctcagcttccaagatcttcattgcagccttgcacatggaaggacagcagcttcttgttgcctacccttgtgccatactttatggactttttgccctcctaacaattttctaaagaatgtttgagatggcatttcaagactctgtttgctgtccagattattttggaaatatattaacattcaaatttgg

SEQ ID NO: 8042 - DNA, 1117 bp, Homo sapiens
gatgtcaaacttggcacaatttgactctgatttttaccaatctaattttactattgataaccaggagcagagtggtaatgactctaatgcctatggaaatctttatggatctagaaaacaacaagctggtgagcagcctcagcctgcctcctttgttccatcagagatgctcatgtcatcgggttacgcaggacaattttttcagccagcatccaactcagattattattcacaatctccttacattgacagttttgatgaagagcctcctttgctagaagaacttggaatccattttgatcacatatggcaaaaaactttgacagtgttaaacccaatgaagccagtagatggcagcattatgaatgaaacggacctcactggacccattcttttttgcgtagccctgggagccaccttgcttctggcaggaaaagttcagtttggttatgtgtatggcatgagtgccattggctgccttgtgattcatgccttgctgaacctgatgagctcttcaggggtgtcgtacggctgtgtggccagcgtgctgggttactgcctgctccccatggtcatcctgtctggttgcgccatgttcttttcactgcagggcatctttggaatcatgtcatccctggtcatcattggctggtgtagtctctcagcttccaagatcttcattgcagccttgcacatggaaggacagcagcttcttgttgcctacccttgtgccatactttatggactttttgccctcctaacaattttctaaagaatgtttgagatggcatttcaagactctgtttgctgtccagattattttggaaatatattaacattcaaatttggtgatatgatttctgttttattgcttttgagagagtaataagcagagagacaaagcagcacttaagggtggtgctctaatagcctgttggtttgaatgatgttttgcttttgagtttggtgcattaaaacatttcaaaatacttaaaatcaaaagggatacagttgctgtactgatcaaccctgcttttctcaatagaggtatttctgagaaaagtaagtaaataaactcatatgtttactaaaaggaaatctctagtaagccttttga

SEQ ID NO: 8043 - DNA, 2768 bp, Homo sapiens
tcggttggcgaggtcactgcaggtcagaggtcacgagatcaaggatctggaaccctgaggtgtgcacagcgctgggatgccaggttcggcctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtagccatctttgtgttcatgatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaaggtgctgagagatctccagctgcacaggccaccgccccagggcgtggccgctgttacagaaacaataaaccctgatgggcatggcgtggacagcctctccttggcctcgcgcacgaatgggcgggcccagcgctgggcagggggcagggagctggggacgggccagagtaggcaccacgctgaccagtcgcagaaggcagagaggaaggtttaatgagccctgtccagggcccttcagtggggagcctccttcttcttgcccttctccttcttgcccttctccttcttcttcactttgggcttcttggccttgcccgggatgctctcgtgctgcttggagccagcagcgtgggactgtggggccgagggcagggatgggagagaagagatggttctgggctggaagcgagacagggggaccactccccgcaccctccccgccagccccagtgcggggacgcctctctggggtgcagggcacgtgcttggggacgctggcgagagccccttaccttcacatccgtgtccgaatcgctggagctgctgctggagtcggaagagctgtggtgtccttgctggatggaggtgcggcagtgaggcggcgccccttacccagccccctgaagttggaggcctaaggcaggaccctggggtcaggggcaaccccagccttcccgcccctccgcagccggtgatgaggcgacttacctttggacccggacctgcccctgcctccgaccggccctgaactttgtggggactgagcttgggatctcccccgtggcccgcccccacaccgggcttctgggaggtgggctccagggctgtggagagaagttgggtggttggtgcaggcagcttctgggcttgagtccggccccctgcacctccagtccacactccccaggagctcacctgctcccaggtcgaactccatggcggtaagagaagttgggtcctaaggccaagggcgcctgggccctgcagaggagcggagcagggggaggagcgctgagacctgcccgttggaggaatgctgagacgccccacccaacctctgtcctggtcctcagccctgactcattgcccggcaccacccaggatttcctctgtgagaagtgggggagatggacaggtgactgcttccgccagccttggtgcctcaggggaggccgactgaggggggctctgtggatggcattcggggagctacaggtttcccccaaaagctcagatgctcgttcttgaagagggaggtgctgcccctgccttcctgcgtaccgcgacaatacagcttcctccgcggcgctttaacacgcagggcgctgctgccaggggcgtcccgtgttctaactcgctcccacagcccctccggcttggtgagcagcgtctgaggggtgaggggcatagacttggagccagcctgctgcactagatgccagctgtgtcacttagcagcaaggtgacctcagcaaagttgttttacctctgtgcctcagtttcctcatctgtaaataacagctacccatgggattgatgtgaaagtcagaggagttaatttcctagaatggtgtctggcatgaagtactgataatgtgttggttttttaaaaaataaaaggtaggtgttttaggccagt

SEQ ID NO: 8044 - DNA, 2854 bp, Homo sapiens
agccgggcgggcacgctccgaaccgcggcttaggtggcggcggcgaaggatgcacccggcaggcttggcggcggcggctgcggggacgccccggctgccctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtagccatctttgtgttcatgtttccccttttgccgggcgcggtggctcatgcttgtaatcccagcactttgggaggccgaggcggtcggatcacgagatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaaggtgctgagagatctccagctgcacaggccaccgccccagggcgtggccgctgttacagaaacaataaaccctgatgggcatggcgtggacagcctctccttggcctcgcgcacgaatgggcgggcccagcgctgggcagggggcagggagctggggacgggccagagtaggcaccacgctgaccagtcgcagaaggcagagaggaaggtttaatgagccctgtccagggcccttcagtggggagcctccttcttcttgcccttctccttcttgcccttctccttcttcttcactttgggcttcttggccttgcccgggatgctctcgtgctgcttggagccagcagcgtgggactgtggggccgagggcagggatgggagagaagagatggttctgggctggaagcgagacagggggaccactccccgcaccctccccgccagccccagtgcggggacgcctctctggggtgcagggcacgtgcttggggacgctggcgagagccccttaccttcacatccgtgtccgaatcgctggagctgctgctggagtcggaagagctgtggtgtccttgctggatggaggtgcggcagtgaggcggcgccccttacccagccccctgaagttggaggcctaaggcaggaccctggggtcaggggcaaccccagccttcccgcccctccgcagccggtgatgaggcgacttacctttggacccggacctgcccctgcctccgaccggccctgaactttgtggggactgagcttgggatctcccccgtggcccgcccccacaccgggcttctgggaggtgggctccagggctgtggagagaagttgggtggttggtgcaggcagcttctgggcttgagtccggccccctgcacctccagtccacactccccaggagctcacctgctcccaggtcgaactccatggcggtaagagaagttgggtcctaaggccaagggcgcctgggccctgcagaggagcggagcagggggaggagcgctgagacctgcccgttggaggaatgctgagacgccccacccaacctctgtcctggtcctcagccctgactcattgcccggcaccacccaggatttcctctgtgagaagtgggggagatggacaggtgactgcttccgccagccttggtgcctcaggggaggccgactgaggggggctctgtggatggcattcggggagctacaggtttcccccaaaagctcagatgctcgttcttgaagagggaggtgctgcccctgccttcctgcgtaccgcgacaatacagcttcctccgcggcgctttaacacgcagggcgctgctgccaggggcgtcccgtgttctaactcgctcccacagcccctccggcttggtgagcagcgtctgaggggtgaggggcatagacttggagccagcctgctgcactagatgccagctgtgtcacttagcagcaaggtgacctcagcaaagttgttttacctctgtgcctcagtttcctcatctgtaaataacagctacccatgggattgatgtgaaagtcagaggagttaatttcctagaatggtgtctggcatgaagtactgataatgtgttggttttttaaaaaataaaaggtaggtgttttaggccagt

SEQ ID NO: 8045 - DNA, 2786 bp, Homo sapiens
agccgggcgggcacgctccgaaccgcggcttaggtggcggcggcgaaggatgcacccggcaggcttggcggcggcggctgcggggacgccccggctgcgtaagtggccctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtagccatctttgtgttcatgatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaaggtgctgagagatctccagctgcacaggccaccgccccagggcgtggccgctgttacagaaacaataaaccctgatgggcatggcgtggacagcctctccttggcctcgcgcacgaatgggcgggcccagcgctgggcagggggcagggagctggggacgggccagagtaggcaccacgctgaccagtcgcagaaggcagagaggaaggtttaatgagccctgtccagggcccttcagtggggagcctccttcttcttgcccttctccttcttgcccttctccttcttcttcactttgggcttcttggccttgcccgggatgctctcgtgctgcttggagccagcagcgtgggactgtggggccgagggcagggatgggagagaagagatggttctgggctggaagcgagacagggggaccactccccgcaccctccccgccagccccagtgcggggacgcctctctggggtgcagggcacgtgcttggggacgctggcgagagccccttaccttcacatccgtgtccgaatcgctggagctgctgctggagtcggaagagctgtggtgtccttgctggatggaggtgcggcagtgaggcggcgccccttacccagccccctgaagttggaggcctaaggcaggaccctggggtcaggggcaaccccagccttcccgcccctccgcagccggtgatgaggcgacttacctttggacccggacctgcccctgcctccgaccggccctgaactttgtggggactgagcttgggatctcccccgtggcccgcccccacaccgggcttctgggaggtgggctccagggctgtggagagaagttgggtggttggtgcaggcagcttctgggcttgagtccggccccctgcacctccagtccacactccccaggagctcacctgctcccaggtcgaactccatggcggtaagagaagttgggtcctaaggccaagggcgcctgggccctgcagaggagcggagcagggggaggagcgctgagacctgcccgttggaggaatgctgagacgccccacccaacctctgtcctggtcctcagccctgactcattgcccggcaccacccaggatttcctctgtgagaagtgggggagatggacaggtgactgcttccgccagccttggtgcctcaggggaggccgactgaggggggctctgtggatggcattcggggagctacaggtttcccccaaaagctcagatgctcgttcttgaagagggaggtgctgcccctgccttcctgcgtaccgcgacaatacagcttcctccgcggcgctttaacacgcagggcgctgctgccaggggcgtcccgtgttctaactcgctcccacagcccctccggcttggtgagcagcgtctgaggggtgaggggcatagacttggagccagcctgctgcactagatgccagctgtgtcacttagcagcaaggtgacctcagcaaagttgttttacctctgtgcctcagtttcctcatctgtaaataacagctacccatgggattgatgtgaaagtcagaggagttaatttcctagaatggtgtctggcatgaagtactgataatgtgttggttttttaaaaaataaaaggtaggtgttttaggccagt

SEQ ID NO: 8046 - DNA, 2905 bp, Homo sapiens
gcatagatgaatgtatcagtggatggatagttggctagatgggtgggttggtggatgaatggcagagcttgcacctgccagtccatctgacatcaaagccagtgtctctaatggtgacaccaccctcctctgcagcaggaggcagagctgtgggatgaatgaggttcgccaggtctcccttacctatcctgggtccccagctccttctcactctcttcccttgcagcctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtagccatctttgtgttcatgatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaaggtgctgagagatctccagctgcacaggccaccgccccagggcgtggccgctgttacagaaacaataaaccctgatgggcatggcgtggacagcctctccttggcctcgcgcacgaatgggcgggcccagcgctgggcagggggcagggagctggggacgggccagagtaggcaccacgctgaccagtcgcagaaggcagagaggaaggtttaatgagccctgtccagggcccttcagtggggagcctccttcttcttgcccttctccttcttgcccttctccttcttcttcactttgggcttcttggccttgcccgggatgctctcgtgctgcttggagccagcagcgtgggactgtggggccgagggcagggatgggagagaagagatggttctgggctggaagcgagacagggggaccactccccgcaccctccccgccagccccagtgcggggacgcctctctggggtgcagggcacgtgcttggggacgctggcgagagccccttaccttcacatccgtgtccgaatcgctggagctgctgctggagtcggaagagctgtggtgtccttgctggatggaggtgcggcagtgaggcggcgccccttacccagccccctgaagttggaggcctaaggcaggaccctggggtcaggggcaaccccagccttcccgcccctccgcagccggtgatgaggcgacttacctttggacccggacctgcccctgcctccgaccggccctgaactttgtggggactgagcttgggatctcccccgtggcccgcccccacaccgggcttctgggaggtgggctccagggctgtggagagaagttgggtggttggtgcaggcagcttctgggcttgagtccggccccctgcacctccagtccacactccccaggagctcacctgctcccaggtcgaactccatggcggtaagagaagttgggtcctaaggccaagggcgcctgggccctgcagaggagcggagcagggggaggagcgctgagacctgcccgttggaggaatgctgagacgccccacccaacctctgtcctggtcctcagccctgactcattgcccggcaccacccaggatttcctctgtgagaagtgggggagatggacaggtgactgcttccgccagccttggtgcctcaggggaggccgactgaggggggctctgtggatggcattcggggagctacaggtttcccccaaaagctcagatgctcgttcttgaagagggaggtgctgcccctgccttcctgcgtaccgcgacaatacagcttcctccgcggcgctttaacacgcagggcgctgctgccaggggcgtcccgtgttctaactcgctcccacagcccctccggcttggtgagcagcgtctgaggggtgaggggcatagacttggagccagcctgctgcactagatgccagctgtgtcacttagcagcaaggtgacctcagcaaagttgttttacctctgtgcctcagtttcctcatctgtaaataacagctacccatgggattgatgtgaaagtcagaggagttaatttcctagaatggtgtctggcatgaagtactgataatgtgttggttttttaaaaaataaaaggtaggtgttttaggccagt

SEQ ID NO: 8047 - DNA, 2696 bp, Homo sapiens
gcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctgcacaacaccatggagtctctgttagagcgaggtgagaagctagatgacttggtgtccaaatccgaggtgctgggaacacagtctaaagccttctataaaactgcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgctaggattggcttcccgcagagggcagggcccatcctaagcagcttccaagtcccacaaaggtggcttgtgggaggatttggaaggagctgcattgtgggcggggagtgtgtgggttgggttcgtaccagcaagtagactaggaactgagcccaggaaagggggatgttttcctggtgtttggatggtcagctgggagtgtccatcatcaggggaagatcaaacacaggtgcactcagctgcccagggcctctgggacacttgccttgacttgcaacttgccttgaacatcacgatcaaagcagcaggtgctgtggtctctcaaaattgatttttatttgactctgtggctctaagactgccttgaaccgcctgaggcctatgcatctgaacaagtgggtctctcccttgagcaccaggagtgggtgccagccggccccgaggattcccagcaccccacctatggtcttgccagcataggcttgctagttccttcttggtcagaggtagctgcagaggggggaggccaagggtttggtctaagctgtgccctgccacctggcaggaggcccactcactgcccaagtcatggcaacaggctggagcagcccaggagatgggcctaaaatgttctggatcccttgggtcctagtgttatgttccagtctgcccacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtcctgacccccaatgtgggcaggggctgggcaggagggtggggtctgctgtgggttcagaggactccacctcctggctggtttacctgctgctgcccattttctctgggtactgctggccagaggactttagcctacccctgaagagcctgtccatgtcattttcctactgccatagataccctaagcccagggccccttgaggcccagactcagcctgcccactggtgccggagacggagtggagtgggcctggatccgagggatgctacctctccctttcccacttgaggaccctggggagagatgggggcggggaaaatggaggtatgaatttggggtaagaggaagtgagatctccgcttgcaggtcagcccctgccttgcagggcgggctggcttgactcaggccctgtgagatagagggcccagcccagccccacccacagatcccctgctcctgttgtgttctgttgtaaatcatttggcgagactgtattttagtaactgctgcctaacttccctgtgttctatttgagaggcgcctgtctggataaagttgtcttgaaatttca

SEQ ID NO: 8048 - DNA, 1270 bp, Homo sapiens
atccggaagtggattgcgagccaggaggaggaagccggcggtggccccgtcagcagccggctgctgagaggccggtaggcggcggcggtcccgaggggcggcggccgcgctgctccctgagaacgggtcccgcagctgggcaggcgggcggcctgagggcgcggagccatgaagctgtacagcctcagcgtcctctacaaaggcgaggccaaggtggtgctgctcaaagccgcatacgatgtgtcttccttcagctttttccagagatccagcgttcaggaattcatgaccttcacgagtcaactgattgtggagcgctcatcgaaaggcactagagcttctgtcaaagaacaagactatctgtgccacgtctacgtccggaatgatagtcttgcaggtgtggtcattgctgacaatgaatacccatcccgggtggcctttaccttgctggagaaggtactagatgaattctccaagcaagtcgacaggatagactggccagtaggatcccctgctacaatccattacccagccctggatggtcacctcagtagataccagaacccacgagaagctgatcccatgactaaagtgcaggccgaactagatgagaccaaaatcattctggcccggaaacaaaactcatgctgtgccatcatgtgatgcagcctgccagaggcccaatgctggaatggcaccatcattcacatcagaactgcagcccctggaaaagaagagacagccatagacgaggagccagagtgggggcagactggccatttttattttgaagttcctgcgagaaatggatggtggaagggtggcgaatgttcaaattcatatgtgtggtagtgattcttggaaagaatttgaggtccccaaaggtgtatttttgggcaaatgaaaccataaactccgactggcttctgtagatgccaaagggctctttttcagctaaccctgggaaggctctgtgggagggaggtcggagccagctgtttctcgatctttggtatatctttggatcttatttgtacattaatgatattaacactccagtggggggtggggagtccctgatgctagggctggggtgggtggagtttgaagactcttgggaaagcctctcctggggccactgttgggggtgggagtgagcccaccacagaggccacaggcaggcccccacttcaggcccaaggcctggggcggggggaacagtcactgggtctcagattctgagactgttgtttagcttacctttctgcta

SEQ ID NO: 8049 - DNA, 2741 bp, Homo sapiens
attaaataagagaaaaaagcataaaaggagtaggcttttttggcagatactgttatatgggatggacaggaggggaagacatgaaaatcaactaaaatgaaatacataaaaaatcagtaaagagcctgcttacgaaagtggaaaaacaacagctgggcggggtcgcagggtggcaaacgtacgcgggcacgtgcacgtgcttttggggccgacagacgcgccagttgcctaggcgcatgcgtctggctatcccagaagcacctgcgccttccggctcgtgctttcctcagtctcgcgcctttctctgcagctcgcgcctttctctgcagctcgcgcctttctctgcagctcgcgcctttctctgcagctcgcgcctttctctgcagctcgccccttcctctgcagctcgccccttcctctgcagctcccacctcactcccctcagcgttctttttcccacggtcttcccgttgccgctaacctaactaactctcagccatggcctccaacgaagatttctccatcacacaagacctggagatcccggcagatattgtggagctccacgacatcaatgtggagccccttcctatggaggacattccgacggaaagcgtccagtacgaggatgtggatggcaattggatctacggtggccacaaccatccgccattgatggtgttgcagccgctcttcacgaacacgggctatggcgaccacgaccaggaaatgcttatgttgcagacacaagaggaagtggtgggctattgcgactcagacaaccagctaggcaacgacttggaggaccagttggccctcccggatagcattgaagacgagcacttccagatgaccctggcctctctgtcggcctcggcggcatcaacatcaacatcaacccagagccgcagcaaaaagcccagcaaaaagcccagcggcaagagtgccaccagcactgaggccaacccggcaggcagcagctccagcctgggcacgaggaagtgggagcagaagcaaatgcaggtcaaaacgctggagggtgagttttccgtgactatgtggtcccctaacgataacaatgaccaaggggcagtgggtgaaggccaggctgaaaacccacctgattattccgagtacttgaaagggaagaaacttcctcctggggggttaccaggcattgatctctcagatcctaaacagctggcagaatttactaaagtgaagcccaaaaggtccaaaggagaacctcccaaaacagtcccttgctcttatagcggctgcgaaaagatgttccgggattacgccgccatgagaaaacatctccacatccacgggcccagagtccacgtatgtgcagaatgtggcaaagcttttcttgagagctcaaagctgagacgacaccagctggtccacaccggcgagaagccctttcagtgcacattcgaaggctgcgggaaacgcttttcccttgatttcaatttgcgcacacacttgcgcatccacaccggcgataagcccttcgtgtgccccttcgatgtttgcaacaggaagttcgctcagtcaaccaacctgaaaacccacatattaacgcatgtgaagaccaaaaacaacccgtgaaaaggagaagacccctctcagacttgggaattatcttccaggactgcggtagggaataaatatgcctctcaaagctttgtatgttgtttctaagagttttaaaaaaaaatgaatcctgcacatttaaggttcgtgttttgttagagtagtaaaaatagaatttaaacgtttttaaaaaggtaaaccttgacataagataatagtgctaagatgccatagcttgttctgtaactatttttgtaaagtttggtcccaacaggagaaaaattcgtagacttcacatcaagagacggttcttacaaactgtttaaaatgggacttttcacattcttagaaataggaagttcatttattgtttacaatgtttttaaaaaacttgttaaaaaattcaaagtgttcatgtttatacttttaggaatatgcttaataagtctatgtatggtttttctggaggttgataactttgggaaagatttactttaaaagagtgaacaattatatgcatacgtgaagtattttcctgcttaaaaaagttatataggtgttatttgttttaatcttggttgtagtcttggatgttaacacatcttgcattttagctgtattaggtcatgtagtattgatattaggtgatttaatagtactagtttaaacctattttagtcattttattttccccaaaatactaccagatgctgttgtttagtgtaatttctttgcctgttcagttaaagtagtgcttgcttgtagaatatattgtgtatatgttgactttaacacttaagaagtacatcctgtgtaatagaaaaagcaaaataaaacacctcttctaaagaaggaaaaaagtagtttgcctatatcagtacagaagttagaactaaagaaaagggggagggtgctactggcatctggtgagtggagggagatcaggaatgccactaaacatcctacaatgcacagacagccccacgaaacacataattatttggctaaaatgccaatagtgtcaggtgcaggggctcaggcctgtaatgtcaacactttgggaggccgaggtgggtggatcgtttgagctcaggaattgaacatcagcctgggcaacatggcataactcggtctctacc

SEQ ID NO: 8050 - DNA, 4259 bp, Homo sapiens
ggctccgagccgtaggagccggatcgggggaggggccgggcccaggagcctcagccccgccggcagccctaagggcaaggtaaccgccacggggtccccgtcgcgaccccctccctcccggagctcccgtccccgggatcccaagctccgccccgccgacccccgtctcccctggaccccggctctagcctgacgagatccccaacctcctgaggtgctctggccccggattctcccgggctgcattctctgctcctcctcgcctgcgaagcatcacgtccgcttcccgacgctgagggcagccccgtccagggcagtggctctgccaatgatcctgtgagtattcaggaatcactgttgcccctggggatccttgtcctggagtggcccacctgcttgcccccagcatggcgtccgacactcccgagtcgctgatggccctctgtactgacttctgcttgcgcaacctggatggcaccctgggctacctgctggacaaggagaccctgcggctacatccggacatcttcttgcccagcgagatctgtgaccggctcgtcaatgagtatgtggagctggtgaacgctgcctgtaacttcgagccacacgagagcttcttcagcctcttttcggacccccgcagcacccgcctcacgcggatccacctccgtgaggacctggtgcaggaccaggacctggaggccatccgcaagcaggacctggtggagctgtacctgactaactgcgagaagctgtccgccaagagcctgcagacactgaggagcttcagccacaccctggtgtccttgagcctcttcggctgtacaaacattttctatgaggaggagaacccagggggctgtgaagatgagtacctcgtcaaccccacctgccaggtgctggttaaggatttcaccttcgagggcttcagccgcctccgcttcctcaacttgggccgcatgattgattgggtccctgtggagtccctgctgcggccgcttaactccctggctgccttggacctctcaggcattcagacgagcgacgccgccttcctcacccagtggaaagacagcctggtgtccctcgtcctctacaacatggacctgtccgacgaccacatccgggtcatcgtgcagctgcacaagctgcgacacctggacatctcccgagaccgcctctccagctactacaagttcaagctgactcgggaggtgctgagcctctttgtgcagaagctggggaacctaatgtccctggacatctctggccacatgatcctagagaactgcagcatctccaagatggaagaggaagcggggcagaccagcattgagccttccaagagcagcatcatacctttccgggctctgaagaggccgctgcagttcctcgggctctttgagaactctctgtgccgcctcacgcacattccagcctacaaagtaagtggtgacaaaaacgaagagcaggtgctgaatgccatcgaggcctacacggagcaccggcctgagatcacctcgcgggccatcaacttgctttttgacatcgcccgcatcgagcgttgcaaccagctgctgcgggccctgaagctggtcatcacggccctcaagtgccacaaatatgacaggaacattcaagtgacaggcagcgccgctctcttctacctaacaaattccgagtaccgctcagagcagagtgtgaagctgcgccggcaggttatccaggtggtgctgaatggcatggaatcctaccaggaggtgacggtgcagcggaactgctgcctgacgctctgcaacttcagcatccccgaggagctggaattccagtaccgccgggtcaacgagctcctgctcagcatcctcaaccccacgcggcaggacgagtctatccagcggatcgccgtgcacctgtgcaatgccctggtctgccaggtagacaacgaccacaaggaggccgtgggcaagatgggctttgtcgtgaccatgctgaagctgattcagaagaagctgctggacaagacatgtgaccaggtcatggagttctcctggagtgccctgtggaacatcacagatgaaactcctgacaactgcgagatgttcctcaatttcaacggcatgaagctcttcctggactgcctgaaggaattcccagagaagcaggaactgcataggaatatgctaggacttttggggaatgtggcagaagtgaaggagctgaggcctcaactaatgacttcccagttcatcagcgtcttcagcaacctgttggagagcaaggccgatgggatcgaggtttcctacaatgcctgcggcgtcctctcccacatcatgtttgatggacccgaggcctggggcgtctgtgagccccagcgtgaggaggtggaggaacgcatgtgggctgccatccagagctgggacataaactctcggagaaacatcaattacaggtcatttgaaccaattctccgcctccttccccagggaatctctcctgtcagccagcactgggcaacctgggccctgtataacctcgtgtctgtctacccggacaagtactgccctctgctgatcaaagaaggggggatgccccttctgagggacataattaagatggcgaccgcacggcaggagaccaaggaaatggcccgcaaggtgattgagcactgcagtaactttaaagaggagaacatggacacgtctagatagaggcctccgtccccatggccgccaccgctctggaccacaggcggggaggaagcatgctcaagcagcccagcgggcgggccccttccgagggagcctcccacggagtgaagagacatgggggacttttgcacaaccgacgcttttccttaatgttagtgagatatatatatattatatatatatattttttttttggttaggaagtgtgaagttttgtgtgtatgatttctgtgcaaaaacaaaagcaacactcctgagtccttgcagcttccttggccattctcaaacccactcagccttcatcgctgacacacacactcctaccccaaccagactaaatgcctataacgctgtgagtgtccagtccttgtccaggaaactcagatcccggcctggcttcctttcatgagaggagcaggccttggacagcgtatcgagcatcctgacccactgcccctgcctgagaacgccatctcggctcccgggcacagctgatggggtttggggattagaacttaccccactgggtctcccaaaagccttggtgctcccggctgtgggccatctggggcaggaaagtgagccattcctaggctgaggtccaggcagccctgcccctgaagaccctctaggagcagggcacccagtggccctgctgctgtccagccaggcctgcctgaggccacgctgctatggaggctgcctcctagtctcccaccaggtcccaggctgtggaaagccccagcccagggatggtcagaactcaggggcagattccactgccccttctgccaaacacatccagaacctgccctcagccctggaagctagcatcttctggggccaggggcttgcttcctcgctccatagccctcaactgcccaggcgctcccaccagcagaactgagcctgcctcctcctcccagcctgccccgctgcccagaggaccccacgcctctcagaggcagaggtcccatgacagcctttgacccacaacggccacacagccgcctccagaccagcactcggactgccctgcagtggccgcttgggcctccctggcggtcccgccctgccctaggctttaccttggaagcctgagaggcgccggctctcttgctcctccatcgatggacactgcattgcttctcatcggacacttgtggagcgcaggggcctggggagcagcgctaaccctggaggcagcctttgggtgatggctttttcttcccttttcctcccgcgggcctgttttcaggtgttcctagcatttctgcctccaggcaggacggcaggggtgagcagctttgggagagacacctggcctttttctcctggagcctctccctcccggccctgggaagtgggcgcagccctgtgttcccccagcttggcagatgggctgcatgcggcgctcccttccttcccacgctcagcggccccggccagaccctggcagacttcacacctcattgctttaccccctggggcctggggaaatgtctgtactttgggaagtcacagaaatacatttttgtgcaaaatggaaaa

SEQ ID NO: 8051 - DNA, 715 bp, Homo sapiens
aagtgacgcgccccgggtttgttgacagcggaggcggcggcggctgcaggctccgagccgtaggagccggatcgggggaggggccgggcccaggagcctcagccccgccggcagccctaagggcaaggcagtggctctgccaatgatcctgtgagtattcaggaatcactgttgcccctggggatccttgtcctggagtggcccacctgcttgcccccagcatggcgtccgacactcccgagtcgctgatggccctctgtactgacttctgcttgcgcaacctggatggcaccctgggctacctgctggacaaggagaccctgcggctacatccggacatcttcttgcccagcgagatctgtgaccggctcgtcaatgagtatgtggagctggtgaacgctgcctgtaacttcgagccacacgagagcttcttcagcctcttttcggacccccgcagcacccgcctcacgcggatccacctccgtgaggacctggtgcaggaccaggacctggaggccatccgcaagcaggacctggtggagctgtacctgactaactgcgagaagctgtccgccaagagcctgcagacactgaggagcttcagccacaccctggtgtccttgagcctcttcggctgtacaaacattttctatgaggaggagaacccagggggctgtgaagatgagtacctcgtcaaccccacctgccaggtgct

SEQ ID NO: 8052 - DNA, 460 bp, Homo sapiens
aggtcgccgcccaatttcccatttggaagctcggttgcctggtggcgcatgccctagatggaggcagtggctctgccaatgatcctgtgagtattcaggaatcactgttgcccctggggatccttgtcctggagtggcccacctgcttgcccccagcatggcgtccgacactcccgagtcgctgatggccctctgtactgacttctgcttgcgcaacctggatggcaccctgggctacctgctggacaaggagaccctgcggctacatccggacatcttcttgcccagcgagatctgtgaccggctcgtcaatgagtatgtggagctggtgaacgctgcctgtaacttcgagccacacgagagcttcttcagcctcttttcggacccccgcagcacccgcctcacgcggatccacctccgtgaggacctggtgcaggaccaggacctggaggccatccgc

SEQ ID NO: 8053 - DNA, 1335 bp, Homo sapiens
aattgctcagctgccagagaagtgactggaatagaggttgtagcttaggcaccgctgctccctccagtccctccgtgcagccgatgatggccctatggtccctgctccatctcaccttcctggggttcagcattaccttgctgttggtccacgggcagggcttccaagggacagcagccatctggccatccctcttcaacgtcaacttgtccaagaaggttcaggaaagcatccagatcccgaacaatgggagtgcgcccctgctcgtggatgtgcgggtgtttgtctccaacgtgtttaatgtggacatcctgcgatacacaatgtcctccatgctgctgcttaggctgtcctggctggacactcgcctggcctggaacactagtgcacacccgcggcacgccatcacgctgccctgggagtctctctggacaccaaggctcaccatcctggaggcgctctgggtggactggagggaccagagcccccaggctcgagtagaccaggacggccacgtgaagctcaacctggccctcgccacggagaccaactgcaactttgagctcctccacttcccccgggaccacagcaactgcagcctcagcttctacgctctcagcaacacggcgatggagttagagttccaggcccacgtggtgaacgagattgtgagtgtcaagagggaatacgtagtttatgatctgaagacccaagtcccaccccagcagctggtgccctgcttccaggtgacgctgaggctgaagaacacggcgctcaagtccatcatcgctctcttggtgcctgcagaggcactgctgttggctgacgtgtgcggggggttgctgcccctccgggccattgagcgcataggctacaaggtgacattgctgctgagttacctcgtcctccactcctccctggtgcaggccctgcccagctcctcctcctgcaacccactgctcatttactacttcaccatcctgctgctgctgctcttcctcagcaccatagagactgtgctgctggctgggctgctggcccggggcaaccttggggccaagagcggccccagcccagccccgagaggggaacagcgagagcacggcaacccagggcctcatcctgctgaagagccctccagaggagtaaaggggtcacagagaagctggcctgagactgctgaccgcatcttcttcctcgtgtatgtggttggggtgctgtgcacccaattcgtctttgcaggaatctggatgtgggcagcgtgcaagtctgacgcagcccctggagaggctgcaccccatggcaggcggcctagactgtaaaggggcagggcct

SEQ ID NO: 8054 - DNA, 464 bp, Homo sapiens
aattgctcagctgccagagaagtgactggaatagaggttgtagcttaggcaccgctgctccctccagtccctccgtgcagccgatgatggccctatggtccctgctccatctcaccttcctggggttcagcattaccttgctgttggtccacgggcagggcttccaagggacagcagccatctggccatccctcttcaacgtcaacttgtccaagaaggttcaggaaagcatccagatcccgaacaatgggagtgcgcccctgctcgtggatgtgcgggtgtttgtctccaacgtgtttaatgtgtcttctgtcctccccagagcaactgccctccacagccatggcgactgcagtggctcggccccttgcagcaaggccagaggctcaggttgccatggcctcactcctggaaaccacctgaaggtgcagccaccctgtataaacccatcaggtgacatctaa

SEQ ID NO: 8055 - DNA, 3678 bp, Homo sapiens
agtctgagaagaaagggtgtagatggagaggcggtggcctcacctctgcatgctccgtgggaagcggcggaggcgcccagcatccctcctactctgcccttggtggaggtttacgagaaaacacggccatctttatgtgtaaatgttgtaacctcttctcaccaaatcagtcggaactcctctcccacgtttcagagaagcacatggaagaaggggttaatgttgatgagattattattccccttaggcctctgagtacacctgaaccccccaactcaagcaaaaccggagatgagtttttggtcatgaagaggaagagaggcaggcctaaggggtccacgaagaagtccagcacagaagaggagctggcagaaaacatcgtgagtccgactgaggacagcccgctggctccggaggaagggaacagcctgcctccaagcagcttggagtgtagcaagtgctgtcggaagttctccaacacgcgccagctgcggaagcacatctgcattatcgtgctgaatttgggtgaggaggaaggagaagcaggtaacgagtctgaccttgaactagaaaagaagtgtaaggaagatgatcgggaaaaagcctcgaaaagaccacggtcacagaaaacagagaaagtccagaagatctcaggaaaggaggccagacagctttctggggcgaagaaacccatcataagtgtggttttaactgcacacgaagcaattccaggtgctaccaagattgtgccagtggaggctgggccccctgaaacaggagctacaaattctgagaccacttcagcagacctggtgcctcggagaggctaccaggaatacgccattcagcagacaccttatgagcaaccaatgaagtcaagcaggctaggtcccactcagctcaaaatcttcacttgtgaatactgcaacaaggtcttcaagttcaagcactcgctgcaggcccacctgaggatccacaccaatgaaaagccatacaagtgcccccagtgcagctatgccagtgccatcaaggccaacctcaatgtgcacctgcgcaagcacactggagagaagttcgcctgcgactattgctcgttcacctgcctgagcaagggccacctcaaggtgcacatcgagcgagtgcacaagaagatcaagcagcactgccgcttctgcaagaagaagtactctgacgtcaagaacctcatcaagcacatccgagacgcgcatgacccacaggacaagaaggtcaaagaggccttggacgagctctgcctgatgacgagggagggcaagcggcagctgctctatgactgccacatctgtgagcgcaagttcaagaacgagctggtggaagaggagtttgccctccagggcgtgaatgcactcaaggaagaggcctgtcctggggacactcagctggaggagggccggaaggagccggaggcccctggggaaatgcctgccccagctgtgcacctggcctccccgcaggccgaaagcacagccctgccaccctgtgagctggaaaccaccgtggtctcctcctcagacctgcattctcaagaggtggtttcagatgattttttgttgaaaaatgatacctcctccgcagaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatgggaagcagtttaagtgcacggtgtgtgactacacagcggcccagaagccacagctgctgcggcacatggaacagcatgtctccttcaagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggagacagcaacagaagctcctgaggagccctccacccagtatctccacatcacagaggccgaagaagacgttcaagggacacaggcagcggtggccgcgctccaggacctgagatacacctctgagagtggcgaccgactggaccccacggccgtgaacatcctgcagcagatcattgagctgggcgccgagacccatgacgccactgcccttgcctcggtggttgccatggcaccagggacggtgactgtggttaagcaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaac

SEQ ID NO: 8056 - DNA, 3462 bp, Homo sapiens
gagcccgggagcacttccgccctgttgtgaagtgggtgtctcgagccttggggagcagtcccttttctaggagcctcttgaaggactcaccgtagatgcaggaagacattggatgaggtcagcatagctgaagtgaggtgtctgggttagacaatggctatggccctggaattgcaagcccaggcatctccgcagccagagcctgaagaactcctgattgtgaaactggaagaggactcttggggatcagaatccaaactctgggagaaggaccgtggctctgtctctggcccagaggcctcccgccagcgcttcaggcaattccaatacagggatgcagctggaccccacgaggccttcagccagctctgggctctctgctgtcgttggctgaggccggagatccgtctcaaagagcagatcctggagctgctcgtgctggagcagttcctgactatcttgcctagggaggtccagacctgggtgcaggcacgccaccctgagagtggtgaggaggctgtggccttggtggaggattggcaccgagagaccaggactgcaggacagtcgggactggaattgcatacagaagagaccaggcccttaaagacaggggaagaagctcagagcttccagctgcagccagtggatccctggcctgagggacagtcccagaagaagggggtgaagaatacatgccctgaccttcccaatcacctaaatgccgaggtggcaccacagcctttgaaagagagtgctgtcctcactccccgagtccctactctcccaaagatggggagcgttggagattgggaggtgacagctgagtcccaggaagccctgggccctggcaaacatgctgagaaggagctctgtaaagaccccccaggagacgactgtgggaacagcgtgtgcctgggagttccagtttcaaaaccaagtaatacctccgagaaagagcaaggaccagagttttggggtctaagtcttataaattctgggaaaaggagcactgcagattacagcctggataatgagccagctcaggcattgacctggagggattcaagagcctgggaggaacaataccagtgggatgtggaggacatgaaggtgtcaggtgttcactggggctatgaggagaccaagactttcctggcaattttgagtgaatctcctttctctgaaaagctccggacttgtcaccagaaccgccaggtatatcgggccattgcagagcagctaagggcaaggggcttcctgcggacactggagcaatgtcgctatagggtcaaaaacctcctacggaattaccggaaagccaagagcagccacccaccaggtacctgccccttctatgaggagctggaggccctggtcagggctcggacagccatcagagccacagatggcccaggagaggccgtggcacttcccaggctcgggtatagtgacgcagagatggatgagcaggaggaagggggctgggatcctgaagaaatggcagaagactgtaacggtgctggcctggtcaatgttgagtctacccaggggcccaggattgcaggggccccagctctgttccagagtcgtattgcaggtgtgcactggggctatgaggagaccaaggccttcctggcaattctcagtgagtccccattctcggaaaagcttcgtacctgtcaccagaacagccaggtgtaccgggccattgcagagcggctgtgtgctctgggcttcctgcggacactggagcagtgtcgctacagattcaaaaacctccttcgaagctaccggaaagccaagagcagccacccaccagggacatgccctttctatgaggaactggactcgctgatgagggctcgggctgcagtcagggccatggggactgtccgagaggctgcaggtctccctaggtgtgggcagagtagtgctgagactgatgcccaggaggcctggggtgaagtggccaatgaagatgctgtcaaaccttcaaccttgtgtcctaaagccccagacatgggttttgaaatgaggcatgaggatgaagaccagatttcagagcaggacatttttgagggtttgcctggagccttatcaaaatgtcctacagaagctgtttgccaacctcttgactggggagaagacagtgaaaatgaaaatgaagatgaagggcagtggggaaatccctcacaggaacagtggcaagaaagttcttctgaagaggacttagaaaaacttattgaccatcaaggcctgtaccttgcagagaaaccctacaagtgtgacacatgcatgaagagcttcagtcggagctcccacttcattgcccatcagcgaatccacacaggtgagaagccctacaaatgccttgaatgtggaaaaaactttagtgaccgctctaacctcaatacccatcagagaatccacactggagagaagccctataaatgccttgaatgtgggaaaagctttagtgaccattctaatctcatcactcaccagagaattcacacgggggaaaagccctataaatgtggagaatgttggaaaagcttcaaccagagctcaaaccttctgaaacatcagagaatccacttgggaggaaatcctgaccagtgtagtgagcctgggggaaactttgcccaaagcccatcttttagtgctcactggaggaattctacagaagagacagctcctgaacaacctcaaagtatcagtaaggacttgaattctcctggaccacacagcacaaactcaggggagaaactttatgagtgttctgaatgtggaagaagcttctctaagagctctgccctcattagtcaccaaagaatccatacgggagagaaaccatatgaatgtgccgaatgtgggaaaagcttcagtaagagctccaccctggccaaccaccagcgcacccacactggagagaagccgtataaatgtgtggactgtgggaagtgcttcagtgagcgctccaagctcatcacacaccagagagtgcacacaggagagaagccctacaaatgccttgagtgtggaaaattcttccgtgaccgttctaacctcattactcaccagaggattcatacgggagagaagccgtataagtgcagagagtgtgggaaatgctttaaccagagctccagtcttattattcaccagagaatccacacaggggagaaaccctacaagtgcacagagtgtggcaaagacttcaacaacagttcccacttcagtgctcaccggagaacccatgcaggagggaaggcgtcgtaggggacagtttcctcaacaacaaaggaggactcaatgtatatatcttatatcataagatgtatgctagagataaactttccaatttttaagcttggtgtgtacccagggaagttatcttggtataaaccaggtaatttggaagtgaattacaaatactaaggatccagatttgaaggc

SEQ ID NO: 8057 - DNA, 3997 bp, Homo sapiens
cttccgccctgttgtgaagtgggtgtctcggtggagccttggggagcagtcccttttctaggagcctcttgaaggactcaccgtagatgcaggaagacattggatgaggtcagcatagctgaagtgaggtgtctgggttagacaatggctatggccctggaattgcaagcccaggcatctccgcagccagagcctgaagaactcctgattgtgaaactggagctgctcgtgctggagcagttcctgactatcttgcctagggaggtccagacctgggtgcaggcacgccaccctgagagtggtgaggaggctgtggccttggtggaggattggcaccgagagaccaggactgcaggacagtcgggactggaattgcatacagaagagaccaggcccttaaagacaggggaagaagctcagagcttccagctgcagccagtggatccctggcctgagggacagtcccagaagaagggggtgaagaatacatgccctgaccttcccaatcacctaaatgccgaggtggcaccacagcctttgaaagagagtgctgtcctcactccccgagtccctactctcccaaagatggggagcgttggagattgggaggtgacagctgagtcccaggaagccctgggccctggcaaacatgctgagaaggagctctgtaaagaccccccaggagacgactgtgggaacagcgtgtgcctgggagttccagtttcaaaaccaagtaatacctccgagaaagagcaaggaccagagttttggggtctaagtcttataaattctgggaaaaggagcactgcagattacagcctggataatgagccagctcaggcattgacctggagggattcaagagcctgggaggaacaataccagtgggatgtggaggacatgaaggtgtcaggtgttcactggggctatgaggagaccaagactttcctggcaattttgagtgaatctcctttctctgaaaagctccggacttgtcaccagaaccgccaggtatatcgggccattgcagagcagctaagggcaaggggcttcctgcggacactggagcaatgtcgctatagggtcaaaaacctcctacggaattaccggaaagccaagagcagccacccaccaggtacctgccccttctatgaggagctggaggccctggtcagggctcggacagccatcagagccacagatggcccaggagaggccgtggcacttcccaggctcgggtatagtgacgcagagatggatgagcaggaggaagggggctgggatcctgaagaaatggcagaagactgtaacggtgctggcctggtcaatgttgagtctacccaggggcccaggattgcaggggccccagctctgttccagagtcgtattgcaggtgtgcactggggctatgaggagaccaaggccttcctggcaattctcagtgagtccccattctcggaaaagcttcgtacctgtcaccagaacagccaggtgtaccgggccattgcagagcggctgtgtgctctgggcttcctgcggacactggagcagtgtcgctacagattcaaaaacctccttcgaagctaccggaaagccaagagcagccacccaccagggacatgccctttctatgaggaactggactcgctgatgagggctcgggctgcagtcagggccatggggactgtccgagaggctgcaggtctccctaggtgtgggcagagtagtgctgagactgatgcccaggaggcctggggtgaagtggccaatgaagatgctgtcaaaccttcaaccttgtgtcctaaagccccagacatgggttttgaaatgaggcatgaggatgaagaccagatttcagagcaggacatttttgagggtttgcctggagccttatcaaaatgtcctacagaagctgtttgccaacctcttgactggggagaagacagtgaaaatgaaaatgaagatgaagggcagtggggaaatccctcacaggaacagtggcaagaaagttcttctgaagaggacttagaaaaacttattgaccatcaaggcctgtaccttgcagagaaaccctacaagtgtgacacatgcatgaagagcttcagtcggagctcccacttcattgcccatcagcgaatccacacaggtgagaagccctacaaatgccttgaatgtggaaaaaactttagtgaccgctctaacctcaatacccatcagagaatccacactggagagaagccctataaatgccttgaatgtgggaaaagctttagtgaccattctaatctcatcactcaccagagaattcacacgggggaaaagccctataaatgtggagaatgttggaaaagcttcaaccagagctcaaaccttctgaaacatcagagaatccacttgggaggaaatcctgaccagtgtagtgagcctgggggaaactttgcccaaagcccatcttttagtgctcactggaggaattctacagaagagacagctcctgaacaacctcaaagtatcagtaaggacttgaattctcctggaccacacagcacaaactcaggggagaaactttatgagtgttctgaatgtggaagaagcttctctaagagctctgccctcattagtcaccaaagaatccatacgggagagaaaccatatgaatgtgccgaatgtgggaaaagcttcagtaagagctccaccctggccaaccaccagcgcacccacactggagagaagccgtataaatgtgtggactgtgggaagtgcttcagtgagcgctccaagctcatcacacaccagagagtgcacacaggagagaagccctacaaatgccttgagtgtggaaaattcttccgtgaccgttctaacctcattactcaccagaggattcatacgggagagaagccgtataagtgcagagagtgtgggaaatgctttaaccagagctccagtcttattattcaccagagaatccacacaggggagaaaccctacaagtgcacagagtgtggcaaagacttcaacaacagttcccacttcagtgctcaccggagaacccatgcaggagggaaggcgtcgtaggggacagtttcctcaacaacaaaggaggactcaatgtatatatcttatatcataagatgtatgctagagataaactttccaatttttaagcttggtgtgtacccagggaagttatcttggtataaaccaggtaatttggaagtgaattacaaatactaaggatccagatttgaaggcacttttaagtgtaatttgtttttcttctgtaaagacccacacagaatcctgactgtccttgtatttgctatcatgtaagagctgtgtcagtatttgagccaaactggcaacttacgagattagagttaaatcagtggtcctgagcagtgattccaaactctcactgtgccttcacaccatccatgtgtaatccaccccatcagcagtggttctcctactttctcagtgggggcatatcctcaagggagaatgttgtgactctggtgagagaggagttggcctagagcaggccactgtgagctcagcacagagtaggaagaacagtgacatcattacaaaatcatcaatagcagcaatagctggtgtttattgagctgttgctctttggcaagctctgtgctaagaactttgtatacatcatctcatttaatcttcacaacggccccaggagataagtactaactttctccccatttcctagaggcttgggaaattaagtaactcgcactggtcacacatctgtaagtgggagaggcaggattcaacagatctgtctgtcttgagtctatcgtgctcttattgctatactgaattcccattcatgttaggtaacttaggggccagaatctccatgcactttgtagaccacatttcctgttatgaaatttccacattttgaattttttaaacaaatatggaaactgagaatccctaaggattaaaggacttgggatatccagaa

SEQ ID NO: 8058 - DNA, 4052 bp, Homo sapiens
agcattccccgcacgagcccgggagcacttccgccctgttgtgaagtgggtgtctcgagccttggggagcagtcccttttctaggagcctcttgaaggactcaccgtagatgcaggaagacattggatgaggtcagcatagctgaagtgaggtgtctgggttagacaatggctatggccctggaattgcaagcccaggcatctccgcagccagagcctgaagaactcctgattgtgaaactggaagaggactcttggggatcagaatccaaactctgggagaaggaccgtggctctgtctctggcccagaggcctcccgccagcgcttcaggcaattccaatacagggatgcagctggaccccacgaggccttcagccagctctgggctctctgctgtcgttggctgaggccggagatccgtctcaaagagcagatcctggagctgctcgtgctggagcagttcctgactatcttgcctagggaggtccagacctgggtgcaggcacgccaccctgagagtggtgaggaggctgtggccttggtggaggattggcaccgagagaccaggactgcaggacagtcgggactggaattgcatacagaagagaccaggcccttaaagacaggggaagaagctcagagcttccagctgcagccagtggatccctggcctgagggacagtcccagaagaagggggtgaagaatacatgccctgaccttcccaatcacctaaatgccgaggtggcaccacagcctttgaaagagagtggagttccagtttcaaaaccaagtaatacctccgagaaagagcaaggaccagagttttggggtctaagtcttataaattctgggaaaaggagcactgcagattacagcctggataatgagccagctcaggcattgacctggagggattcaagagcctgggaggaacaataccagtgggatgtggaggacatgaaggtgtcaggtgttcactggggctatgaggagaccaagactttcctggcaattttgagtgaatctcctttctctgaaaagctccggacttgtcaccagaaccgccaggtatatcgggccattgcagagcagctaagggcaaggggcttcctgcggacactggagcaatgtcgctatagggtcaaaaacctcctacggaattaccggaaagccaagagcagccacccaccaggtacctgccccttctatgaggagctggaggccctggtcagggctcggacagccatcagagccacagatggcccaggagaggccgtggcacttcccaggctcgggtatagtgacgcagagatggatgagcaggaggaagggggctgggatcctgaagaaatggcagaagactgtaacggtgctggcctggtcaatgttgagtctacccaggggcccaggattgcaggggccccagctctgttccagagtcgtattgcaggtgtgcactggggctatgaggagaccaaggccttcctggcaattctcagtgagtccccattctcggaaaagcttcgtacctgtcaccagaacagccaggtgtaccgggccattgcagagcggctgtgtgctctgggcttcctgcggacactggagcagtgtcgctacagattcaaaaacctccttcgaagctaccggaaagccaagagcagccacccaccagggacatgccctttctatgaggaactggactcgctgatgagggctcgggctgcagtcagggccatggggactgtccgagaggctgcaggtctccctaggtgtgggcagagtagtgctgagactgatgcccaggaggcctggggtgaagtggccaatgaagatgctgtcaaaccttcaaccttgtgtcctaaagccccagacatgggttttgaaatgaggcatgaggatgaagaccagatttcagagcaggacatttttgagggtttgcctggagccttatcaaaatgtcctacagaagctgtttgccaacctcttgactggggagaagacagtgaaaatgaaaatgaagatgaagggcagtggggaaatccctcacaggaacagtggcaagaaagttcttctgaagaggacttagaaaaacttattgaccatcaaggcctgtaccttgcagagaaaccctacaagtgtgacacatgcatgaagagcttcagtcggagctcccacttcattgcccatcagcgaatccacacaggtgagaagccctacaaatgccttgaatgtggaaaaaactttagtgaccgctctaacctcaatacccatcagagaatccacactggagagaagccctataaatgccttgaatgtgggaaaagctttagtgaccattctaatctcatcactcaccagagaattcacacgggggaaaagccctataaatgtggagaatgttggaaaagcttcaaccagagctcaaaccttctgaaacatcagagaatccacttgggaggaaatcctgaccagtgtagtgagcctgggggaaactttgcccaaagcccatcttttagtgctcactggaggaattctacagaagagacagctcctgaacaacctcaaagtatcagtaaggacttgaattctcctggaccacacagcacaaactcaggggagaaactttatgagtgttctgaatgtggaagaagcttctctaagagctctgccctcattagtcaccaaagaatccatacgggagagaaaccatatgaatgtgccgaatgtgggaaaagcttcagtaagagctccaccctggccaaccaccagcgcacccacactggagagaagccgtataaatgtgtggactgtgggaagtgcttcagtgagcgctccaagctcatcacacaccagagagtgcacacaggagagaagccctacaaatgccttgagtgtggaaaattcttccgtgaccgttctaacctcattactcaccagaggattcatacgggagagaagccgtataagtgcagagagtgtgggaaatgctttaaccagagctccagtcttattattcaccagagaatccacacaggggagaaaccctacaagtgcacagagtgtggcaaagacttcaacaacagttcccacttcagtgctcaccggagaacccatgcaggagggaaggcgtcgtaggggacagtttcctcaacaacaaaggaggactcaatgtatatatcttatatcataagatgtatgctagagataaactttccaatttttaagcttggtgtgtacccagggaagttatcttggtataaaccaggtaatttggaagtgaattacaaatactaaggatccagatttgaaggcacttttaagtgtaatttgtttttcttctgtaaagacccacacagaatcctgactgtccttgtatttgctatcatgtaagagctgtgtcagtatttgagccaaactggcaacttacgagattagagttaaatcagtggtcctgagcagtgattccaaactctcactgtgccttcacaccatccatgtgtaatccaccccatcagcagtggttctcctactttctcagtgggggcatatcctcaagggagaatgttgtgactctggtgagagaggagttggcctagagcaggccactgtgagctcagcacagagtaggaagaacagtgacatcattacaaaatcatcaatagcagcaatagctggtgtttattgagctgttgctctttggcaagctctgtgctaagaactttgtatacatcatctcatttaatcttcacaacggccccaggagataagtactaactttctccccatttcctagaggcttgggaaattaagtaactcgcactggtcacacatctgtaagtgggagaggcaggattcaacagatctgtctgtcttgagtctatcgtgctcttattgctatactgaattcccattcatgttaggtaacttaggggccagaatctccatgcactttgtagaccacatttcctgttatgaaatttccacattttgaattttttaaacaaatatggaaactgagaatccctaaggattaaaggacttgggatatcc

SEQ ID NO: 8059 - DNA, 2322 bp, Homo sapiens
gggagcacttccgccctgttgtgaagtgggtgtctcggtggagccttggggagcagtcccttttctaggagcctcttgaaggactcaccgtagatgcaggaagacattggatgaggtcagcatagctgaagtgaggtgtctgggttagacaatggctatggccctggaattgcaagcccaggcatctccgcagccagagcctgaagaactcctgattgtgaaactggaagaggactcttggggatcagaatccaaactctgggagaaggaccgtggctctgtctctggcccagaggcctcccgccagcgcttcaggcaattccaatacagggatgcagctggaccccacgaggccttcagccagctctgggctctctgctgtcgttggctgaggccggagatccgtctcaaagagcagatcctggagctgctcgtgctggagcagttcctgactatcttgcctagggaggtccagacctgggtgcaggcacgccaccctgagagtggtgaggaggctgtggccttggtggaggattggcaccgagagaccaggactgcaggacagtcgggactggaattgcatacagaagagaccaggcccttaaagacaggggaagaagctcagagcttccagctgcagccagtggatccctggcctgagggacagtcccagaagaagggggtgaagaatacatgccctgaccttcccaatcacctaaatgccgaggtggcaccacagcctttgaaagagagtggagttccagtttcaaaaccaagtaatacctccgagaaagagcaaggaccagagttttggggtctaagtcttataaattctgggaaaaggagcactgcagattacagcctggataatgagccagctcaggcattgacctggagggattcaagagcctgggaggaacaataccagtgggatgtggaggacatgaaggtgtcaggtgttcactggggctatgaggagaccaagactttcctggcaattttgagtgaatctcctttctctgaaaagctccggacttgtcaccagaaccgccaggtatatcgggccattgcagagcagctaagggcaaggggcttcctgcggacactggagcaatgtcgctatagggtcaaaaacctcctacggaattaccggaaagccaagagcagccacccaccaggtacctgccccttctatgaggagctggaggccctggtcagggctcggacagccatcagagccacagatggcccaggagaggccgtggcacttcccaggctcgggtatagtgacgcagagatggatgagcaggaggaagggggctgggatcctgaagaaatggcagaagactgtaacggtgctggcctggtcaatgttgagtctacccaggggcccaggattgcaggggccccagctctgttccagagtcgtattggtaagaacatgggggtttagtcagattcagatttccaaccctcctaccagctagactgctattccctgaggtcagggcacaggctgcaagtctggattgaagccactagagtgaagagctacattccttaggtcatcctcaaactccaactttcttttcccatgaccaagtctctttgcaaaagtcttcttagttatagaagcaaacatttttaaagccttaaggggcctcaaagagtgaatccagtatttccaaaagtgtgtcactggtagtatgggatgatcatcgacgttacatgaatgaactttaaattcttgtatttatatatttctcttaatttgtatgagtgcatcaacctgtgatttcacagataacaaagttaggtaaagagtgatggcgagtgaaatattgaacagataatggcagaaatcccgacagtgtagacttgaataatcaatgtctgggaaacatccaatcattgtaaaggtgcaaacatggaagtccatgagatgaggcgtcttatagacgcacaggtaggagcagagcccggatcagagcctgtggctcctgcctgctggtttcacatggttttccctccaccatgttgccttcctgggctacatcactttcctgcagaggagctgagactagaccacctccttttcattcccctgcaaaggaggaaagtgtgtcctcatttggcctttcttgcaggactatttgaaactcatttatgcctctaatctttaggaattctcagctttcatgttttgttaaaaggagaatttatggccaggtgcggtggctcacgcctgtaatcccaacactttgggaggctgaggtgggcagatcacgaggtcaggagatcaagactatcctggccaacatg

SEQ ID NO: 8060 - DNA, 3849 bp, Homo sapiens
atggctatggccctggaattgcaagcccaggcatctccgcagccagagcctgaagaactcctgattgtgaaactggaactgctcgtgctggagcagttcctgactatcttgcctagggaggtccagacctgggtgcaggcacgccaccctgagagtggtgaggaggctgtggccttggtggaggattggcaccgagagaccaggactgcaggacagtcgggactggaattgcatacagaagagaccaggcccttaaagacaggggaagaagctcagagcttccagctgcagccagtggatccctggcctgagggacagtcccagaagaagggggtgaagaatacatgccctgaccttcccaatcacctaaatgccgaggtggcaccacagcctttgaaagagagtgctgtcctcactccccgagtccctactctcccaaagatggggagcgttggagattgggaggtgacagctgagtcccaggaagccctgggccctggcaaacatgctgagaaggagctctgtaaagaccccccaggagacgactgtgggaacagcgtgtgcctgggagttccagtttcaaaaccaagtaatacctccgagaaagagcaaggaccagagttttggggtctaagtcttataaattctgggaaaaggagcactgcagattacagcctggataatgagccagctcaggcattgacctggagggattcaagagcctgggaggaacaataccagtgggatgtggaggacatgaaggtgtcaggtgttcactggggctatgaggagaccaagactttcctggcaattttgagtgaatctcctttctctgaaaagctccggacttgtcaccagaaccgccaggtatatcgggccattgcagagcagctaagggcaaggggcttcctgcggacactggagcaatgtcgctatagggtcaaaaacctcctacggaattaccggaaagccaagagcagccacccaccaggtacctgccccttctatgaggagctggaggccctggtcagggctcggacagccatcagagccacagatggcccaggagaggccgtggcacttcccaggctcgggtatagtgacgcagagatggatgagcaggaggaagggggctgggatcctgaagaaatggcagaagactgtaacggtgctggcctggtcaatgttgagtctacccaggggcccaggattgcaggggccccagctctgttccagagtcgtattgcaggtgtgcactggggctatgaggagaccaaggccttcctggcaattctcagtgagtccccattctcggaaaagcttcgtacctgtcaccagaacagccaggtgtaccgggccattgcagagcggctgtgtgctctgggcttcctgcggacactggagcagtgtcgctacagattcaaaaacctccttcgaagctaccggaaagccaagagcagccacccaccagggacatgccctttctatgaggaactggactcgctgatgagggctcgggctgcagtcagggccatggggactgtccgagaggctgcaggtctccctaggtgtgggcagagtagtgctgagactgatgcccaggaggcctggggtgaagtggccaatgaagatgctgtcaaaccttcaaccttgtgtcctaaagccccagacatgggttttgaaatgaggcatgaggatgaagaccagatttcagagcaggacatttttgagggtttgcctggagccttatcaaaatgtcctacagaagctgtttgccaacctcttgactggggagaagacagtgaaaatgaaaatgaagatgaagggcagtggggaaatccctcacaggaacagtggcaagaaagttcttctgaagaggacttagaaaaacttattgaccatcaaggcctgtaccttgcagagaaaccctacaagtgtgacacatgcatgaagagcttcagtcggagctcccacttcattgcccatcagcgaatccacacaggtgagaagccctacaaatgccttgaatgtggaaaaaactttagtgaccgctctaacctcaatacccatcagagaatccacactggagagaagccctataaatgccttgaatgtgggaaaagctttagtgaccattctaatctcatcactcaccagagaattcacacgggggaaaagccctataaatgtggagaatgttggaaaagcttcaaccagagctcaaaccttctgaaacatcagagaatccacttgggaggaaatcctgaccagtgtagtgagcctgggggaaactttgcccaaagcccatcttttagtgctcactggaggaattctacagaagagacagctcctgaacaacctcaaagtatcagtaaggacttgaattctcctggaccacacagcacaaactcaggggagaaactttatgagtgttctgaatgtggaagaagcttctctaagagctctgccctcattagtcaccaaagaatccatacgggagagaaaccatatgaatgtgccgaatgtgggaaaagcttcagtaagagctccaccctggccaaccaccagcgcacccacactggagagaagccgtataaatgtgtggactgtgggaagtgcttcagtgagcgctccaagctcatcacacaccagagagtgcacacaggagagaagccctacaaatgccttgagtgtggaaaattcttccgtgaccgttctaacctcattactcaccagaggattcatacgggagagaagccgtataagtgcagagagtgtgggaaatgctttaaccagagctccagtcttattattcaccagagaatccacacaggggagaaaccctacaagtgcacagagtgtggcaaagacttcaacaacagttcccacttcagtgctcaccggagaacccatgcaggagggaaggcgtcgtaggggacagtttcctcaacaacaaaggaggactcaatgtatatatcttatatcataagatgtatgctagagataaactttccaatttttaagcttggtgtgtacccagggaagttatcttggtataaaccaggtaatttggaagtgaattacaaatactaaggatccagatttgaaggcacttttaagtgtaatttgtttttcttctgtaaagacccacacagaatcctgactgtccttgtatttgctatcatgtaagagctgtgtcagtatttgagccaaactggcaacttacgagattagagttaaatcagtggtcctgagcagtgattccaaactctcactgtgccttcacaccatccatgtgtaatccaccccatcagcagtggttctcctactttctcagtgggggcatatcctcaagggagaatgttgtgactctggtgagagaggagttggcctagagcaggccactgtgagctcagcacagagtaggaagaacagtgacatcattacaaaatcatcaatagcagcaatagctggtgtttattgagctgttgctctttggcaagctctgtgctaagaactttgtatacatcatctcatttaatcttcacaacggccccaggagataagtactaactttctccccatttcctagaggcttgggaaattaagtaactcgcactggtcacacatctgtaagtgggagaggcaggattcaacagatctgtctgtcttgagtctatcgtgctcttattgctatactgaattcccattcatgttaggtaacttaggggccagaatctccatgcactttgtagaccacatttcctgttatgaaatttccacattttgaattttttaaacaaatatggaaactgagaatccctaaggattaaaggacttgggatatcc

SEQ ID NO: 8061 - DNA, 2505 bp, Homo sapiens
gccgtccttacccccaggactcggccccatggagacgccgccggccgccgctggcgcatggcggggagctgtggcgcggggccttccaggagtctgagctatgagtggcccctgtggagagaagcctgtcctggaagccagccccaccatgagtctgtgggaatttgaggacagccacagccgtcagggcaccccaaggccgggtcaagagctggccgctgaggaggcctcggccctggaactgcagatgaaggtggacttcttccggaagctgggctattcatccacggagatccacagcgtcctgcagaagctgggcgtccaggcagacaccaacacggtgctgggtgagctggtgaaacacgggacagccaccgagcgggagcgccagacctcaccggacccctgccctcagctccctctagtcccgcggggtggtggcacccctaaggctcccaacctggagcctccactcccagaagaggaaaaggagggcagcgacctgagaccagtggtcatcgatgggagcaacgtggccatgagccatgggaacaaggaggtcttctcctgccggggcatcctgctggcagtgaactggtttctggagcggggccacacagacatcacagtgtttgtgccatcctggaggaaggagcagcctcggcccgacgtgcccatcacagaccagcacatcctgcgggaactggagaagaagaagatcctggtgttcacaccatcacgacgcgtgggtggcaagcgggtggtgtgctatgacgacagattcattgtgaagctggcctacgagtctgacgggatcgtggtttccaacgacacataccgtgacctccaaggcgagcggcaggagtggaagcgcttcatcgaggagcggctgctcatgtactccttcgtcaatgacaagtttatgccccctgatgacccactgggccggcacgggcccagcctggacaacttcctgcgtaagaagccactcactttggagcacaggaagcagccgtgtccctatggaaggaaatgcacctatgggatcaagtgccgattcttccacccagagcggccaagctgcccccagcgctctgtggcagatgagctccgtgccaatgctctcctctcaccccccagagccccaagcaaggacaaaaatggccggcggccttcaccttcatcccagtccagctctctgctaacagagagtgagcagtgcagcctggatgggaagaagctgggggcccaggcatccccagggtcccgccaagagggtctaacacagacctatgccccatcaggcaggagcctcgcacctagcgggggcagtggcagcagctttgggcccacagactggctcccacagacgctggactcactcccgtacgtctcccaggattgcctggactcgggcattggctccctggagagccagatgtcggaactttggggggttcgaggaggaggccctggtgagccgggcccaccccgagccccttacacgggctacagtccctatggatctgagctcccagccaccgcagccttctctgcctttggccgggccatgggtgctggccacttcagtgtccctgccgactacccacccgcgccccctgcctttccacctcgagagtactggtctgaaccatacccactgcccccacccacatcagtccttcaggagcccccagtgcagagcccaggggctggcaggagcccgtggggcagggcaggcagcctggccaaggagcaggccagcgtgtatactaagctgtgtggtgtgtttcccccgcacctggtggaggctgtgatggggcgcttcccacagctcctggacccccagcagctggctgccgagatcctctcctacaagtcccagcaccccagtgagtaagctgcctgtggctggcaagggcagcacccccagcctccaagggccgtcaggctgggctttgggccattgagcagcccattcccagccctgaggcccaccccagaggctggacagagggaggattcaagtcgggaaggaaacccacaaaccaaagatactgtaggattggttctggcccatgcagcacctctagctgtctgcctcagtgggtcagaagcgatcaccctgttgatacacattgtatctctgtagtttaaggagacgctgccggtaacggcgtcggtccgtggctgaggcccaaaccgtcttttctctcagagggtggggagggaggtgggggcagcagaggcctgggctgggtgccctgtgcacgccaccccacttccgccctacccctgggacgttggccttggctggctagttgggcaccgtgtgcctgccctccaagggcctcctctacgccaatgaggcctcatctgtgctctcgctgggcacgtggcttcatgtcagtaagcaagatgcttcttaataacccaccttctgccccactctattccttatcctgctgcccctgtaggggtcaagggccctccgtctacaccctc

SEQ ID NO: 8062 - DNA, 2682 bp, Homo sapiens
atataaaggcgccgccgtccttacccccaggactcggccccatggagacgccgccggccgccgctggcgcatggcgggtaggagctgtggcgcggggccttccaggagtctgagctatgagtggcccctgtggagagaagcctgtcctggaagccagccccaccatgagtctgtgggaatttgaggacagccacagccgtcagggcaccccaaggccgggtcaagagctggccgctgaggaggcctcggccctggaactgcagatgaaggtggacttcttccggaagctgggctattcatccacggagatccacagcgtcctgcagaagctgggcgtccaggcagacaccaacacggtgctgggtgagctggtgaaacacgggacagccaccgagcgggagcgccagacctcaccggacccctgccctcagctccctctagtcccgcggggtggtggcacccctaaggctcccaacctggagcctccactcccagaagaggaaaaggagggcagcgacctgagaccagtggtcatcgatgggagcaacgtggccatgagccatgggaacaaggaggtcttctcctgccggggcatcctgctggcagtgaactggtttctggagcggggccacacagacatcacagtgtttgtgccatcctggaggaaggagcagcctcggcccgacgtgcccatcacagaccagcacatcctgcgggaactggagaagaagaagatcctggtgttcacaccatcacgacgcgtgggtggcaagcgggtggtgtgctatgacgacagattcattgtgaagctggcctacgagtctgacgggatcgtggtttccaacgacacataccgtgacctccaaggcgagcggcaggagtggaagcgcttcatcgaggagcggctgctcatgtactccttcgtcaatgacaagtttatgccccctgatgacccactgggccggcacgggcccagcctggacaacttcctgcgtaagaagccactcactttggagcacaggaagcagccgtgtccctatggaaggaaatgcacctatgggatcaagtgccgattcttccacccagagcggccaagctgcccccagcgctctgtggcagatgagctccgtgccaatgctctcctctcaccccccagagccccaagcaaggacaaaaatggccggcggccttcaccttcatcccagtccagctctctgctaacagagagtgagcagtgcagcctggatgggaagaagctgggggcccaggcatccccagggtcccgccaagagggtctaacacagacctatgccccatcaggcaggagcctcgcacctagcgggggcagtggcagcagctttgggcccacagactggctcccacagacgctggactcactcccgtacgtctcccaggattgcctggactcgggcattggctccctggagagccagatgtcggaactttggggggttcgaggaggaggccctggtgagccgggcccaccccgagccccttacacgggctacagtccctatggatctgagctcccagccaccgcagccttctctgcctttggccgggccatgggtgctggccacttcagtgtccctgccgactacccacccgcgccccctgcctttccacctcgagagtactggtctgaaccatacccactgcccccacccacatcagtccttcaggagcccccagtgcagagcccaggggctggcaggagcccgtggggcagggcaggcagcctggccaaggagcaggccagcgtgtatactaagctgtgtggtgtgtttcccccgcacctggtggaggctgtgatggggcgcttcccacagctcctggacccccagcagctggctgccgagatcctctcctacaagtcccagcaccccagtgagtaagctgcctgtggctggcaagggcagcacccccagcctccaagggccgtcaggctgggctttgggccattgagcagcccattcccagccctgaggcccaccccagaggctggacagagggaggattcaagtcgggaaggaaacccacaaaccaaagatactgtaggattggttctggcccatgcagcacctctagctgtctgcctcagtgggtcagaagcgatcaccctgttgatacacattgtatctctgtagtttaaggagacgctgccggtaacggcgtcggtccgtggctgaggcccaaaccgtcttttctctcagagggtggggagggaggtgggggcagcagaggcctgggctgggtgccctgtgcacgccaccccacttccgccctacccctgggacgttggccttggctggctagttgggcaccgtgtgcctgccctccaagggcctcctctacgccaatgaggcctcatctgtgctctcgctgggcacgtggcttcatgtcagtaagcaagatgcttcttaataacccaccttctgccccactctattccttatcctgctgcccctgtaggggtcaagggccctccgtctacaccctcttcttctcctccatcctttattcagagtcatctcgcccttccccatgggtgggggaacctgtgtttgtttgtgtgcacatgtaaattttaaatattttaagcagaaagtccttacctcctgtaacacatcaataaagtacaatcattgtgagccctttcaa

SEQ ID NO: 8063 - DNA, 2138 bp, Homo sapiens
tgggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagagggagggaacggaaaatggagccattgatgctgttcctgttgatgaaaatcttttcactggagaggatttggatgaactagaagaagaattaaatacacttgatttagaagaatgacaccaaacacatcgctgaaaaaattaagtcagctcagcacgagttgaaattgactacattaatttctttccacctagaatcaacaggatgtttatttcctatgctgattctggaggagttaacctcctgcaaaaaaggcatcttgtccctacatcttctcttctgactttggctacatctcatagtaagttcagagtagttcatgataaattgaaaatataatggtcattgcagaaaatgattgatgttgtaactgtccacccaagtaagaagtgtatctgcctttccatcttttggttttcatttgggcatgtgctattaccagaaacaacaaacttatatttaaaatacccttcatttgacacagtttttaatgagtgatttaatttcctctgtatttgtatgtttagaagactgcctaaaacatgagcactgtacttcataaaggaaactgcgtatgcagattcagtattgtgtatctttggacaattagatggacatttaaaatggaacttcttttatctgacaggatcagctacaatgccctgtgttaaattgtttaaaagtttcccttttcttttttgccaataaagttgtaaataaagaccatcatacattaaaatccaaata

SEQ ID NO: 8064 - DNA, 1299 bp, Homo sapiens
gactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgcagatcccaagtctgtagtatgtgcattcttcaagcaaggacagtgtactaaaggagataagtgtaagttctcccatgacttgactctggagagaaaatgtgaaaagcgaagtgtttacattgatgcaagagatgaagaacttgaaaaagatactatggataattgggatgagaaaaagctggaagaagtagtgaacaagaagcacggtgaggcggaaaagaaaaaaccaaaaactcaaatagtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggttgatgattcagtgagtgtaaatgacatagatttaagcctgtacatcccaagagatgtagatgaaacaggtattactgtagccagtcttgaaagattcagcacatatacttcagataaagatgaaaacaaattaagtgaagcttctggaggtagggctgaaaatggtgaaagaagtgacttggaagaggacaacgagaggcatgtgcta

SEQ ID NO: 8065 - DNA, 1101 bp, Homo sapiens
aatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccgggggcagcaaaaaggcggagcaaaaaaagaaggagaagattatcgaagacaaaactttcggtttgaagaataagaaaggagcaaagcaacagaagtttatcaaggctgtcacacatcaagttaaatttggtcaacaaaatccacgtcaggtagcacagagtgaagctgaaaagaaattgaagaaggatgacaagaagaaagaattgcaggagctaaatgagctgttcaaacctgtagttgctgctcaaaaaataagtaaaggtgtgcaagcatttcctggaagctattgaaaacaacaagtatggctggttttgggtatgccctggagggggtgatatttgcatgtatcgtcatgcacttcctcctggatttgtgttgaaaaaagataaaaagaaagaagagaaagaagatgaaatttcattagaagatctaattgagagagagcgttctgccctaggtccaaatgttaccaaaatcactctagaatcttttcttgcctggaagaaaaggaaaagacaagaaaagattgataaacttgaacaagatatggaaagaaggaaagctgacttcaaagcagggaaagcactagtgatcagtggtcgtgaagtgtttgaatttcgtcctgaactggtcaatgatgatgatgaggaagcagatgatacccgctacacccagggaacaggtggtgatgaggtaagaggaagctttgtgcctcatctccttatgttaattgaaagaaacaatagaaaataccacaacatggttaagagccaccaacatcagagccacagtgcctgggttcaaatccttactccaaccatgggaaattaatctaggcctccaccctcatctaatatggacataatgattatctctacatcatagtttgtgagaattaatcgagttcatgaattagtagttctttatacagcttaggacagtg

SEQ ID NO: 8066 - DNA, 3291 bp, Homo sapiens
aagctttccccggtgtcggcggcaggtggaatttccacgctttatctgcgcctgcgccgcgcgggattcgcggtccgagctgaagaggttcgcggtccggtttcacttctccgaaccctgaggcagtgtgtgaagctgggacgccagccatgttccagaccgcttggcgccaggaaccagtgacctttgaggatgtggctgtgtacttcacccagaatgaatgggccagcctggactctgtgcagagggccctgtacagggaagtgatgctggagaattatgcaaatgtggcttccctggcattcccattcaccacgcctgttctggtctcccagctggagcaaggggaactgccatggggcctcgatccctgggaacctatgggcagggaggctctcagaggtatctgtccaggggatgaggccagaactgagaaggaaggattaactccaaaggatcatgtgtccaaagaaacagagtccttcagactgatggtggggggcctgccagggaatgtttcccagcaccttgactttgggagcagcctagagcagccacaaggtcattggataattaagacaaagtcaaagaggagacatttcacagatacctcagccaggcaccatgaggcctatgaggtcaagaatggagagaagtttgagaaattaggaaaaaatattagcgtcagcacacaactcactacaaatcagacaaatcctagtggtcagatatcttatgaatgtggacaatgtggcagatatttcattcaaatggcagacttccaccgacatgagaaatgtcacactggtgaaaagtcttttgaatgcaaagaatgtggaaaatacttcagatataactcattacttattcggcatcagataattcacactggaaagaaaccatttaaatgtaaagaatgtggaaaaggtttaagttcagacacagccttgattcagcatcagagaatccacactggagaaaagccctatgaatgtaaggagtgcggcaaggccttcagtagcagctctgtcttcctccagcaccagaggttccacactggggagaagctctatgaatgtaacgaatgttggaaaactttcagttgcagctcaagtttcactgtccatcagcgaatgcacactggggagaaaccttatgaatgtaaagagtgtggaaaacgattaagctccaacacagccttgactcagcatcagcgaattcacactggggagaagccctttgaatgtaaggagtgtgggaaggcattcaatcagaaaataaccctgattcagcaccagcgagttcacactggcgagaaaccttatgagtgtaaagtgtgtggtaaaaccttcagctggtgtggaagattcattctgcatcagaaactacacactcagaagacacctgtccaagcatagggctatccatagttaggcccactgtgcctctccttttttctctttattttcatgctttttatcagtgtcctcgctgtccttcctggttagacacttggctttcatcatgaactcttctttaagttttttgaacctgtttccccaacatgaagtctctttatggttagagaagaccaaaaaacaaacaaacaaacttagaaacataaaaggaaatgtaagtttccagatttaaaggacatgctgggtgcccagcaggatggattcaagggaaacctacattaaggaaaattgctgtgaattatgaaaacaccaagtttgaataagaggatcatggagaaaaaatgagaccctaaaaagtttctagagagagaaaacaaaagatcagaaatgaaagcggggccaggcgcggtggctcgtgcctgtaatcccagcactttgggaggctgaggcgggtggatcatgaggtcaggagttcgagaccagcccgcccaatatggtgaaaccccgtctctcctgaaaaaaaaaaacacaaaaattagccaggcatggtggcgcatgcctgtaatcccagctactagagaggctgaggcaggagaatcacttgaatccctgaggcagaggttgcagtgagctgagatcgcaccactgcactccagcctgggcgacagagtgagactttgtctcaaaaacagtaaaaaatgaaaatggcattagatttttcaagagcaaccttcaaagtcagatgacaatgtgtatgccttcagacttctcatggaaaatgttttcccctgcaattctatactccaaagtataagtatagaataaaggcatttcagaccctttaaatctgaaatctttatctcccatgcatcctttctcatatgtgcaacactacacaaggagtaaaccagtaaataaaaagacagatatatggattccctattgcagtccgtacgtcagaagtctcctaaattcaaaaacgggccctgtccatgtggagccaaatgcatcttggaagacattcctagtagggtgcaaacttccagagacctatctcaggttcagtgtccacccaccctacttattcttcagtttgtcttcactagacagttgtactctgtgcctttgcaaaagtcaggatgtatatactctttgagtcaggtgcaaggcaccatttgtcttaaatttattctcattgctgtttcaagtgacctcaaagcaggcagcattttcttgcaattccatctagttattttttatgatcatggaagaacctaccattattgctgttacctgtggaaatgagggaagatgtaaatgtgttaggttttagcatcccctctggcagccagcttgattttgcaggaagcagagagtagtgattaataatacagagccaggcagactttggtttgagtccaggtgtttgtccttggttaagttacaaaaactgcactagtttccttatctgtaaaatgaggatgacagttaatctacctcataggtttgtgttggggattaaatgcattatttgtagaagtgtttcaaacagtgactacatataataaaagtattacctattattggccgggcacagtggctcatgcctgtaatcccagcactttgggaggctgaggtgggcagatcacaaggtcaggagatcaagaccatcctgctaacacactgaaaccctgtctctactaaaagtacaaaaaattagctgggcgtggggtgacatgtgcctgtagtcccagctacttgggaggctgaggcaggagcccagggaggcagaggttgcagtgagccaagatcatgccactgcactccagtctgggtgacagattgagactccgtctcaaaaaaaaaaaaaaaa

SEQ ID NO: 8067 - DNA, 533 bp, Homo sapiens
tcctagagaggaggggcatggaaaacgcacttccggcggagggtctcaagctttccccggtgtcggcggcaggtggaatttccacgctttatctgcgcctgcgccgcgcgggattcgcggtccgagctgaagagtttcacttctccgaaccctgaggcagtgtgtgaagctgggacgccagccatgttccagaccgcttggcgccaggaaccagtgacctttgaggatgtggctgtgtacttcacccagaatgaatgggccagcctggactctgtgcagagggccctgtacagggaagtgatgctggagaattatgcaaatgtggcttccctggcattcccattcaccacgcctgttctggtctcccagctggagcaaggggaactgccatggggcctcgatccctgggaacctatgggcagggaggctctcagaggtatctgtccaggggatgaggccagaactgagaaggaaggattaactccaaaggatcatgtgtccaaagaaacagagtccttcagactgatggtggg

SEQ ID NO: 8068 - DNA, 1369 bp, Homo sapiens
cggagggataatcggggcggccggggctgaagggagaggcgcaggagccctggggagagtggtccctgcccttccgcgcctcgagccatcgctaccgcccttcggaaccagtgcagcggccgatcagtaaacacagagactggggatcgatcatggggctttgtaagtgccccaagagaaaggtgaccaacctgttctgcttcgaacatcgggtcaacgtctgcgagcactgcctggtagccaatcacgccaagtgcatcgtccagtcctacctgcaatggctccaagatagcgactacaaccccaattgccgcctgtgcaacatacccctggccagccgagagacgacccgccttgtctgctatgatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctagttttaatgccagcagtacccctggaccagaggaggtagacagcgcctctgctgccccagccttctacagccaggccccccggcccccagcttccccaggccggcccgagcagcacacagtgatccacatgggcaatcctgagcccttgactcacgcccctaggaaggtgtatgatacgcgggatgatgaccggacaccaggcctccatggagactgtgacgatgacaagtaccgacgtcggccggccttgggttggctggcccggctgctaaggagccgggctgggtctcggaagcggccgctgaccctgctccagcgggcggggctgctgctactcttgggactgctgggcttcctggccctccttgccctcatgtctcgcctaggccgggccgcagctgacagcgatcccaacctggacccactcatgaaccctcacatccgcgtgggcccctcctgagcccccttgcttgtggctaggccagcctaggatgtgggttctgtggaggagaggcggggtaatggggaggctgagggcacctcttcactgcccctctccctcaagcctaagacactaagaccccagacccaaagccaagtccaccagagtggctgcaggccaggcctggagtccccgtgggtcaagcatttgtcttgacttgctttcctcccgggtctccagcctccgacccctcgccccatgaaggagctggcaggtggaaataaacaacaactttattaaaa

SEQ ID NO: 8069 - DNA, 692 bp, Homo sapiens
ataatcggggcggccggggctgaagggagaggcgcaggagccctggggagagtggtccctgcccttccgcgcctcgagccatcgctaccgcccttcggaaccagtgcagcggccgatcagatcgatcatggggctttgtaagtgccccaagagaaaggtgaccaacctgttctgcttcgaacatcgggtcaacgtctgcgagcactgcctggtagccaatcacgccaagtgcatcgtccagtcctacctgcaatggctccaagatagcgactacaaccccaattgccgcctgtgcaacatacccctggccagccgagagacgacccgccttgtctgctatgatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctagttttaatgccagcagtacccctggaccagaggaggtagacagcgcctctgctgccccagccttctacagccaggccccccggcccccagctt

SEQ ID NO: 8070 - DNA, 802 bp, Homo sapiens
gggatttatgcagggggtgtttctccgcataaggagggacagtgggcaggaatctgagatcggggcgaatatgagaggtgtctgggggagttaagagtggaaactgggctggtgagagcgtagtggtggccaccagaacctgacttcctaccaactcatgcccctttcccaggatcgatcatggggctttgtaagtgccccaagagaaaggtgaccaacctgttctgcttcgaacatcgggtcaacgtctgcgagcactgcctggtagccaatcacgccaagtgcatcgtccagtcctacctgcaatggctccaagatagcgactacaaccccaattgccgcctgtgcaacatacccctggccagccgagagacgacccgccttgtctgctatgatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctagttttaatgccagcagtacccctggaccagaggaggtagacagcgcctctgctgccccagccttctacagccaggccccccggcccccagcttccccaggccggcccgagcagcacacagtgatccacatgggcaatcctgagcccttga

SEQ ID NO: 8071 - DNA, 2047 bp, Homo sapiens
gccggacgaggcccagccagtctgggtctggcctggccgcccctccagcctgctggagccggagccggagccggagccggagccggagccggagccagagccagagctcgaggactcaccggcccagtctccgtccgggatggggccccgctcccgggcgcgttgccgcccagtcccggggaccgtccctaccgcgagggtctgaggcgcggctgccccggggagggtggaaggccaggcgtggggcccgaacctctggctgactttggcagggcccatctggcacggcctccgcggcgcgcagctgttttcaagtcagcaaacatttactgaggatctactatgtacaagatgaacatctgcaacaagccctccaacaagacggcccctgagaagagtgtgtggacggcaccggcacagcccagcggaccctcccctgagctgcagggccagcgatcccgccggaatgggtggagctggccccctcacccgctccagattgtggcctggctgctgtacctcttctttgctgtgatcggctttgggatccttgttcccctcctgcctcaccactgggtgcccgctggctacgcttgcatgggcgccatctttgctggccaccttgtggtgcacctgaccgccgtctccatcgatccagcagatgccaacgtgcgggacaagagctatgcggggcccctgcccatcttcaaccgaagccagcacgcacatgtcattgaagacctgcactgcaacttgtgcaacgtggatgtgagcgctcgctccaagcactgcagcgcctgcaacaagtgcgtgtgcggtttcgaccaccactgcaagtggctcaacaactgtgtgggcgagcggaactaccggctctttctacacagtgttgcatccgctttactgggcgtcctgctcctggtgctggtggccacatatgtcttcgtggagttctttgtcaaccccatgcgtctgcgcaccaaccgacactttgaagtcctgaagaatcacacggatgtgtggttcgtgttcctgcctgccgcccccgtggagacccaggcccctgccatcctggccctggccgccctgctcatccttctgggcctcctgtccacagccctcctggggcacctgctctgcttccacatttatctcatgtggcacaagctcaccacctatgagtacatcgtgcagcaccgcccaccacaggaggccaagggggttcacagggagctcgagtcatgtcctcccaagatgcggcccattcaggagatggagttctacatgcggaccttcagacatatgcgcccagagccccctggccaggccgggccagcagcagtgaatgccaaacactctcgccctgcctccccggatccgaccccaggtaggagggactgtgctgggcctccggtccaggtggagtgggatagaaagaagcctctaccctggcgctcgcctctgcttcttttggcgatgtggggccctcaggctcccccgtgtctctgcagaaaaagaggaagaggcgcgtgtataaagtgcgaacgtctgagacctcggatccggcgtcggggcctagggcccccagccgccgctccagctcgtcgacggattccgcggacgccagccctgtgcacgccgctggccctgccggcgcctaccactcggcgtcggcagagtccgtggacgagattccagtggcgcagacgcgcctgggcagcgccgctctggccgccccgcggggccggggccgacagcccacgctggcgcggcaggcgcgtgcgcccgccgttttcgtgagcccgagcagcggcgagcccagggcgccgggcggccgggaggctggtctggcttagctgggccgagaggccggagggccgagttagagcggccggcctgactctctatgcaacaccccatccttgccgcaccgagtgcactttaggggcccctacggccggcgggatcggcctccctcccccacgactcagcaatacccgccccaccggctgtgatgctccaataaacttttttatgcttttgcgga

SEQ ID NO: 8072 - DNA, 2604 bp, Homo sapiens
gtgaacgggttgtgggacctgtcgctgtgtgggggctgtcgagcactccccagaacgtaacaaatcctcaggggaactgatgggcggtcgcgcgggcactgggtcctccacaccctggagagccgttttccgttgccactcggctctggccggggtcacattctgcagcatgtctgttcattcccctgggcggggccctgcaccgactccagcccagcccctgctccctctgcggggaacgtggccccaggcagtgctgggccattggctgtcagtgctggtcctggcggctgcattcccagtccccttggtctctgtgacagtgggcggggccggccctcccaggatctgacggcgcaggtcctccccttctgtgtcctgcagatggacacccgctccgggagccagtgttccgtcaccccagaagccatactcaataatgaaaagctggtcttgccgccccgcatctccagagtgaacggctggtcgttacccctgcactacttccaggtggtgacctgggctgtcttcgtgggcctttcctcggccaccttcgggatcttcattcccttcctgcctcacgcgtggaaatacattgcctacgtggtgaccggggggatcttctcgttccacctcgtcgtccacctgatcgcgtcctgcatcgacccggccgactccaatgtcagactcatgaagaactattctcagcccatgcccctcttcgacagatcaaaacatgcacacgtgatccagaatcagttctgccacctgtgcaaggtcaccgtgaacaagaaaaccaaacactgcatttcctgcaataagtgtgtgtccggcttcgaccaccactgcaaatggatcaacaactgcgtgggaagccggaattattggttcttcttcagcactgtggcctcggccacagctggcatgctctgcctgatcgccatcctgctgtatgtcctcgtccagtacctcgtgaaccccggggtgctccgcacggaccccaggtatgaagatgtcaagaatatgaacacgtggctgctgttcctccccctgttcccggtgcaggtgcagaccctgatagtcgtgatcatcgggatgctcgtgctcctgctggactttcttggcttggtgcacctgggccagctgctcatcttccacatctacctgaaggccaagaagatgaccacctttgagtatctcattaataaccgcaaagaagagagttcaaaacatcaagcagtgaggaaagatccatacgtgcaaatggacaaaggagttctccagcaaggagctggcgccctgggctcatctgcacagggagtcaaagccaagagctccctgctgattcacaagcacttatgtcacttctgcacttcagtaaaccaggatggggattcgacggcacgggaaggggatgaagacccgtgtccatctgcacttggagccaaggccaggaactcccggctgatttgcaggcgcctgtgtcagttctccactcgtgtacacccagacgggggctcgatggcacaggaagcagatgatgccccgagtatatctacacttgggctgcaacaagaaacaacagagcccatgaaaactgacagtgctgaaagtgaagactgagattcaggagctcaggtgcccctgtgatccaggtcttctaccctgaaaccccaccctccatcaaggtcctgcctgtagagtctaccttgcaaagcctcctgctcctacccatgctacaggccaggaaccagagcccatcatctcagaggcccctggatgtccttcgaaggaaccaggaccctcagagcccagcatccatctctgtcatcatcttcatcacacccaaagaagagccagccttgcaggagggtttacatctccaggaagatgggctgccagcaactgcagaggatgcagccacctgcttaactgtgctgtccagccagccagccagctgcagggcctcttgctgcttaagagctgatgggccgggcatgttggctcacacctgtgagcacagtactgggaaatgggagcacagtactaggaaatgggagcacagtactgggaaatgggagcacagtactgggaaatgggggctcacagcactgcaaaatgggagcacagtattgggaaatgggagcacagtactgggaagtgggagcacagtactgagaagtgggagcacagtactgagaaatgggagtacactactgagaaatgggagcacagtactgggaaatgggcatacagtactgagaaatgggagcacacagtactgggaaatgggagcacagtactgggaaatgggagcccacagtactgggaaaggggagttcacagtactcggaaatgggagcatagtactgggaaatgggagcacagtactgggaaatgggagcatagtactgggaaaccccagacctggattctgagtttttcagcctagcccagacttcttatcttagtagacaaaaagagtcaataccagagaaccagaggcatcctctgtattttaatgaactctgcattttaatctgtttagtagtcattttttaaaagataatcagttttccaaatatatctataagttactacgtg

SEQ ID NO: 8073 - DNA, 2245 bp, Homo sapiens
cagatggacacccgctccgggagccagtgttccgtcaccccagaagccatactcaataatgaaaagctggtcttgccgccccgcatctccagagtgaacggctggtcgttacccctgcactacttccaggtggtgacctgggctgtcttcgtgggcctttcctcggccaccttcgggatcttcattcccttcctgcctcacgcgtggaaatacattgcctacgtggtgaccggggggatcttctcgttccacctcgtcgtccacctgatcgcgtcctgcatcgacccggccgactccaatgtcagactcatgaagaactattctcagcccatgcccctcttcgacagatcaaaacatgcacacgtgatccagaatcagttctgccacctgtgcaaggtcaccgtgaacaagaaaaccaaacactgcatttcctgcaataagtgtgtgtccggcttcgaccaccactgcaaatggatcaacaactgcgtgggaagccggaattattggttcttcttcagcactgtggcctcggccacagctggcatgctctgcctgatcgccatcctgctgtatgtcctcgtccagtacctcgtgaaccccggggtgctccgcacggaccccaggtatgaagatgtcaagaatatgaacacgtggctgctgttcctccccctgttcccggtgcaggtgcagaccctgatagtcgtgatcatcgggatgctcgtgctcctgctggactttcttggcttggtgcacctgggccagctgctcatcttccacatctacctgaaggccaagaagatgaccacctttgagtatctcattaataaccgcaaagaagagagttcaaaacatcaagcagtgaggaaagatccatacgtgcaaatggacaaaggagttctccagcaaggagctggcgccctgggctcatctgcacagggagtcaaagccaagagctccctgctgattcacaagcacttatgtcacttctgcacttcagtaaaccaggatggggattcgacggcacgggaaggggatgaagacccgtgtccatctgcacttggagccaaggccaggaactcccggctgatttgcaggcgcctgtgtcagttctccactcgtgtacacccagacgggggctcgatggcacaggaagcagatgatgccccgagtatatctacacttgggctgcaacaagaaacaacagagcccatgaaaactgacagtgctgaaagtgaagactgagattcaggagctcaggtgcccctgtgatccaggtcttctaccctgaaaccccaccctccatcaaggtcctgcctgtagagtctaccttgcaaagcctcctgctcctacccatgctacaggccaggaaccagagcccatcatctcagaggcccctggatgtccttcgaaggaaccaggaccctcagagcccagcatccatctctgtcatcatcttcatcacacccaaagaagagccagccttgcaggagggtttacatctccaggaagatgggctgccagcaactgcagaggatgcagccacctgcttaactgtgctgtccagccagccagccagctgcagggcctcttgctgcttaagagctgatgggccgggcatgttggctcacacctgtgagcacagtactgggaaatgggagcacagtactaggaaatgggagcacagtactgggaaatgggagcacagtactgggaaatgggggctcacagcactgcaaaatgggagcacagtattgggaaatgggagcacagtactgggaagtgggagcacagtactgagaagtgggagcacagtactgagaaatgggagtacactactgagaaatgggagcacagtactgggaaatgggcatacagtactgagaaatgggagcacacagtactgggaaatgggagcacagtactgggaaatgggagcacagtactgggaaatgggagctcacagtactgggaaatgggagctcacagtactgggaaatgggagcacagtactgtgaaatgggagcacagtactgggaaatgggagcatagtactgagaaaccccagacctggattctgagtttttcagtctagcccagacttcttatcttagtagacaaaaagagtcaataccagagaaccagaggcatcctctgtattttaatgaactctgcgttttagtctgtttagtagtcatattttaaaagataatcagttttctaaatatatctataagttactacatgc

SEQ ID NO: 8074 - DNA, 1129 bp, Homo sapiens
ccgggccgaggcgatggcgccctgggcgctcctcagccctggggtcctggtgcggaccgggcacaccgtgctgacctggggaatcacgctggtgctcttcctgcacgataccgagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatggtcaggcctccggttcttccagccctggggtcagtggttgcggtccagcgggctcctgttcgccaccttcctgctgctgtccctcttctcgttggtggccagcctgctcctcgtctcgcacctctacctggtggccagcaacaccaccacctgggaattcatctcctcacaccgcatcgcctatctccgccagcgccccagcaaccccttcgaccgaggcctgacccgcaacctggcccacttcttctgtggatggccctcagggtcctgggagaccctctgggctgaggaggaggaagagggcagcagcccagctgtttagggttgctggaggccgggctaccgtcttgtgcctgaaaaccacggggcctgtccccagctggggtgagcgctcagagggcctggggccctcactcctgcccacgcctcccagaccccagaacggagcttcaagtcagacagatccctgccttggtgggcagttctgccttccaaggaagaaggggaagaaaaggacctgtgggtggctcaggcccaagcagaccccgggctccaccccagccccgcccaggctgctgccagtgcacacttttacaaatttaatataaagcaagtccagtcttaaaaagacaaa

SEQ ID NO: 8075 - DNA, 677 bp, Homo sapiens
tcttccgggtggggccccgggccgaggcgatggcgccctgggcgctcctcagccctggggtcctggtgcggaccgggcacaccgtgctgacctggggaatcacgctggtgctcttcctgcacgataccgagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatggtcaggcctccggttcttccagccctggggtcagtggttgcggtccagcgggctcctgttcgccaccttcctgctgctgtcccacttcttctgtggatggccctcagggtcctgggagaccctctgggctgaggaggaggaagagggcagcagcccagctgtttag

SEQ ID NO: 8076 - DNA, 1187 bp, Homo sapiens
ttcttccgggtggggccccgggccgaggcgatggcgccctgggcgctcctcagccctggggtcctggtgcggaccgggcacaccgtgctgacctggggaatcacgctggtgctcttcctgcacgataccggtgagccggaccccgagcgaccccggacccacccgatcccgcagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatggtcaggcctccggttcttccagccctggggtcagtggttgcggtccagcgggctcctgttcgccaccttcctgctgctgtccctcttctcgttggtggccagcctgctcctcgtctcgcacctctacctggtggccagcaacaccaccacctgggaattcatctcctcacaccgcatcgcctatctccgccagcgccccagcaaccccttcgaccgaggcctgacccgcaacctggcccacttcttctgtggatggccctcagggtcctgggagaccctctgggctgaggaggaggaagagggcagcagcccagctgtttagggttgctggaggccgggctaccgtcttgtgcctgaaaaccacggggcctgtccccagctggggtgagcgctcagagggcctggggccctcactcctgcccacgcctcccagaccccagaacggagcttcaagtcagacagatccctgccttggtgggcagttctgccttccaaggaagaaggggaagaaaaggacctgtgggtggctcaggcccaagcagaccccgggctccaccccagccccgcccaggctgctgccagtgcacacttttacaaatttaatataaagcaagtccagtcttaaaaagacaa

SEQ ID NO: 8077 - DNA, 989 bp, Homo sapiens
tcttccgggtggggccccgggccgaggcgatggcgccctgggcgctcctcagccctggggtcctggtgcggaccgggcacaccgtgctgacctggggaatcacgctggtgctcttcctgcacgataccgagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatggtcaggcctccggttcttccagccctggggtcagtggttgcggtccagcgggctcctgttcgccaccttcctgctgctgtcccacttcttctgtggatggccctcagggtcctgggagaccctctgggctgaggaggaggaagagggcagcagcccagctgtttagggttgctggaggccgggctaccgtcttgtgcctgaaaaccacggggcctgtccccagctggggtgagcgctcagagggcctggggccctcactcctgcccacgcctcccagaccccagaacggagcttcaagtcagacagatccctgccttggtgggcagttctgccttccaaggaagaaggggaagaaaaggacctgtgggtggctcaggcccaagcagaccccgggctccaccccagccccgcccaggctgctgccagtgcacacttttacaaatttaatataaagcaagtccagtcttaaaaagacaaa

SEQ ID NO: 8078 - DNA, 646 bp, Homo sapiens
gccccgggccgaggcgatggcgccctgggcgctcctcagccctggggtcctggtgcggaccgggcacaccgtgctgacctggggaatcacgctggtgctcttcctgcacgataccgataaaagtgcagatgaactgctggccacacacagccactcatggaaccaacatctccaggcctttgctcagccaggaacacacttccccacctccaactgcaccccaaccccacccactcctgttctacccggcccagcctcactgtgctctccggcctctccagagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtgg

SEQ ID NO: 8079 - DNA, 644 bp, Homo sapiens
cttccgggtggggccccgggccgaggcgatggcgccctgggcgctcctcagccctggggtcctggtgcggaccgggcacaccgtgctgacctggggaatcacgctggtgctcttcctgcacgataccgagctgcggcaatgggaggagcagggggagctgctcctgcccctcaccttcctgctcctggtgctgggctccctgctgctctacctcgctgtgtcactcatggaccctggctacgtgaatgtgcagccccagcctcaggaggagctcaaagaggagcagacagccatggttcctccagccatccctcttcggcgctgcagatactgcctggtgctgcagcccctgagggctcggcactgccgtgagtgccgccgttgcgtccgccgctacgaccaccactgcccctggatggagaactgtgtgggagagcgcaaccacccactctttgtggtctacctggcgctgcagctggtggtgcttctgtggggcctgtacctggcatgcaccaggcccctgtcccctgcaccgcaggtcaggcctccggttcttccagccctggggtcagtggttgcggtccagcgggctcctgttcgccaccttcctgctgctgtccctcttctcgttggtggccagcctg

SEQ ID NO: 8080 - DNA, 7380 bp, Homo sapiens
cgcccacccggcccggaggaggcggacccactcggagcgccgcgcgcgcgccgggctgagccttgcaaacaagtgtctgtgctgtgtccccgcggccctcctcgcgccggggccgcttcctccgggtaggagggagcaagggagccctcgccgcgcggcccgcgagccgccgccgccctcggcccgcgcatccccgcgcgggggccgcggattcgactaggctgccaggcgcagcgacaccgggtcgcggtgcgagcggcgccccggctctcgccgagaggctcctgacagaaaaacgtgcgtggttgtccccacccctgggaggggttgccggtgccgcgcgcggccgcccagtcgccagcgctctctcctgggaggatccgctgccggaggaaggagtggacccaacctggccgcgccgcagaagtggctcccgaggaagccggcgccggggccgccgcctcgtgtcccctcggggcgcagtgctcgggggtcggcgggccagagccgaggcgcggccggggagccgggggctgcggggccgagcgggcagccgcgcgagggggcgggcgctcggcgacccgggggccggccgggctgagccccgcgccccgggacgcgggctggaagcgacggaggagtgctgccgcgggctgcggaccagcgccgtcccctcacggagcggggattctgctatgacagttgggctccccggagggttaacctgggtgtcctcggcaaagttgtcgccgagccgggagcccgtgtaggggccgcggcgccgcggctcggggggcggccgggcggccggcggcggtcgtggctcggcggggcccgcgcggccggggggctcctgggggtgtgcgcccccagccggctgccctcgtggatgcctcccggcggcggcgggcccatgaaagactgcgagtacagccagatcagcacccacagctcctcccccatggagtcgccccacaagaagaagaaaatcgcggcccggaggaaatgggaggtgttcccgggaagaaacaagttcttctgtaacgggaggatcatgatggcccggcagacgggcgtcttctacctgacgctcgtcctcatcctggtcactagcggactcttcttcgccttcgactgtccgtacctggcggtgaaaatcacccctgccatccctgcagtcgctggcatcctgttcttctttgtgatggggaccctgctccgcaccagcttcagcgaccccggagtcctcccacgagccacgcctgatgaagccgccgatctggaaaggcaaatagatatcgcaaacggcaccagttcaggggggtaccgcccgcctcccagaaccaaagaagtcatcatcaatggccagaccgtgaaacttaaatactgtttcacctgcaagattttccggccccctcgcgcctcccattgcagcctttgtgataactgcgtagaacggtttgatcaccactgtccctgggtaggcaactgtgtggggaaaagaaactacagatttttttatatgtttattttatctctgtcttttctgacagtctttatatttgcattcgttatcacccacgtcattcttcgttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgaggacattaaaggatcctggtcaaataaaagaggtaaagaaaattacaatccctacagctacggaaatatctttaccaactgctgtgttgccctgtgtgggcccatctcaccaagcctgatcgacagaagagggtacatccagcccgacacgccgcagccagcagcaccctccaatggcatcaccatgtacggggccacgcagtcacagagtgacatgtgcgaccaagaccagtgcattcagagcaccaaattcgttttgcaggctgcagccacgcccctgctgcagagcgagcccagcctcaccagcgacgagctgcacctgcccgggaagcctggcctgggcacgccctgcgccagcctcacactgggcccgcccacaccgcccgcctccatgcccaacctcgccgaggccacgctcgcggacgtgatgccccggaaagatgagcacatgggccaccagttcctgacgcccgatgaggcgccctcgccccccaggctactggcggcgggcagccccctggcgcacagccgcaccatgcacgtgctgggcctggccagccaggactccctgcatgaggactctgtgcgcggcctggtgaagctcagctccgtgtgacccacatggccccaggccgggggacaccagaggctcctccatgggcagcaggagtgagcggaggggtgtgtcccacagcgactttcccagccaatgccacggtggagatgacagccccaggtctggggtacagagaccacttaggatggcacagggtggctggccccggatgctgagagcttggtttcatttgaattttcttccccaacctgagtgctttgacaacaatggaaatagagaagtggctgctttcttttggtgaccctccaggggtggaatcggagtgtgtctgcccgcccttgtgacagacacacggaaggcttctgacgcttgtggccagactgcaattgcacttatgtgttatgctactaatatttgaaacagacctgccattccatttgttaattaaaaaaaaaaaaaatcctaaagggaaaaaaccgaccaggtgtggatctgcatgccacgctgccgtctgtgttacagtggtgttgctatttccaaggaagtgctgctttctttttctttttttaattttgtgaattttcaagtgctgttttgttggaagacagtgcaacgaactgagactaatggacagtgtcatcactcagcttactgggctgaggcgtctgtggagaggtggcaccggggctgcagagggcggctggggttccgtcgtgtcgggtgtcacttcaccttctgtttggccgctcgatgaggtctcgtgttgagatattgtgtgccacaacccccacagtcttcacctccgtgtgtgatgaaacttcccgtggacagccaataaaatgacgtcctctgttattttggatctgcgtacggttatccttaatagcataaatgaaaacaaagtcatccagatggggagagtttttcttgaaatgtccctagcgaggaatggtccccagacaaccaaaagtcaaatctttgaactgggagatatttatagaataatttcttagataagaggcaagttttccatcatttattttctttaattatctctttttgacaccatcttagtggaatttgctctacgtttgcagtttgccgtgcaacagttgatcggaagtagggagaggggaggggacgctcagggagaaggttctgtcgggcgtcttctgggcttccttctgtgttaacgtgtcactcaatcccagaagtgcaacttgaggtcctagtaaaggtatcagaaaatgaggaggagaaatcggcttacagtctaagctgagatcatgtaggtcatcatccttcctagacactgatcagaatgaaattaagaaaatgaccactttgttcactttcattggtcacctagaagggaacgaactggctctggacttagggagtgtgtcactatgggggcagccacaggggacacagcaactcctctcctggcttctttccagaccataaatctaacagctaaagctactcaagttcaaagccatggccttgctccttataaccatatgaaagacaagacacattgaccaatgatacaagtaacccaagtgatttgcatttatggaaaaaggctattactcctgagaaagagttgccattttatataaaagaaaagaagataggaaaaagaaaagcacacaagttttatttggaatgaaggcaattcacaggtcacaaaataattcatgctgaaagggcctgcagagttcttgcactgtgatgtcttcgagccatctttattgtcatgctgcatgcacgtatagaaaatggaataggtccattctatgtagccatttttgattttctgaaccacctaactacttgtacccacctgcaatgtgtaattcatggggcagtgccctccttacacaaccgcacacgctcacaggcaccaactcacagggattctccttgtccacgctacctgtgagcccaaagtgacagccccacaaaggagcttccacaacttcccaaaccgtctctgctccttgctttcttccacctgctccccagaggccccaggaaggagttggccctgatgagaacggtgctccatgggtgaccgcgaatccggcttagccctcactccggtcccacgtgtggcccagtccattctcagctcattcccctggaaagcaagatcatggtcttcagaggcctcccgcttctaacatttcctaactcagtggttgccactctcctgtgaccagcccttcttcccacctcactgtgaaaaattcccagaagccaggatcacgactcacttgtcttcacataatggatatttacttaatatttattatcaatttccccacctccaaccctgtccctggcacacacttggcatcatttatccaataggggactgggaattttggtgaagtgaatcaaggctattcagggtcaagagagagattaacttgaatgggccaatttgctagataattaatgtcttaaaaaccaaaaccagagagaagcccacagccctgtcctctgtggcttgaaaaagaaacccagcatcagaggaatgagcgatgatgccccctggggcgcccacttctgtttgtcaggagggatggtcggaggggcagctcacctggcgaggtgatggctctgcatttcccacgaacatatatgtgacatgtacataaatataaatacttatgtttataaatgttgaatggttccttctagctgtggctgagtagacgttggtgtttctaacttctttcagtgtgttagagattgattacatgctagctataaaaagtaaaataaatattttaccatgctattaaagcttggaccattatcaaacacacacaaacacacactcattctgctgtttaaaaattcatctgcgttcgttctcccaggagtgctccagggaaccacaggcttcccggcacttgaaggctgaactgagcgtgagtgccctggtccccaggaagcaggcggatgctgcaggaaggtggcagacagcctgcatccaggagggccccaggaagtggggatgctgcaggaaggcggcacaaagcctgcatccgggagggccccaggaagcagggggatgctgcaggaaggtggcagacagactgcatccaggagggcacagtgacctgtcactccgttctgcagaaattggcccagcagttgcgttatgcccaaccaaaagatgctcgttccagctttcaaatgtgatgatttcagcctgtgaggacaatgccatgtccccaccctaagccagcaaaatgcgaaatctctgttctggcccagaatggcacaagggaggagtctttgcagagttccacgccaccccccagcttactgcggccttcaccggctctgtctaggattgccagctgtggttccaagtgaggagcaaacccattttatgagccatgttcctgcggagacctgatgggccaggccttctgtggctttgaaaacccctaagctcttcacctcctgggcctaggccttcttgtctgactcaacagcaagaaaaatgaacttgccaaaattggcagtaggtgtccttgacacaggggcttctgatggcatcgcccagaaaatgctggaaccagaactggtcagagactttgaagggcacagcctggcgggctactccccaagggtctcaggtctctgcccacctgactaccctgcagcaaacgcttctctgtaacctgacttctcccttcagacctcagcctacaaccatcctcttcatgccaggaaccaactgcttctcagcctcggcttagggtcttaagttcaccagaagggatcggggtttgcgttgatattataaggaatcttcccagaaggagctgcccttcatccatccacaagaatacattgagttcatttagttcttgaccaggtaagaaaagaataaaggagaacaaatattaaatactcttttctaattgatgccttactactgttttgaagctgagccgaaatcaaattgatgtttacattttctatcaagtacacatgagctgtgggagtctagcatattcttgtccaaaagagagagactttcaaatgaattcctattcctcttggtcccctccacctattttggaggtctgcatgtggagttgtatgctattttccaaggtacctcatttaaaaaaaaaaaaaaaaaaaaactgcctctcatttgttcccttaaaacgtctctctctctcataaaactaagttatcattgaaatattaaacgatctgaagcgtctttttttttttcaaataaatgtcaaagatggtaatagtttgtaaatcagtaaatcctctgtccatctgcccattgtccatggtcctgataatagagccaagatggattttcacatgtaaggtgttagtccattaatccagccattaaaagtagttgggagattgaagattagatggtttctggagcaaccgaatttgcagctgccacaaaactagataaatagccacaactggagttattttttgatctcataaaccccaggaattacacacagaatggattgaaaagcagacaagcatcttgtgctattgcagagacttttctacccaggaagtgttgaatttttaaaagaaacttgatattggtgataaaggtatgaatgaacaactctcttacttgccctcgatgtttcaagatgcctggtgaaaccgagaggccacatggcatgtccaaggagacatgctttctgggttctatatgaatagagatggttttagcctgcaattaaaaaaaaaaaaaaaaacggttgaagccttgctaactttttcccagagcattctgggttgatatttcacagtcaaacgttttggcatggaaaaaaaaaaaagcattttaaactcttagtgaattcaaagctctaaatccaaacaatggtgaacacatgtacataacatttcatgttttcagagatacgtatgcttatttaagtgcctttcatgttttaatcaatgtttgcagaatttatcttaaacctgagatgaattaaaaaatttttctccttcaataaaaactgctaatggca

SEQ ID NO: 8081 - DNA, 3134 bp, Homo sapiens
cgcccacccggcccggaggaggcggacccactcggagcgccgcgcgcgcgccgggctgagccttgcaaacaagtgtctgtgctgtgtccccgcggccctcctcgcgccggggccgcttcctccgggtaggagggagcaagggagccctcgccgcgcggcccgcgagccgccgccgccctcggcccgcgcatccccgcgcgggggccgcggattcgactaggctgccaggcgcagcgacaccgggtcgcggtgcgagcggcgccccggctctcgccgagaggctcctgacagaaaaacgtgcgtggttgtccccacccctgggaggggttgccggtgccgcgcgcggccgcccagtcgccagcgctctctcctgggaggatccgctgccggaggaaggagtggacccaacctggccgcgccgcagaagtggctcccgaggaagccggcgccggggccgccgcctcgtgtcccctcggggcgcagtgctcgggggtcggcgggccagagccgaggcgcggccggggagccgggggctgcggggccgagcgggcagccgcgcgagggggcgggcgctcggcgacccgggggccggccgggctgagccccgcgccccgggacgcgggctggaagcgacggaggagtgctgccgcgggctgcggaccagcgccgtcccctcacggagcggggattctgctatgacagttgggctccccggagggttaacctgggtgtcctcggcaaagttgtcgccgagccgggagcccgtgtaggggccgcggcgccgcggctcggggggcggccgggcggccggcggcggtcgtggctcggcggggcccgcgcggccggggggctcctgggggtgtgcgcccccagccggctgccctcgtggatgcctcccggcggcggcgggcccatgaaagactgcgagtacagccagatcagcacccacagctcctcccccatggagtcgccccacaagaagaagaaaatcgcggcccggaggaaatgggaggtgttcccgggaagaaacaagttcttctgtaacgggaggatcatgatggcccggcagacgggcgtcttctacctgacgctcgtcctcatcctggtcactagcggactcttcttcgccttcgactgtccgtacctggcggtgaaaatcacccctgccatccctgcagtcgctggcatcctgttcttctttgtgatggggaccctgctccgcaccagcttcagcgaccccggagtcctcccacgagccacgcctgatgaagccgccgatctggaaaggcaaatagatatcgcaaacggcaccagttcaggggggtaccgcccgcctcccagaaccaaagaagtcatcatcaatggccagaccgtgaaacttaaatactgtttcacctgcaagattttccggccccctcgcgcctcccattgcagcctttgtgataactgcgtagaacggtttgatcaccactgtccctgggtaggcaactgtgtggggaaaagaaactacagatttttttatatgtttattttatctctgtcttttctgacagtctttatatttgcattcgttatcacccacgtcattcttcgttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgaggacattaaaggatcctggtcaaataaaagaggtaaagaaaattacaatccctacagctacggaaatatctttaccaactgctgtgttgccctgtgtgggcccatctcaccaagcctgatcgacagaagagggtacatccagcccgacacgccgcagccagcagcaccctccaatggcatcaccatgtacggggccacgcagtcacagagtgacatggctgcagccacgcccctgctgcagagcgagcccagcctcaccagcgacgagctgcacctgcccgggaagcctggcctgggcacgccctgcgccagcctcacactgggcccgcccacaccgcccgcctccatgcccaacctcgccgaggccacgctcgcggacgtgatgccccggaaagatgagcacatgggccaccagttcctgacgcccgatgaggcgccctcgccccccaggctactggcggcgggcagccccctggcgcacagccgcaccatgcacgtgctgggcctggccagccaggactccctgcatgaggactctgtgcgcggcctggtgaagctcagctccgtgtgacccacatggccccaggccgggggacaccagaggctcctccatgggcagcaggagtgagcggaggggtgtgtcccacagcgactttcccagccaatgccacggtggagatgacagccccaggtctggggtacagagaccacttaggatggcacagggtggctggccccggatgctgagagcttggtttcatttgaattttcttccccaacctgagtgctttgacaacaatggaaatagagaagtggctgctttcttttggtgaccctccaggggtggaatcggagtgtgtctgcccgcccttgtgacagacacacggaaggcttctgacgcttgtggccagactgcaattgcacttatgtgttatgctactaatatttgaaacagacctgccattccatttgttaattaaaaaaaaaaaaaatcctaaagggaaaaaaccgaccaggtgtggatctgcatgccacgctgccgtctgtgttacagtggtgttgctatttccaaggaagtgctgctttctttttctttttttaattttgtgaattttcaagtgctgttttgttggaagacagtgcaacgaactgagactaatggacagtgtcatcactcagcttactgggctgaggcgtctgtggagaggtggcaccggggctgcagagggcggctggggttccgtcgtgtcgggtgtcacttcaccttctgtttggccgctcgatgaggtctcgtgttgagatattgtgtgccacaacccccacagtcttcacctccgtgtgtgatgaaacttcccgtggacagccaataaaatgacgtcctctgttattttgga

SEQ ID NO: 8082 - DNA, 2301 bp, Homo sapiens
gaagtggctcccgaggaagccggcggcggcgggcccatgaaagactgcgagtacagccagatcagcacccacagctcctcccccatggagtcgccccacaagaagaagaaaatcgcggcccggaggaaatgggaggtgttcccgggaagaaacaagttcttctgtaacgggaggatcatgatggcccggcagacgggcgtcttctacctgacgctcgtcctcatcctggtcactagcggactcttcttcgccttcgactgtccgtacctggcggtgaaaatcacccctgccatccctgcagtcgctggcatcctgttcttctttgtgatggggaccctgctccgcaccagcttcagcgaccccggagtcctcccacgagccacgcctgatgaagccgccgatctggaaaggcaaatagatatcgcaaacggcaccagttcaggggggtaccgcccgcctcccagaaccaaagaagtcatcatcaatggccagaccgtgaaacttaaatactgtttcacctgcaagattttccggccccctcgcgcctcccattgcagcctttgtgataactgcgtagaacggtttgatcaccactgtccctgggtaggcaactgtgtggggaaaagaaactacagatttttttatatgtttattttatctctgtcttttctgacagtctttatatttgcattcgttatcacccacgtcattcttcgttcacagcaaacaggattcctaaatgcccttaaggacagtcctgcaagcgtcctggaggctgtggtgtgcttcttctctgtctggtccatcgttggcctctcaggattccacacctacttgatcagctccaaccagacaacaaatgaggacattaaaggatcctggtcaaataaaagaggtaaagaaaattacaatccctacagctacggaaatatctttaccaactgctgtgttgccctgtgtgggcccatctcaccaagcctgatcgacagaagagggtacatccagcccgacacgccgcagccagcagcaccctccaatggcatcaccatgtacggggccacgcagtcacagagtgacatgtgcgaccaagaccagtgcattcagagcaccaaattcgttttgcaggctgcagccacgcccctgctgcagagcgagcccagcctcaccagcgacgagctgcacctgcccgggaagcctggcctgggcacgccctgcgccagcctcacactgggcccgcccacaccgcccgcctccatgcccaacctcgccgaggccacgctcgcggacgtgatgccccggaaagatgagcacatgggccaccagttcctgacgcccgatgaggcgccctcgccccccaggctactggcggcgggcagccccctggcgcacagccgcaccatgcacgtgctgggcctggccagccaggactccctgcatgaggactctgtgcgcggcctggtgaagctcagctccgtgtgacccacatggccccaggccgggggacaccagaggctcctccatgggcagcaggagtgagcggaggggtgtgtcccacagcgactttcccagccaatgccacggtggagatgacagccccaggtctggggtacagagaccacttaggatggcacagggtggctggccccggatgctgagagcttggtttcatttgaattttcttccccaacctgagtgctttgacaacaatggaaatagagaagtggctgctttcttttggtgaccctccaggggtggaatcggagtgtgtctgcccgcccttgtgacagacacacggaaggcttctgacgcttgtggccagactgcaattgcacttatgtgttatgctactaatatttgaaacagacctgccattccatttgttaattaaaaaaaaaaaaaatcctaaagggaaaaaaccgaccaggtgtggatctgcatgccacgctgccgtctgtgttacagtggtgttgctatttccaaggaagtgctgctttctttttctttttttaattttgtgaattttcaagtgctgttttgttggaagacagtgcaacgaactgagactaatggacagtgtcatcactcagcttactgggctgaggcgtctgtggagaggtggcaccggggctgcagagggcggctggggttccgtcgtgtcgggtgtcacttcaccttctgtttggccgctcgatgaggtctcgtgttgagatattgtgtgccacaacccccacagtcttcacctccgtgtgtgatgaaacttcccgtggacagccaataaaatgacgtcctctgttattttgg

SEQ ID NO: 8083 - DNA, 1519 bp, Homo sapiens
gctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtgggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 8084 - DNA, 1718 bp, Homo sapiens
ccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaa

SEQ ID NO: 8085 - DNA, 1647 bp, Homo sapiens
gggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacagctatggaagttgggaccttttccgggaggcttatgctgccattgagaaaatgaaacagctcgacaagaacaaactacaggcggttgccaaccagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaa

SEQ ID NO: 8086 - DNA, 1873 bp, Homo sapiens
gggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcagaatgataacagcagacacttatttagtgttaccacattggcaggagtgtccttgctggtatttgtaggacagatagacatctggccaggctttccacttctgcatccctccaggtcattcattcaacaaatatttattgagtacttccatgagccgggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaa

SEQ ID NO: 8087 - DNA, 1280 bp, Homo sapiens
cgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgccacatacttcctccagccctctctaaactacccaccagtcttcgcccctcttttcttagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttag

SEQ ID NO: 8088 - DNA, 1798 bp, Homo sapiens
cgcgtgtggttgaggatgggctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagaaaatgaaacagctcgacaagaacaaactacaggcggttgccaaccagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaa

SEQ ID NO: 8089 - DNA, 1959 bp, Homo sapiens
ctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggtcttttgtggggatgagccagggtgcaaggagagtacaatactccagttaccgaattgaaaccatccctgcagtggagcagcctcctccagtttctgttgggttttgagctacctgttaaataagtcagtgggattgtcaaggacaaagccctccctggctgcctcagggcaaaatcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagaaaatgaaacagctcgacaagaacaaactacaggcggttgccaaccagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaag

SEQ ID NO: 8090 - DNA, 989 bp, Homo sapiens
tggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggtcttttgtggggatgagccagggtgcaaggagagtacaatactccagttaccgaattgaaaccatccctgcagtggagcagcctcctccagtttctgttgggttttgagctacctgttaaataagtcagtgggattgtcaaggacaaagccctccctggctgcctcagggcaaaatcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactg

SEQ ID NO: 8091 - DNA, 1325 bp, Homo sapiens
ccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagaaaatgaaacagctcgacaagaacaaactacaggcggttgccaaccagacttatcaccagaccccaccacccaccttctcctttcgagaaaggatgactcacaagagtcttgtctacctctggttcctgtgcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcact

SEQ ID NO: 8092 - DNA, 1362 bp, Homo sapiens
ggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggc

SEQ ID NO: 8093 - DNA, 888 bp, Homo sapiens
tgcaaggagagtacaatactccagttaccgaattgaaaccatccctgcagtggagcagcctcctccagtttctgttgggttttgagctacctgttaaataagtcagtgggattgtcaaggacaaagccctccctggctgcctcagggcaaaatcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtgggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagaaaatgaaacagctcgacaagaacaaactacaggcggttgccaaccagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggaga

SEQ ID NO: 8094 - DNA, 3135 bp, Homo sapiens
gcgcgcgccgccgctgccacctccgctgctcggcccggtcccggagtggcccggccggcccgcggggcgcggagccgaggcccgcggctggctgcatgaaggactgcgagtaccagcagatcagccccggggccgccccgctgcccgcctccccgggggcgcgccgtcccggccccgccgcgtccccgactccgggccccgggcccgcgccgcccgccgcccccgccccgccgcgctggagcagcagcggcagcggcagcggcagcgggagcgggagcctcggccgccgcccacggcgcaagtgggaggtgttcccgggtcgcaatcgcttctactgcggcggccgcctcatgctggccggccacggcggcgtcttcgcgctcacgctgctgctcatcctcaccaccaccggcctcttcttcgtctttgactgtccctacctggctcgcaagctgacccttgccatccccatcatcgctgccatcctcttcttcttcgtcatgagctgcctgctgcagacaagcttcaccgaccctgggatcctgccccgggccactgtctgtgaagcagccgccctggagaaacagatcgacaacacaggcagttctacataccggccaccccctcggacccgggaggtgctgatcaacgggcagatggtgaagctgaagtactgcttcacctgcaagatgttccggccaccccgaacctcacactgcagtgtctgcgacaactgtgtggaacgatttgaccatcactgcccctgggtgggcaactgtgtggggagacggaactatcgcttcttctacgcgtttattctctccctctcattcctgacggccttcatcttcgcctgtgtggtcacccacctgacgttgcgcgctcagggaagcaacttcctctccactctgaaggagacaccagcaagcgtgctggagttggtgatctgcttcttctccatctggtccattctgggcctctcagggtttcacacgtacctcgtcgcctccaacctgactactaatgaagacatcaaaggctcgtggtccagcaagaggggcggtgaggcctctgtcaacccctacagccataaaagtattatcaccaactgctgtgctgtgctctgtggccccctacctcccagcctaattgaccggaggggatttgtgcagtccgacaccgtgttgccctcacccatcagaagcgatgagccagcctgcagagccaagcctgatgccagcatggtaggaggccacccctgaccacggctcagtacttgccacctgctggcctgtctgaccctccgcactcacctgccgggaccctccctattccatccaagggaagcagaactgccaaagactcaagtcttttcatatttatttcccatcctgcgtggctttccctgaactgttccgtggctgtgccctctgctccccaaacccaggttcccacagccttgggccctaggtaccccagctgatcagtgccaggagagaccagagcctctggaggctacccaggggaccacaccaagtccttgcctgtgccgggcgagccctgtgtgagtgaggctgtgaactgagcgtgaggcctcccaggtgggggaactgcttgggccttgctgagccagggtcctcagggtgaagcaggactgaggagtggccagctctggatagctggctgtggagaggaagcctccatgggctgctttggtctgtgggctccttcattcccttggtgataatttccctttattctgtgggatttttggtggggttttccccccttttttatggagttggccaataggattgagttggggctccagtagagaaggcagggttggtggtgggtgggggcagcctgtatcagacaaaggtaaatcagccagccaggcacccacagcctcagctcctgtgcagttcctgggcagcacagtggaagtgggagcctggtccttcccctgcccatggagagctctttaagggatcccagcctgcccctccacttctctcccaagccaggtcccggcatgggtgggttatgctcatgctggcaatacttgaaacgggtttattaatgctgggtattttgcacaattttatagacctcttttctacatagtcttttttaaatggaaggagaaaatgtcagccacattactgtctgtgtagtgccaggtgaagggttatcagaaggctggttggttttaataagtttattccaagagaccttctggctggaatgagtgagagtgtgtgtgcatgtgtgtgtgtgttcatgtgtgccctgtatgaatgtggctggctcccatatcccctgggctgccccctgccccatcccctttgagtgtcagaagcactctgagccaaggggacagggggcacgtgcactggtcacgagaaaaccctgggctcccactggggctcagcccagcctcctatctttccttcttctatggacttcagacagccagtgtctggggactctgccactctacccccagccctacccaccagcccccaggtgaggcttccagctgggacctgcccagacaggctgagcctgggcgtggtgggtggggtgatggctctggggagcggctgccatcctacaagccacaccccctcctctgagctctgaatatgggacccagtgccaggagctggaagacaaggtgtttctgccaaacggggacctccatccagagaaaaggaagaaggtgcagggtgggccaagaggcaagtgaaggttggcctgagtctgggccggaaactcagaggatgtttctcctctgctgggagctgtagtttcttatcaaaatagatattgttccaccatccccctccttggcccttcaagtgggctgaagcccttggaaagtgacataggaagtccccagatcttgcccttctcactccagaggctagtggtcacagacagctgggaatggcagccacagagggtcccctctgggagaaacagcttcaccccagcctcagggccctgggccatcactgcagtggccctgggaggtgaggaagaagctggctagaggagggggctcccacctaccttttatttaagccagtattctttgttcctgcttgtaataaaacttcagtttataag

SEQ ID NO: 8095 - DNA, 1306 bp, Homo sapiens
ggccatggagctctggaagctgggctgggggaggaagcctggtggctctgacctcccctggaggcgaaggaggcccagccatgacactcttaacggatgccacgccgctggtgaaggagccccatcccctgcctctggtcccacgtccctggttcctccctagcctctttgctgccttcaatgtggtgctgctggtctttttcagtggcctcttcttcgcattcccttgcaggtggctggctcagaacggggagtgggcctttcctgttatcacaggctccctctttgtccttaccttcttcagtcttgtttcactcaacttctcagaccctggcatcttacatcaaggctccgctgagcagggccccttgacggtgcacgtggtgtgggtgaaccacggggccttccgcctgcaatggtgtccaaagtgctgcttccaccgcccgccccggacttaccactgcccctggtgcaacatctgtgtggaggactttgaccaccactgcaagtgggtcaataactgcatcggtcaccgcaacttccgcttcttcatgctgcttgtcctgtccctgtgcctctactcgggcgccatgctggtcacctgtctcatcttcctggtgcgcacaacccacctgcccttctccaccgacaaggccatcgccatcgtggtggccgtgtccgccgcgggcctcctggtgccgctgtccctcctgctgctgatccaggcactgtccgtgagctcggccgaccgcacctacaagggcaagtgcagacaccttcagggatacaaccccttcgaccagggctgtgccagcaactggtatttaacaatttgtgcaccactgggacccaagtacatggctgaagctgtccagctgcagagagtggtggggcctgactggacatccatgccgaatctgcaccctccaatgtccccctctgctctcaaccccccagccccaacctctgggtccctacaaagcagggaagggacccccggggcgtggtgaggctgcagctctccaggagttccacacgggcccagtgctgcccctgctgctgcaggagcccccaggcgaggttcggccttcctctcgcccctgtgcacccggagatgcccacagcaccagcacctgagctcacctccgaacccgcctcctgaacccgcctcctgaacctgcctccttacctcccacttcctgagccctgagtggaagcctttctgtgccttgccctttgcccactcccctggtgggactgccaagaccctcaatgcccattaaatactcttgcctgcctcttacaa

SEQ ID NO: 8096 - DNA, 6377 bp, Homo sapiens
cgcaagttgaagcgcgagggttccacgcgggctgcggggacgcgggcctcggtgctgcagactttctcagggcgcctgggtcgcggcaggcgcggagtcccgagcgcagcagctgctccgccggcctcgcctccgacccccgccctgcgccaagcgcggaagcgctcgcgacctaactgccccgggtgccgggcgcctagggaggggccgccaccgcccgctccgccccgggggcctgcgcccagcagcccccgcctccccggaatccagaggccgagccggaggcggcggggccacggtgggagcccgcgaggtggcccgagcgagggccccgcatccccgcagagcccgcccgagggcgcagcctgccacgccaggggaggcggccgggcggcggggaacggcgggggcggagcgcagcctcccgacgccgccgcctcaccgcccccctccgcctcctcggcctccgctcgcagccgccgcctccgcctccgccgggctgaggagccgggagtccgccgcgccggctcggggctgcgggatggggagttagcgccacggcggcggcagtggccgcagcgcaccccgccgccgcccaggagcccgtccagccaggggtgccgggcccgcccagcccgccccggagccaggcccgcgggcggcggcggagctgggcaggtggatgcggctggaagatggcgccctcgggcccgggcagcagcgccaggcggcggtgccggcgggtgctgtactggatcccggtggtgttcatcaccctcctgctcggctggtcctactacgcctacgccatccagctgtgcatagtgtccatggaaaacactggcgaacaagttgtgtgcctgatggcctatcatctactttttgcaatgtttgtctggtcatactggaaaactatctttacattaccaatgaatccttcaaaagaattccatctctcttatgcagagaaagatttgttggagagagagccaagaggagaagcccatcaggaagttcttaggcgagcagccaaggatcttcccatctataccaggaccatgtctggagccatccgatactgtgacagatgccaacttataaaaccagatcgctgccatcactgctccgtctgtgataaatgtattttgaagatggatcatcattgtccatgggtgaacaattgtgttggattttcaaattataagttctttctccttttcttggcttattctctgctctactgcctttttattgcggcaacagatttacagtattttatcaaattttggacaaatggcctacctgatactcaagccaagttccatattatgtttttattctttgctgcagctatgttttctgtcagcttgtcttctctgtttggctatcattgttggctagtcagcaaaaataaatctacattagaggcattcagaagtccagtatttcgacatggaacagataagaatggattcagcttgggtttcagtaaaaacatgcgacaagtttttggtgatgagaagaagtactggttgctacccattttttcaagtctaggtgatggctgctcctttccaacttgccttgttaaccaggatcctgaacaagcatctactcctgcagggctgaattccacagctaaaaatctcgaaaaccatcagtttcctgcaaagccattgagagagtcccagagccaccttcttactgattctcagtcttggacggagagcagcataaacccaggaaaatgcaaagctggtatgagcaatcctgcattaaccatggaaaatgagacttaactcttcaagcaagataaattcatactttataaaagtatcaatgctgtagatggatggaagaggcttcccacaggaaggtgccaccagtcagttgtgcctatgtccctttggctggaaatgcagaatatgaattgattagttctctccaagccattgcttaaaatataacatgttttggatccaatacacacattgttacaactaacacaaattcctattaaatattaaaagtagttctggtttattaatcaacggggaaaacatcttctccaaaaaacttggaataaatccaaggaccagtttttacccaaatatatgggtagcacagtttatcacatagaaactccattaatcatctgattttccgaatctgaaaattgagactattaagatattaggatttcagagatttcaagtcacattataatgataagcattattcataaaacttgttacctttaagaaggtggaagtggcaaaccatacttcttttttttcctctgatgtgaatccagcctcagactgagtgaactgtaataattatgaattcattacagagtccaggtggcctgcagttgaagatcatcaaccatttttgcctcacttaattccagccttttgttttctgctggaaaataagtgtggacattgaagcttgagctctcaaagcagttggctggaatacttttgtcagaatacggtacatttctattacatcagaaatatattttcatctcttcttgttaaattgggaggaaatttatgatagcaattatgaagattgttttatgacattcttttgtcagtttggctttctaaaaatctctttttagattatttctcctgttgaacatagtaaaactattgaatttctcttaagaattcctaataggtcaatagatttaccctccagtgatatctatattatttctttctcgtctcatcaaaatgatgacaggtaaactatatttttccttaaacacctattacagttaaattatgcaaatcattaaataaaaatcatacaacttttggaaagttagttcaacatgaactaaaatggcatgctatttggaaatttagtttgagataaactaaagtgtgttgatgccagaatgttcagcttcagtaaatataataagctcttgtgccttgtatgcactatttaaaaaaagttttttttatttgagtccagtataattcatgtaaatgttaacaattagaataatactctgtatgcttttttgatactgattttgagaatttaaagcagattaccttttaaaactggaccaactaagtaattggtatttaatcaaagagaaaatggtaataaacttttcaaaatctttgttaaaccaaacattcaacacaaaataaactagaaggccagaggataatggaataaaagatcattgcaattacttatccttcctaaaaatatagttttatattaattgtgcttatggaagaaacaatgtcagccaagtccattttatagtttgagtgcaattctttgaacaatagaaatatctgcagtctttcacagatttgtattatgctgaagagtttcatctgacaatctgcttcaagaaatctcagaaaatatgataacattttaactttcattttagagcacgttttggtcatttttaaaaatacctaaagtgccagaccggaacctatagctactgctagaagtcttaaaaaaaccaacagcagcacaggatgtattaagaattatatgaagtcaggtttgtttttttttttttttttttttcaaagcacagtactgttagctgtttttgtggacaggattcgattaagtattccctcttgtcaaactggaagctaggggaaaaagagggatttttatcctttactcttctagagtactgttaatgcccctttcccacagtcttttatataattaaatatatgtcaatacacattagaatcagatttgaaaaagttaaaacaatttcattgttgtaattgttccctttctgttttcatatagtgaataacctttaaagggttgttttgttttgttttgaattataggagttataatctttggagatgattgcatatctcattagatatgcaatataaatttatctgagtgaacaaagtgctaaataaatagatctacattttgtacatatttatataaaatttacctttaagtatttactttaaaaaatttaatggcttaactcgaacttgaagacacatacttcaactgtccttattgtccattaaactgataattttgatttttcttgcttttatagattttactatataggaatcaagatttaagaaattttgcattaaaaatagtgtaccaatgcttcatatacgttagttatttgctattatgtagggaagaggattgttatttcaaagatatattaaagaacagttgcatctgaatataatcatgatgcattcaatgaagttcatatccatgaattcactcctaatataccctaataaagtggttgatcacctacattatctgtctataagaaactgcctttgcactgacaatgtaaattattttaagcataaattttcctaatagtttattagagctactaatggcaaaattcatgtcttcaatgtggccataacataggtcttgggaggggtggtgagaaaataaggtatttactttgtagtagttaagtgattctgaggacaattagaaacagactataaaactcaactacactgtaatcaatagacaactattggaaatatggcatatgttgacaaacacttaactagggaaatcaaagatataaatcatgtttataaaaaattaggcacgcaatcatgtgattcatgcttcaagaaaatatatgaaaaaagtgttactccattatgttataaactagcagattttccctattttgaaatgcatgtaaacgggctcggctgattctgaaattgtactgtatcatttggtatttacttatatggtcaaatacttgtttgtaaaagtgatggttctgatacctttgatcaaacatagatacaaacctcagaaaatggtaaatgcaaagcagtttacgttgtaaatcatgatggtgtcctccagcacaaccatcccacccacacacctagactacagattctgatctgtgaatattttcaccaaagtgacatttaaacaagtggatttttcacaaataacacgtgtttaatatctttctgcagaaacgtgttcttctaaagcagaaaaccacgtggcttaatcccaaatgttttacacttcttttccacatacttagccagttcagcaccgatttcctcttatatgtggaaggagactatgttacatacctgaagtattactcttttacaaagataccattagaattttctcactgtcttggtaaaaattcctagattctactttttattgcaagtgttagcaatatgatcttgtaacgccatgaaaagcattaagtagaagccaacattaacctagattttacaactgagcaatctgttccccaccagatttcctttagaatttattaccaaaggatcttattttgttacagaacacaggaaattgttaaaccttataatgttgcaaaccatgcattttccttttctcttttccataagatttttttattgtagtagtgccctggcttgtaaacagtggacatcactgaaaggatgaaatcaagtaggcttgtttcaaagagactcctgtgaatcaactatgaatatgaagtatctcccagaacaatgttgagtgtttcaggagactctgaaacagggcacccattttttttttccttcctcaaaatagtctccttgaaatgtgagcaaagaactatgatgatgcagtccaggtatctaatagctcaatcaccaacaccgctgagaattgttcttataccagcaaaaagttcaaatacaataacctgggcaatgccaacagaagacacttttaatcatttgcagacctttcttgttgcaggaaagtgagggcaaaaacaaactggtgaaaaatgttcaaaaatagatctttttgatgttcatagccagtattcagtatttctgtattgtttacaattgggggaaaatgtctgttaaggctaatcatctgagtgatttgagtagcaattaaaccaaagggaaacttttaataagttattttaagccctggtttatggctagttcccttttgctcaggaaaaatagtactactttatggtttatgaaaacctatgatttatgttgcatcttccggggaaggtttaacagtacaaggagctgaatcctacctgaaattattaatgcttaatatattgcttctgtttgattgataaaggtgcttaatcaattgaaaaaaaaacgcataatgcttcaaggtaaaattccgttgattctgaatttaaaaagatactacagaatgcgtcagttctcctgttgtatttttctcagttatgagagcaaggctattttgtcagtttagattttgtgtctttttctgtcagtatgtatggctccctaattgaaaacatcttaaatgaactaatcaaacactta

SEQ ID NO: 8097 - DNA, 1508 bp, Homo sapiens
gggagctggaccagcagccgcctggagcgtccgagtcaccgtcgccggggctcccgcgctccccagaacggtgggacgcggggctcggcagccgccagcggaacatggcgccctggacgctgtggcgctgctgccagcgcgtcgtgggctgggtgccggtgctcttcatcaccttcgtggtcgtctggtcctactacgcgtacgtggtggagctctgcgtgtttactatttttggaaatgaagaaaatggaaagaccgttgtttaccttgtggctttccatctgttctttgttatgtttgtatggtcctattggatgacaattttcacatctcccgcttccccctccaaagagttctacttgtccaattctgaaaaggaacgttatgaaaaagaattcagccaagaaagacaacaagaaattttgagaagagcagcaagagctttacctatctataccacatcagcttcaaaaactatcagatattgtgaaaaatgtcagctgattaaacctgatcgggcgcatcactgctcagcctgtgactcatgtattcttaagatggatcatcactgtccttgggtgaataactgtgtgggattttctaattacaaattcttcctgctgtttttattgtattccctattatattgccttttcgtggctgcaacagttttagagtactttataaaattttggacgaatgaactgacagatacacgtgcaaaattccacgtactttttcttttctttgtgtctgcaatgttcttcatcagcgtcctctcacttttcagctaccactgctggctagttggaaaaaatagaacaacaatagaatcattccgcgcacccacgttttcatacggacctgatggaaatggtttctctcttggatgcagtaaaaattggagacaagtctttggtgatgaaaagaaatattggctacttccaatattttcaagcttgggtgatggttgcagttttccaactcgccttgtggggatggatccagaacaagcttctgttacaaaccagaatgagtatgccagaagatctaaactgcagaggtagaaagcagaaaacttggcaaatgacagtagtggctcaaatcaaccttttcctatcaaaccacttagtgaatcaaaaaaccgcttgttggacagtgaatctcagtggctggagaatggagctgaagaaggcatcgtcaaatcaggtgtatgaaaacattatagactggtattttcaattttcatttgcaagaaaatgatcagtggaatgaaataactgaagtataacagaagatatattttttaaaacggaaagcctttgtacagttcctgggattcacagaagcactactccagagcagaatgatgccttaatcttaagtgtccatttgtgcagcattgacttagagctacaaaagtgacttaatgttattctggaaataatacttacctgttatgagttgctataatatgagctgtcatcacattttaacatgcatatgta

SEQ ID NO: 8098 - DNA, 1455 bp, Homo sapiens
cggaggcgggggagctggaccagcagccgcctggagcgtccgagtcaccgtcgccggggctcccgcgctccccagaacggtgggacgcggggctcggcagccgccagcggaacatggcgccctggacgctgtggcgctgctgccagcgcgtcgtgggctgggtgccggtgctcttcatcaccttcgtggtcgtctggtcctactacgcgtacgtggtggagctctgcgtgtttactatttttggaaatgaagaaaatggaaagaccgttgtttaccttgtggctttccatctgttctttgttatgtttgtatggtcctattggatgacaattttcacatctcccgcttccccctccaaagagttctacttgtccaattctgaaaaggaacgttatgaaaaagaattcagccaagaaagacaacaagaaattttgagaagagcagcaagagctttacctatctataccacatcagcttcaaaaactatcagatattgtgaaaaatgtcagctgattaaacctgatcgggcgcatcactgctcagcctgtgactcatgtattcttaagatggatcatcactgtccttgggtgaataactgtgtgggattttctaattacaaattcttcctgctgtttttattgtattccctattatattgccttttcgtggctgcaacagttttagagtactttataaaattttggacgaatgaactgacagatacacgtgcaaaattccacgtactttttcttttctttgtgtctgcaatgttcttcatcagcgtcctctcacttttcagctaccactgctggctagttggaaaaaatagaacaacaatagaatcattccgcgcacccacgttttcatacggacctgatggaaatggtttctctcttggatgcagtaaaaattggagacaagtctttggtgatgaaaagaaatattggctacttccaatattttcaagcttgggtgatggttgcagttttccaactcgccttgtggggatggatccagaacaagcttctgttacaaaccagaatgagtatgccagaagtggctcaaatcaaccttttcctatcaaaccacttagtgaatcaaaaaaccgcttgttggacagtgaatctcagtggctggagaatggagctgaagaaggcatcgtcaaatcaggtgtatgaaaacattatagactggtattttcaattttcatttgcaagaaaatgatcagtggaatgaaataactgaagtataacagaagatatattttttaaaacggaaagcctttgtacagttcctgggattcacagaagcactactccagagcagaatgatgccttaatcttaagtgtccatttgtgcagcattgacttagagctacaaaagtgacttaatgttattctggaaataatacttacctgttatgagttgctataatatgagctgtcatcacatttt

SEQ ID NO: 8099 - DNA, 1869 bp, Homo sapiens
gtggggtgggggcggggcctggctgggcgccgggacgggaggagtcccggcggcgcctcggacttttgctcccacaagtcctgcctcggaggcgggggagctggaccagcagccgcctggagcgtccgagtcaccgtcgccggggctcccgcgctccccagaacggtgggacgcggggctcggcagccgccagcggaacatggcgccctggacgctgtggcgctgctgccagcgcgtcgtgggctgggtgccggtgctcttcatcaccttcgtggtcgtctggtcctactacgcgtacgtggtggagctctgcgtgtttactatttttggaaatgaagaaaatggaaagaccgttgtttaccttgtggctttccatctgttctttgttatgtttgtatggtcctattggatgacaattttcacatctcccgcttccccctccaaagagttctacttgtccaattctgaaaaggaacgttatgaaaaagaattcagccaagaaagacaacaagaaattttgagaagagcagcaagagctttacctatctataccacatcagcttcaaaaactatcagatattgtgaaaaatgtcagctgattaaacctgatcgggcgcatcactgctcagcctgtgactcatgtattcttaagatggatcatcactgtccttgggtgaataactgtgtgggattttctaattacaaattcttcctgctgtttttattgtattccctattatattgccttttcgtggctgcaacagttttagagtactttataaaattttggacgaatgaactgacagatacacgtgcaaaattccacgtactttttcttttctttgtgtctgcaatgttcttcatcagcgtcctctcacttttcagctaccactgctggctagttggaaaaaatagaacaacaatagaatcattccgcgcacccacgttttcatacggacctgatggaaatggtttctctcttggatgcagtaaaaattggagacaagtctttggtgatgaaaagaaatattggctacttccaatattttcaagcttgggtgatggttgcagttttccaactcgccttgtggggatggatccagaacaagcttctgttacaaaccagaatgagtatgccagaagtagtggctcaaatcaaccttttcctatcaaaccacttagtgaatcaaaaaaccgcttgttggacagtgaatctcagtggctggagaatggagctgaagaaggcatcgtcaaatcagggacaaataaccatgtaacagtggcaatagaaaattgagtaccacttgttcataactaaccatttgaataagagcaaggtgtatgaaaacattatagactggtattttcaattttcatttgcaagaaaatgatcagtggaatgaaataactgaagtataacagaagatatattttttaaaacggaaagcctttgtacagttcctgggattcacagaagcactactccagagcagaatgatgccttaatcttaagtgtccatttgtgcagcattgacttagagctacaaaagtgacttaatgttattctggaaataatacttacctgttatgagttgctataatatgagctgtcatcacattttaacatgcatatgtattttttgatacctgaattacattattagaataagtatccatatacattttcactccaaaaacacaagcttaaaaactttaaagtacatctagggcaaatggtggctgaaagtgaataatattcaaattactgttgcttgtactgtataaggaaaactgcttttttaaattgggtatttgctaatttataattactattttatacttttcaacatttttaataactttttttat

SEQ ID NO: 8100 - DNA, 1202 bp, Homo sapiens
gggagctggaccagcagccgcctggagcgtccgagtcaccgtcgccggggctcccgcgctccccagaacggtgggacgcggggctcggcagccgccagcggaacatggcgccctggacgctgtggcgctgctgccagcgcgtcgtgggctgggtgccggtgctcttcatcaccttcgtggtcgtctggtcctactacgcgtacgtggtggagctctgcgtgtttactatttttggaaatgaagaaaatggaaagaccgttgtttaccttgtggctttccatctgttctttgttatgtttgtatggtcctattggatgacaattttcacatctcccgcttccccctccaaagagttctacttgtccaattctgaaaaggaacgttatgaaaaagaattcagccaagaaagacaacaagaaattttgagaagagcagcaagagctttacctatctataccacatcagcttcaaaaactatcagatattgtgaaaaatgtcagctgattaaacctgatcgggcgcatcactgctcagcctgtgactcatgtattcttaagatggatcatcactgtccttgggtgaataactgtgtgggattttctaattacaaattcttcctgctgtttttattgtattccctattatattgccttttcgtggctgcaacagttttagagtactttataaaattttggacgaatgaactgacagatacacgtgcaaaattccacgtactttttcttttctttgtgtctgcaatgttcttcatcagcgtcctctcacttttcagctaccactgctggctagttggaaaaaatagaacaacaatagaatcattccgcgcacccacgttttcatacggacctgatggaaatggtttctctcttggatgcagtaaaaattggagacaagtctttggtgatgaaaagaaatattggctacttccaatattttcaagcttgggtgatggttgcagttttccaactcgccttgtggggatggatccagaacaagcttctgttacaaaccagaatgagtatgccagaagtagtggctcaaatcaaccttttcctatcaaaccacttagtgaatcaaaaaaccgcttgttggacagtgaatctcagtggctggagaatggagctgaagaaggcatcgtcaaatcagggacaaataaccatgtaacagtggcaatagaaaattga

SEQ ID NO: 8101 - DNA, 497 bp, Homo sapiens
gggagctggaccagcagccgcctggagcgtccgagtcaccgtcgccggggctcccgcgctccccagaacggtgggacgcggggctcggcagccgccagcggaacatggcgccctggacgctgtggcgctgctgccagcgcgtcgtgggctgggtgccggtgctcttcatcaccttcgtggtcgtctggtcctactacgcgtacgtggtggagctctgcgtgtttactatttttggaaatgaagaaaatggaaagaccgttgtttaccttgtggctttccatctgttctttgttatgtttgtatggtcctattggatgacaattttcacatctcccgcttccccctccaaagagttctacttgtccaattctgaaaaggaacgttatgaaaaagaattcagccaagaaagacaacaagaaattttgagaagagcagcaagagctttacctatctataccacatcagcttcaaaaagcctcatgcagtctacaaaatag

SEQ ID NO: 8102 - DNA, 1280 bp, Homo sapiens
cttttgctcccacaagtcctgcctcggaggcgggggagctggaccagcagccgcctggagcgtccgagtcaccgtcgccggggctcccgcgctccccagaacggtgggacgcggggctcggcagccgccagcggaacatggcgccctggacgctgtggcgctgctgccagcgcgtcgtgggctgggtgccggtgctcttcatcaccttcgtggtcgtctggtcctactacgcgtacgtggtggagctctgcgtgtgaaagaccgttgtttaccttgtggctttccatctgttctttgttatgtttgtatggtcctattggatgacaattttcacatctcccgcttccccctccaaagagttctacttgtccaattctgaaaaggaacgttatgaaaaagaattcagccaagaaagacaacaagaaattttgagaagagcagcaagagctttacctatctataccacatcagcttcaaaaactatcagatattgtgaaaaatgtcagctgattaaacctgatcgggcgcatcactgctcagcctgtgactcatgtattcttaagatggatcatcactgtccttgggtgaataactgtgtgggattttctaattacaaattcttcctgctgtttttattgtattccctattatattgccttttcgtggctgcaacagttttagagtactttataaaattttggacgaatgaactgacagatacacgtgcaaaattccacgtactttttcttttctttgtgtctgcaatgttcttcatcagcgtcctctcacttttcagctaccactgctggctagttggaaaaaatagaacaacaatagaatcattccgcgcacccacgttttcatacggacctgatggaaatggtttctctcttggatgcagtaaaaattggagacaagtctttggtgatgaaaagaaatattggctacttccaatattttcaagcttgggtgatggttgcagttttccaactcgccttgtggggatggatccagaacaagcttctgttacaaaccagaatgagtatgccagaagtagtggctcaaatcaaccttttcctatcaaaccacttagtgaatcaaaaaaccgcttgttggacagtgaatctcagtggctggagaatggagctgaagaaggcatcgtcaaatcaggtgtatgaaaacattatagactggtattttcaattttcatttgcaagaaaatgatcagtggaatgaaataactgaagtataacagaagatatattttttaaaacggaaag

SEQ ID NO: 8103 - DNA, 4699 bp, Homo sapiens
tcgcggctcccgggagctaagcgagacggcgacggcggcagtcgtccctccccacgcgggcgcgcgggcatgcggacacccactcggccggtccaggccctcaggctcccggaagcggaaggggagagcggcccggcctgggcggcggcgccggaggaggcggaggtggcgcggcaggaggaggggaaagagctgctggcggtcgggagagcggcggcagcgagaggcgagccagcggcgacgaatgaagaactttttcacttactgcaggattttcagcttcagcaagcaggttctcatggagaactgttattgaagagagatccatttggtgggatataattaaaaaaaatgaatcaaaagaaaatctctaaatgcagattccagaaaaattacagcacatctcagtgaatttgcaagtggatcatccttccttgtgggttagcaggcagttataagattgcaaaatgggtctccggattcactttgttgttgacccacatggttggtgctgcatgggtttgattgtctttgtttggttatacaatattgttttaattcccaaaattgtcctctttcctcactatgaagaaggacatattccaggcatattaataataatattctatggcatttccatattctgtctggttgccttagtgagggcctccataactgatccaggaagactccctgagaaccccaagatcccacatggagaaagggagttctgggaattatgtaacaagtgtaatttgatgagaccaaagcgttcccatcactgtagccgctgcggccactgtgtgaggagaatggatcatcactgtccatggattaacaattgtgttggtgaagataatcattggctctttctgcagttgtgtttctacactgaacttcttacttgctacgcactgatgttttctttctgccactattactattttcttccactaaaaaagcgtaatttggacctctttgtttttagacatgaattggccataatgagactagcagcctttatgggcattactatgttagttggaataactggactcttttacactcaactaattggcatcatcacagatacaacatctattgaaaagatgtcaaactgttgtgaagatatatcgaggccccgaaagccatggcagcagaccttctcagaagtttttggcactcgttggaagatcctgtggttcattcctttcaggcagaggcaaccactgcgagttccctaccactttgccaatcatgtctaaacagatggatggtgggcacagatgggtcctccatgctggcaatgcgttacaggttttatgataatagaactatgacagtcttcaagtcaattaaaatccacccaccagtcttaggcatcataatgtgccccaggctttattttaatagtgatcttgatcctgttgtgggactaatacaagatctatatttaagttttaaagcatgtttactttcaaattagctttccacagggatttcttgaaatgcttttgttattaaactcaaaaggcagtgattaggatgaaataattgtacataatttattttagtactgacagtgttacagattctaatttatggtaaatttcagatgtttatttaaaattttcacttttaaacagtaaccaaatctaaatttaattattcaggttttacaaaagttgatacaccttcttatagtataggtaaattttctttttcaaatccaatttaaaataacctttccttttaaatgtgctgcaacgtttttaaaaatgcagcagcataggagtgaacaacagcaacacaaaacgggcattggtttcttaggagtggcttgcttacgttttcttcttttttcttcaccaaaaccaacatgaaagtaccactgaagtaaaacaccaactacctaccttactataaaggaaatgttaaaatttttttcacaataattttttcaattttcactattactgttgtaattattgattgtgattaaaatatttgctcccaggagaactcctgaccagtgggcatgtattcctattttatcctaagattttaatgagcaaaaaggggagagaatttgcaataacttcacaattaccttttctagtgcagttatattagaatgcatatgtttttaaaatgctagtataactagatagtatataatgtacagtataaagaggaatattgtgcttttgaaaagagtatactttttacttttatttatgtactagtagatgtaaaatttcacattgaaggtttatatatattggccaactcatatagaaattttatttataggaagctactactaaaaaaagtcactaactttgtgtacctataatccctaaattaaaattaaattttaattggctggctgtaatttgcattgagagaccttttactagtagctagtgttaggaagtgaacctaaaataagaaaatataatgatctgtgtttatcattagccttgtacaaatgtaaattactaatagtgatgttcttttgcaaggcatagaacatttgtatgaaaagacatttagtatgctttgaaaaaaactcagcttttagtttttttccattagaatactgcaaaacccatatatctttttaaaaaatttatgtactcacagtctttcccttgaagagaagattgaaaaagtctactgttcataaaccatgctaacattttccttttagctagttttgaaagtaaggaacaatacctgggaaataattaaacagaaggttaccattgtcagccagttggctatactgtggttagttctttcagaaattgtaaatatcttgtagcatattctgaaataatagagtaagttcttctcagagatgttaatatcatgtttttcatgttctaattagaatactttattacttacaaactcagaaatacgaacagaaatacagcagacgaacatatttattggtactgaaaagagacgtagtaaattaaatagaagaaatatatttataaagcttagtgaaacacaaaattagaatgttcatgtcaggcacaagggtttggattttgtgcaagctaatttggccacatttggcctggtgacagaactgttcataaggaagtaatatatagataaggtaggtagatatcagttgaatgccttatattgtatacattcctttcaaataaagaccttgagaaaacagcagagccaagtgaagatcacctaaagaactttgtggctaatttatacttcatgtagtagcagtgggtactgggcagggtctctttcccactctgatgatttgtgctcttatttttcctagatttacctcatctagggcatattcttttccctcttcctctttacctttcctggtcctgatccctctgtactcagttcccctaaattattggactacaaactaatatactagaaaagcatacacttattttatttgaatgcagaaatgctatctatcagtatatatacataagaatgtatattacagtatatctatatatacttaacactgtaactttcagtattccccagttagcgtacctaactctcctgtgggttttgttaattcttattagactactagagaaaaaccaactggcagtttgctaagcatatctactggtgttgtttctgcgccctcttttggctaattgatgtaattatactggctctaaagatttactgccccataagtaaatagtatagccacattctgaacatatcaaaagtacaaacttaggaggagtgtatgtacaaaaatgtaaaattttatgaaaatgaacatgtttttatgatgttatttctagttcataagaatgtgatgactgctttgcttcatttatgtacgttcccattatattcttgctgtcaatcaatcacaaatttatatcagattaggataaactaagccattttatgtattttattttaaaccttattttggcagagtaattccttagaattggaaaagctgttactttgaaattaccaatttattacaaaacatagaaatgtattgtagctacaaagacaaccaagcattttctgtgttttaatgaatatctaaaaaactacatttagtttattttactcagttttgaaatgatttttttactggctctattgccttaaaataactaagagattaatgattctttgtataattttccttttctttgttcttttttttacatttcgcagagttatatctatagttttagtaacaatttcttatgtattctggataactgaaaacaactaaaggtgttgggcattagaaaataattgtgagcagtaagattactgatgtaatatgtatgttggactgaagtatttctttataaacattctatttgattttaagcaaaatgtatgttaaagcatgtttttacatcagtaaagtcatttgtcgaccttctggaaatgaaaggtttttacctagatactgtaagttacacctccttaacaatcatatttgtcattgttgttttctgcaaacaaaaatgtttatgggcttcatgtaggcttaagattgtaggcaaaaatggactgagttcaggacccttcaagcagtaggcattcagttacagagcagttggtactttgtaacccagacttacagtttaaaaatatcaagttagctgatgtttcattataataaaaatactattttgcttaa

SEQ ID NO: 8104 - DNA, 3408 bp, Homo sapiens
ccttactcgctggcgcccaagtgggaagccagcagctgcccgctccctcctccccacatccccgctacttgcccagttcccgaagcgaagcgcaggctgcgagccagccgggccgagtccacaactttgcagcctcgggcagggcgagagccggcgtccggggctcctcttgtcggcgaccagagctcggaatgtaatcgaggatgctggccctgcggctgctcaacgtggtggcccccgcctacttcttgtgcatctccctggtgaccttcgtgctgcagctcttcctcttcctgcccagcatgcgcgaggaccccgcggccgcccggctcttctcgcccgccctgctccacggggcgctcttcctattcctctcggccaacgccctgggcaattacgtccttgtcatccagaactccccagacgacctgggggcctgccagggggcctcggccaggaagactccatgcccctcacctagcacccacttctgccgagtgtgcgccagagtcaccctgaggcacgaccatcactgtttcttcaccggcaactgcatcggcagcaggaacatgcgcaacttcgtcctgttctgcctctacacctccctggcctgcctctactccatggtggccggcgtggcctacatctccgctgtcctttccatctccttcgcccaccccttggccttcctcacgctcctgcccacctccatcagccagttcttctccggagctgtcctgggttctgaaatgttcgtcatcctcatgctctacctctggttcgccatcggcctggcctgcgccggcttctgctgccaccagctgctgttgatcctccgcgggcagacccgccaccaggtgcggaagggggtggcagtgagggcccggccctggcgcaagaacttacaagaggtcttcggaaagaggtggctgctgggcctgctggtccccatgttcaatgtcggaagtgagagctccaagcagcaggataagtagtagacactcccgtcatttatctctctgtctctgtcttgactcctcctgagcataaaaccatggcagccttgtctccacccatgactcactacaaccttgtgctggtaaggtcctagcatcttcccctcaccttccacccatgagaacagcgtgagctggtggatcatgacaaggaggaaaaatgtccccccaggcatttctaggctcctcacgagccagccaggtggctgctagctgttaggctgcctctgctttctttccgtccccttgggatccctgctttccccctcttcctggctcatccattctccaccgtgtctcattcatcactgctgtctgctagagcccttcctctcagcccccatgttgggagaggggagtggattcttgctgctggtatgagactccctgggacctagaggctggcaaatgtttaaaatcaccacgtgtaagaggcagccaagtcagctctgccaactgctaggggagttgggaaagagtgggtgtgtgtccgcatcccctctgtaggaaaaagaacttagtagcttgctgctccctcaccaccccccaccaggttcaagaccctttttctgggagacagcaatcaatggcctgctttttccaaatgttattccctgtccaccctgccccatctggccggcccagcccagtccaggacctggctggatgcttcctgtccctggaactcttccagcctttctacttgatctccagcccccaggtctttgccagatgatgggaaggcaaggaagaagggacagggaaagataattactgataaatgaaggggatattcgactgtataaccatatggaagtgtgtgtgtgtgtgtgtgtgtgtgtgtgagagagagagagagagagatgggtggtggtgagaagtgttgttagaaacatataggaataatgcctaggggaaagggagaagtgagagggacaattgggttcatttatgccctatacaaagggcattccagcagctgaaactcttcaatgtttgaatggctgcctgtgaaggtagtgagtgccccatcactggaggtattccagcagagtctaggcagtcgtctgccaggcatgctgtggaagggatttctgtacagggtcattctaggtgagcttacacattccttccaaccccaaggttctgatgtcctggttgtgattgctggacccagaggcaagatctgcagagatgcctgtgagatatttgctttcctagaggggagtgtgggcatgggaggggtctgaaaatcaggacccaacccagccactgaagagagagtctctgcagagacagggctacctgggtggttgaggggactgacatttgaggacagggagatggagcagtgtcattgtcagtggcagggcatggggggcagtggtgagctaaggctgaggagtggagatgaccagaatataagggtgcaattcccagaccatccctgcgcatctgactgactccggtggaggcactgctgtgtgttttctgaaacctagaggaccagacctctggggcatataagggagtagggacaacacaagtgccccctcctgactgggtcccaaagccaatatgacatccatgcaggcagcagtgctgaatccatgccctgcaatgtccaaccgccaactgcagtgacccgctgatagctgcgcaacagcctgggttcttgagcagagattgggaggactttactgtggttctgccttcacaccccctagagagctaatgtagtattggctccacctgctcacatttctccctcccatactcattccttcactcatccatcctacgtatatttattgagtgccaactacgttcccagcctcttccaggcactggcaatgcagtgatgaacaggatgacaagattcatgccatcaggggcaccttgtcactgccgtctgtgcactgattcacactccctgcaaaatggtcactctgccatcttggtggttggtggggcaggtcatttggaaataaagaatgtgatagagatggctgaagaggggaagcctaggctgcctcaatggaggagtcgctgggggcattttcacccacaattctggccatacttaagcaatgggagggagagggaggaggggaagatctgggcaattttggccttgactctttcctggctccagagctcaagcttagaagccagccctgctatttccagcctcctgaaggctcagcacggtgaggcctgacatcctggggaagggcaacagggagacctacaggatgttggctgcttgcagactggtcaatgggggatgacggtggggaggttgccagatgtgagacttgagtagcatttgtacacatggccctgtattgtccttgaagaacatcaataaaatatatggttttaaattgga

SEQ ID NO: 8105 - DNA, 388 bp, Homo sapiens
ggggtgaggctcaaagaagaagctccaagttcaagctctgtgtctggataaactcccattgtctttccttctctcaaatcagagctgcccgtgggtcccagggtgatgctgggctgtgtagaggctgagtgcaggagcattaatgctagaaccagatgaggaaactggaatctaagatcacactggaatttacagacgaagaaactggaatctgagatctcacagtagtgaatggtgaatattcaaacccaggaatgtaatcgaggatgctggccctgcggctgctcaacgtggtggcccccgcctacttcttgtgcatctccctggtgaccttcgtgctgcagctcttcctcttcctgcccagcatgcgcgaggaccccgcggccgc

SEQ ID NO: 8106 - DNA, 545 bp, Homo sapiens
actcgtgcgcccagggcgggcttgtcggcatggaaaggatttcggcgccatgagggttgtttgggtttctctcagcaggagggcgggaggcgggcgcgaaggggggattttaatttcgcctcaaatgaaaacgctcttcgcaaagaaatagcccgggcagccagcgttggagagatgtgctggccaggacccgctgacacaggaatgtaatcgaggatgctggccctgcggctgctcaacgtggtggcccccgcctacttcttgtgcatctccctggtgaccttcgtgctgcagctcttcctcttcctgcccagcatgcgcgaggaccccgcggccgcccggctcttctcgcccgccctgctccacggggcgctcttcctattcctctcggccaacgccctgggcaattacgtccttgtcatccagaactccccagacgacctgggggcctgccagggggcctcggccaggaagactccatgcccctcacctagcacccacttctgccgagtgtgcgccagagtcaccctgaggcacgaccatca

SEQ ID NO: 8107 - DNA, 3778 bp, Homo sapiens
ggggcacccggaagcgcgcgtggacctggcgcaccgagccgggcgggcggaggggcggttgggacggcgcggggaggcgggcgcgccgcccgggccgcggcgggctgtggtcacaggtgggcggctgcggcgagggagcggccgagcggagcccgggtcccggagactcctgccgtcacgcccggggctccgcgtagcagagatcgggagacgcgtctgtgcctccggggaagccgacccatctcccctccgcctctttggctgcagttgcacctccggccagagggcaggtgcaaatcatgacacagaagggcagtatgaagcctgtgaagaaaaagaaaaccgaagaacctgaattggagcccctgtgctgctgcgagtacatagatcggaatggggaaaagaaccacgtggctacttgtttgtgtgattgtcaagatctggatgaagggtgtgatcgatggattacatgtaaatctttacagccagagacttgtgaaagaatcatggatacaatttctgatcgcctccgaattccttggcttaggggagccaaaaaagtgaacatcagcatcatccctccgcttgtcctgctgcctgtcttccttcatgtggcttcctggcatttcctcctgggggtggtggttttgacctcccttcctgtgctggcactgtggtactactacctcactcacagaaggaaagaacagaccctgtttttcctgagccttggactgttctctctgggctacatgtactatgtgttcctgcaggaagtggtccccaaagggcgtgtgggtcccgttcagctggcggttcttacctgcgggttatttctgatactcttagccttgcacagagccaagaagaatccaggctacctcagcaatccagcaagcggtgacagatctctaagcagcagccagctggagtgcctgagcagaaaagggcaggagaagaccaaagggttccctggggcagacatgtcgggcagtctcaacaatcgcacaacaaaggatgaccccaagggctcttccaagatgccagctggaagccccaccaaagcgaaggaggactggtgtgccaagtgccagctggtgcgaccagcccgggcatggcactgccggatatgtggcatctgtgtgaggagaatggatcatcattgtgtctggataaatagctgcgttggagaatcaaatcatcaagcatttatacttgcccttttgatcttcttgctcacctcggtgtatgggatcacactgaccttggacaccatttgtagagacagaagtgtcttcacagctcttttctattgtcctggagtttatgcaaattacagctcggctctgtccttcacctgcgtgtggtactctgtgatcatcacagcaggcatggcctacatcttcctgatccagctgatcaacatcagctacaatgtgactgagcgggaagtccagcaggccctccgacagaagactgggcgccggctcctctgcgggctcatcgtggacacagggttacttggatgagccaactccgcttccttcccatggataggaagggactctgtgtattattcaggtttattggcacgaagatacttgttttaagttccttgagaacccatgatggacagttgacagaatgcttaaacctgtcaaaagatgagtgatcttgtgtgggaaaagccttcccaggcgtctgtaccgaaaggagcagcaaacaaggggctaatccatgagcagtgttctgtaggctctgtgacatctttggtttataggattttggagccttttatgatctggaactatttgaggggtttcattataggccttggttctctccaggggccagatgagtttattgtggaatctttgaaaggacaaggcctctgtgaatgaatcagtcccagggaagcatttggtggtggcggcagtggaggattgcccggtgaacctataaatcagcagtctcttgggcagaggagcaagcccctcgaacatgatttcaaacaagcaggtcctcttctctcatctcacgtccttagtctctgttaatgaacatactggatgtggagtttaataaattacctactatcatctggccacttagattattatcacaccactgtggactgttcctggggggagaagaacagaccgatttgaaagattcaagggagaaagattaaggatcaggattgcatgaaagaagaaaatccttcaatatttaaaatgtttcttacaatacccacggagcacttttatggttccagccgagcgttcctgaaatgaactgaccattaacagcgcctctttgataggttaccctgatgctgctaaagtaaagccttaagtgtgtttttgggacaacgtgctgcttattccacctcagccacatatgtgtttgtgtttaggatattgtaaatctttgctaagtagtgttttccttggtgaatgaagtcattgttgtcttcaagtgtaccatctgcctagcaaaaaattgctacaaactttctcttatgcaatagtccttggtacttctaatatttttagcaagagacaattttctgtactagaatcttccactgccagaaaacacagtgccagtaaggttctacataccactgaccatctgcttaatagacatgtatttcctttgagtaggacattagcttttgattataaagctcaactagtataagcaaaaatataacatctagaagcacagttttagccaggatgtttaaaaattacagttttgtgagacttaagggtctttttaacctaggtaagtttatatgacctaacttaattgtagccatattctggtaccttccattttgaaaagtagaggttgcttaagcaagcaatggataataagagacttttcctgaggcacctgtttggaatctggttttctcagcggcagcttgacatgtgcacccttttgtattaaacactgcaagggtgatgcaggggagcaggaaagccatcctaaactcactactgagtacgattcagtatgttcctgtggatgtctgctgtgactaatataaatttcttgcagaatcagctacacttaattatgttgctgatagacaagcatccacgcttcagctggcactaagtgttttcattgtaggatcagcagcaggttaaagactgaacggttagtgaagacaaatgtcttaagaggctgcgatgtctaggttgggcttgtgacttcttagtggcctagccttcttgatggcaccttgaaagtgaacttctagaaatctacatttaaaaggcaaagctttaaaagcagagctagtctattctagttactgatgcaactaaaattctgtatttcttaagatggagccactgacgagatgtcacagtatagagcctgcagtctcaactcattgtgatcctaatggtctgggtgattggatggtttgagttgttagggattttgagtttttcattttattgcatatctgggttggatgttagactaaaggaaacccaggaatatttacctggtgttacatttaatatttaatgtaactggtctagcaacattaagggggatttctgaagccaactccggaggctgtgggctgcacattttgcactgtttttatatacttgtattcatatcctcttatcacctcagactcagacacaaggccttttacatggaaattttacaaattacttccatttatgtaaaataacgtcctgtgaccaagttgtttaaatggaaaataaagtgctttctttaaggaaaa

SEQ ID NO: 8108 - DNA, 740 bp, Homo sapiens
ggctgtcgccataggaacggctggtgcccagacggcgcctgcccaggctgggaaggggcggtgaaggcagctcagacctccaagaaccctggagccccctgtgtggccaggcggagccacagaagcctgatgaaaacgggaccccctccccctctctcttctcatttttgattgctcaggcgttggaggttaagcagagagagagaggcgtggacctatttacgagatgtaagttgtgttctttccacctttaccttctgagggcttcttacgcctcatggtgacaggtgcaaatcatgacacagaagggcagtatgaagcctgtgaagaaaaagaaaaccgaagaacctgaattggagcccctgtgctgctgcgagtacatagatcggaatggggaaaagaaccacgtggctacttgtttgtgtgattgtcaagatctggatgaagggtgtgatcgatggattacatgtaaatctttacagccagagacttgtgaaagaatcatggatacaatttctgatcgcctccgaattccttggcttaggggagccaaaaaagtgaacatcagcatcatccctccgcttgtcctgctgcctgtcttccttcatgtggcttcctggcatttcctcctgggggtggtggttttgacctcccttcctgtgctggcactgtggtactactacctcactcacagaaggaaagaacagaccctgtttttcctgagccttggactgttctct

SEQ ID NO: 8109 - DNA, 1941 bp, Homo sapiens
aatcactccgcggcgttatccgggctccagcgccgcgggattccgagcgcctccactgctggtccgttggccagatcaactcgccgcgtgggccggccgttccctgagagtctgagcgctcgccgcacccccttccgagcttctattggccgtagcagacgtccgtctgccgctatctccgccccaatacggaagcggcctagtcctccggctccgacagctgggtgtccaggccatggggcagccctgggcggctgggagcacggacggggcgcccgcgcagctgcctctcgtgctcaccgcgctgtgggccgcggccgtgggcctggagctggcttacgtgctggtgctcggtcccgggccgccgccgctgggacccctggcccgggccttgcagctggcgctggccgccttccagctgctcaacctgctgggcaacgtggggctcttcctgcgctcggatcccagcatccgtggcgtgatgctggccggccgcggtctgggccagggctgggcttactgctaccaatgccaaagccaggtgccgccacgcagcggacactgctctgcctgccgcgtctgcatcctgcgtcgggaccaccactgccgcctgctgggccgctgcgtgggcttcggcaactaccggcccttcctgtgcctgctgcttcatgccgccggcgtcctgctccacgtctctgtgctgctgggccctgcactgtcggccctgctgcgagcccacacgcccctccacatggctgccctcctcctgcttccctggctcatgttgctcacaggcagagtgtctctggcacagtttgccttggccttcgtgacggacacgtgcgtggcgggtgcgctgctgtgcggggctgggctgctcttccatgggatgctgctgctgcggggccagaccacatgggagtgggctcggggccagcactcctatgacctgggtccctgccacaacctgcaggcagccctggggccccgctgggccctcgtctggctctggcccttcctggcctccccattgcctggggatgggatcaccttccagaccacagcagatgtgggacacacagcctcctgactccaggaagagccagagctgtgcagggaggaaggggtgagaggggggcccccacacctagactcagtaaggaagtcgggttggaccttaacatctgcattggacaactccaccccttccttggccttgcccctgcccgcctacactcctacgtgtccagggcttgggccgtgacttaggcagaggagtgcagaggagggtctggcaggggctgctcaggccgcctagctgcccctttgccaggttaataaagcactgacttgtttctcagcctccctccatctttgcatagtttctggcccctcactttgttgctggggctgtttctgggaccctctgtagggcctggaaactgcaggatgcctgagggtctcaggggctggggctctacctcccctggcctgggtgagttgggggtggggcaccagcacgccaaggcagtgtcctactgatccaggctatgagaatccaaacattctttcccaggtttggcattttatagttagaagcatttctgcaacagcagtttcatggaacctctcttagctaacctggtccatggggcagcagttacgctctaagaatccatgtggtaagatcatggtgcggcaaatggaggcagggtccaacccaggtctttgtgcttttgcctttacccttgcacagctggaggaaatgagtaggaaagaaatcaaggtaaagaaatgcgctggggctgtttgggcatctgtggagggtggtgctgacagggctaggcctgcacctctctggcctcctcaagagctgcttgttaaatgtttccgtgtaaatagaatgaatagagaccgccatttccacatggcaggcctaaa

SEQ ID NO: 8110 - DNA, 3101 bp, Homo sapiens
gcgtcatcaacctgcgcggcggccgctcctgcagccgcggccgccgccactgccgggagagctcgatgggcttctcctgcgcgccgcccggtgtctggccgagtccagagagccgcggcgcctcgttccgaggagccatcgccgaagcccgaggccgggtcccgggttggggactgcaggggaaggcagcggcggcggcggcgggagccccaccggggtctgggactggggaactgcctccggcttcacgatgccagtatggacagaatagcttatgatgcttatccccacccaccacttccgaaacattgagcggaaaccagaatacctccagccagagaagtgtgtcccacccccctaccctggtcctgtgggaaccatgtggtttatccgtgacggctgtggcatcgcctgtgccatcgttacctggtttctggtcctctatgcggagttcgtggtcctctttgtcatgctgattccatctcgagactacgtgtatagcatcatcaacggaattgtgttcaacctgctggccttcttggccctggcctcccactgccgggccatgctgacggaccccggggcagtgcccaaaggaaatgccactaaagaattcatcgagagtttacagttgaagcctgggcaggtggtgtacaagtgccccaaatgctgcagcatcaagcccgaccgagcccaccactgcagtgtttgtaagcggtgcattcggaagatggaccaccactgtccctgggtcaacaactgtgtaggcgagaacaaccagaagtacttcgtcctgtttacaatgtacatagctctcatttccttgcacgccctcatcatggtgggattccacttcctgcattgctttgaagaagattggacaacctatggactgaacagggaagaaatggcagagactggaatctctcttcatgaaaaaatgcagccccttaacttcagttcgacagagtgcagctccttctctccacccaccacagtgattctccttatcctgctgtgctttgagggcctgctcttcctcattttcacatcagtgatgtttgggacccaggtgcactccatctgcacagatgagacgggaatagaacaattgaaaaaggaagagagaagatgggctaaaaaaacaaaatggatgaacatgaaagccgtttttggccaccccttctctctaggctgggccagcccctttgccacgccagaccaagggaaggcagacccgtaccagtatgtggtctgaaggaccccgaccggcatggccactcagacacaagtccacaccacagcactaccgtcccatccgttctcatgaatgtttaaatcgaaaaagcaaaacaactactcttaaaactttttttatgtctcaagtaaaatggctgagcattgcagagaaaaaaaaaagtccccacattttattttttaaaaaccatcctttcgatttcttttggtgaccgaagctgctctcttttccttttaaaatcacttctctggcctctggtttctctctgctgtctgtctggcatgactaatgtagagggcgctgtctcgcgctgtgcccattctactaactgagtgagacatgacgctgtgcgtggatggaatagtctggacacctggtgggggatgcatgggaaagccaggagggccctgacctcccactgcccaggaggcagtggcgggctccccgatgggacataaaacctcaccgaagatggatgcttaccccttgaggcctgagaagggcaggatcagaagggaccttggcacagcgacctcatcccccaagtggacacggtttgcctgctaactcgcaaagcaattgcctgccttgtactttatgggcttggggtgtgtagaatgattttgcgggggagtggggagaaagatgaaagaggtcttatttgtattctgaatcagcaattatattccctgtgattatttggaagagtgtgtaggaaagacgtttttccagttcaaaatgccttatacaatcaagaggaaaaaaaattacacaatttcaggcaagctacgttttcctttgtttcatctgcttcctctctcaccaccccatctccctctcttccccagcaagatgtcaattaagcagtgtgaattctgactgcaataggcaccagtgcccaacacatacagccccaccatcatccccttctcattttataaacctcaaagtggattcactttctgatagttaacccccataaatgtgcacgtacctgtgtcttatctatattttaacctgggagactgttgtcctggcatggagatgaccatgatgctggggttacctcacagtccccaccctttcaaagttgacatatggccatcccattggccagaatccacagacacacctaagcctgtggcactgggacagaatagattttccatttgagaggcacttcctgtgtcagtcttgtttgaaggaggtggtgatggtggatagaggtgaaggaggtagggagtgccctccaagtgcaaaaataacaaatatgattattgaccatcggggaattctcacacattgatttgttttttaagcaattgccagaaacccccttttttagcttttgcttggggtgggggtaggagttaaggtttattcaatcctgtcctgggtagggcgaaagttaatctagccatgtgatttttcagaaaagtaagtggaacatgctgccacttttcaattctgtcagtgcttccacatggaaacaaaatgcaataaaatttttccaaaacctgttctgatttagctctctcttgaggtgttacccttagtgggaggccgactatccacaatctacttgagttttctctggttgggtgtttgtttcattgctctgtctcttgaatgaggatactttattttttttgttttaaaatgcatttatggtccctctcttgaaccagcttgccccaccaggcctctttcctttgctttctgcagcctgaatcaattcctttgtgctgatgggctctcctaagagctttcctgagtcagttaactttacctcgtgtctacggtgctattcatgcgatacgggcgaggctgagatgctaagatt

SEQ ID NO: 8111 - DNA, 3226 bp, Homo sapiens
atcaagcccgaccgagcccaccactgcagtgtttgtaagcggtgcattcggaagatggaccaccactgtccctgggtcaacaactgtgtaggcgagaacaaccagaagtacttcgtcctgtttacaatgtacatagctctcatttccttgcacgccctcatcatggtgggattccacttcctgcattgctttgaagaagattggacaaagtgcagctccttctctccacccaccacagtgattctccttatcctgctgtgctttgagggcctgctcttcctcattttcacatcagtgatgtttgggacccaggtgcactccatctgcacagatgagacgggcatcgagcgcctcaaacgaaagaaccagcccagggagcacatggggagctggcagtcagtaaaggagacctttggtggggacttctccctgaactggttcaaccccttctccagaccgtgtcagccagagatccccagtgacaaagacatggtgcggcaggtgacatcgctgtcagacaccgaaacaatggaggatccatcagaggagacaaaggacgaggactctgtggaggtgacagatgaatagatgctgctgtggggagagaagcaaacactaaaaagtgctgtcaaccttcatcctggggttttggctaaaggggcttatgggcatggtgcgctcccagcacccccagtgcttcccttagccactcgcttggccttgccatttcccctccttcttctctccatgttgggccaggtctgggggtcgggagtaggctggggacatcagaggaggatgggggctttctcagagttcatctaagaagagtctgcactgagacggctcatcaagaaccgttctccaagactgggtggctttcacattctccgcccagcaaagggagcttttgaacagggcatcccaggggcagaaaagagcttgcctttggctttccccaggatttctgtcttctcttgggaaggctgggcccctggctcctggctttgagaagtaaggttgtgacagaaggaccgggcagggcttgccttggggacctgggttgggacactgacatcaggggagactagcctggaaagactgcagagctgccagctactccctggaaagggcttccccatgctgcctgccgaaattaggaggtagaggtggctgccacatctacctgcaagggccaggcatggttcaaagaggaccctgcattaagctctacacacacatgtgcaggacatgtccagcatggacagagccagagttaagacagtagcaccgaaaatgagcccccattccacagacactggagtcttcactgagcgagacagctgggagctgtcctgcctgtggctacatatctagccattcacagatgtggatatgggaaggacctctttggagctactggggactccctaaccactcgcatgagaacttaattgaatgttacctcttggagggagtctaataacacatgtaggtagaactgaccataaaccctgcctgtgtgtttgaaaaggccagttctcccaaattggtgcccatcttgtctctgaaaagatgggtgatggccagggtctgctgattgatgaatcagatgaatcaggaagatagacaaacacacacacacacacacacaccccaccaggatgagtctgccctctattcaccccatttgaagcctgtggtgtctgtgaccactgctgaaggtctgagcagcgttctggtgctcctaaaccccattccagtggttgctgaagcagcatcttctgcacaaagcccaacagaagggttcttatccccgtttggtataagaagtggattcaccacccactccctccacgtgcctttgttcctctctttggcccatttccccagcgtctactggcgtcaggattggcaggagcacaggcactcagcagagcatgcccctgcaagacctcagtgttagggccccccttccagctccaggcaaaagggcatgagtcctggccccaaggggcctgtggctgcagttcagaggagaagaaggtcagtgtttggaggtgcagcctcaggatgctgagaaaggaaactggcgaccgtgagaaagaaaagagccaagcagcatcctggttcttggacagcatctttggacactctgtgaagggcaacgatcctgccagagaccgtctctctacaactgatgacccactagggcctggggttaattgctcaaagggcccagtgttcacaaagccacctctgccctaacccttgccagagctctccaactatgacccacgagaggggtgatggtgggattctaacatcaacagagcaaccagaaagacattgggcctcccacactcaggctgcaggcccactttcttggtccttatcagctttaatatttattaatgacgacataggagcccgagtcagctgtaaaggccattaacttgcaatctggacaggaagttgacgctcaccactttgggtaagagctgctctgactgtagggccccctatttgttgtcctaacccagaagcagctctgggctgccaggatggtggatggaataccagagagttcacactagggaggaagcaatgcctgccccctggagtctcctagggggcagcagttagaataagggaagaggatttgctggtcactgtttgctgacatgggtttccatggtgagttcaggcctgaggacagcagtgtctgcaaaaccacatggcccttgagaaatgtccttgcacattgggcttcaaactcctcttctagggaatccatcttggcctgaaagcagaggtacaacaccagccccaaaggcaattctgttttcagattggttgctctggaaaggaaggctggggtgagggggcattttacttgcacagaggctgaccctgcctcccctcttcactgaccccatctccaaggtagacctcagccatgtcagtccctgttctgggaggtgctgggctgggccacagccagggttatgtaggtaattaacctgtccaaccctgagcctcgcctccccacaccagcaacacagtggtctctctgtggtgaccattcacagcataacattctgcttagcctcagactgaaagcattgcaactgatgtcaaaaccagatgagatcttacagggagagagattgggtgcaatttgcctctttctttgaataaaaagctctttgctcaccctcagtga

SEQ ID NO: 8112 - DNA, 2687 bp, Homo sapiens
atcaacctgcgcggcggccgctcctgcagccgcggccgccgccactgccgggagagctcgatgggcttctcctgcgcgccgcccggtgtctggccgagtccagagagccgcggcgcctcgttccgaggagccatcgccgaagcccgaggccgggtcccgggttggggactgcaggggaaggcagcggcggcggcggcgggagccccaccggggtctgggactggggaactgcctccggcttcacgatgccagtatggacagaatagcttatgatgcttatccccacccaccacttccgaaacattgagcggaaaccagaatacctccagccagagaagtgtgtcccacccccctaccctggtcctgtgggaaccatgtggtttatccgtgacggctgtggcatcgcctgtgccatcgttacctggtttctggtcctctatgcggagttcgtggtcctctttgtcatgctgattccatctcgagactacgtgtatagcatcatcaacggaattgtgttcaacctgctggccttcttggccctggcctcccactgccgggccatgctgacggaccccggggcagtgcccaaaggaaatgccactaaagaattcatcgagagtttacagttgaagcctgggcaggtggtgtacaagtgccccaaatgctgcagcatcaagcccgaccgagcccaccactgcagtgtttgtaagcggtgcattcggaagatggaccaccactgtccctgggtcaacaactgtgtaggcgagaacaaccagaagtacttcgtcctgtttacaatgtacatagctctcatttccttgcacgccctcatcatggtgggattccacttcctgcattgctttgaagaagattggacaaagtgcagctccttctctccacccaccacagtgattctccttatcctgctgtgctttgagggcctgctcttcctcattttcacatcagtgatgtttgggacccaggtgcactccatctgcacagatgagacgggaatagaacaattgaaaaaggaagagagaagatgggctaaaaaaacaaaatggatgaacatgaaagccgtttttggccaccccttctctctaggctgggccagcccctttgccacgccagaccaagggaaggcagacccgtaccagtatgtggtctgaaggaccccgaccggcatggccactcagacacaagtccacaccacagcactaccgtcccatccgttctcatgaatgtttaaatcgaaaaagcaaaacaactactcttaaaactttttttatgtctcaagtaaaatggctgagcattgcagagaaaaaaaaaagtccccacattttattttttaaaaaccatcctttcgatttcttttggtgaccgaagctgctctcttttccttttaaaatcacttctctggcctctggtttctctctgctgtctgtctggcatgactaatgtagagggcgctgtctcgcgctgtgcccattctactaactgagtgagacatgacgctgtgcgtggatggaatagtctggacacctggtgggggatgcatgggaaagccaggagggccctgacctcccactgcccaggaggcagtggcgggctccccgatgggacataaaacctcaccgaagatggatgcttaccccttgaggcctgagaagggcaggatcagaagggaccttggcacagcgacctcatcccccaagtggacacggtttgcctgctaactcgcaaagcaattgcctgccttgtactttatgggcttggggtgtgtagaatgattttgcgggggagtggggagaaagatgaaagaggtcttatttgtattctgaatcagcaattatattccctgtgattatttggaagagtgtgtaggaaagacgtttttccagttcaaaatgccttatacaatcaagaggaaaaaaaattacacaatttcaggcaagctacgttttcctttgtttcatctgcttcctctctcaccaccccatctccctctcttccccagcaagatgtcaattaagcagtgtgaattctgactgcaataggcaccagtgcccaacacatacagccccaccatcatccccttctcattttataaacctcaaagtggattcactttctgatagttaacccccataaatgtgcacgtacctgtgtcttatctatattttaacctgggagactgttgtcctggcatggagatgaccatgatgctggggttacctcacagtccccaccctttcaaagttgacatatggccatcccattggccagaatccacagacacacctaagcctgtggcactgggacagaatagattttccatttgagaggcacttcctgtgtcagtcttgtttgaaggaggtggtgatggtggatagaggtgaaggaggtagggagtgccctccaagtgcaaaaataacaaatatgattattgaccatcggggaattctcacacattgatttgttttttaagcaattgccagaaacccccttttttagcttttgcttggggtgggggtaggagttaaggtttattcaatcctgtcctgggtagggcgaaagttaatctagccatgtgatttttcagaaaagtaagtggaacatgctgccacttttcaattctgtcagtgcttccacatggaaacaaaatgcaataaaatttttccaaaacc

SEQ ID NO: 8113 - DNA, 1259 bp, Homo sapiens
aagtctcgtatcgcgcccgggaggcgccggagcccagcggctggcgccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcc

SEQ ID NO: 8114 - DNA, 1942 bp, Homo sapiens
ccgcctccgcggggctgtgggaagcttgggctgtcccaggaccgtcagtctcctcctctgaccctccctttccccttgtgtgtagggccgccgtcccacccccacctcgcccgagtccggggcggccccggtgtcccctccgagcctgctgcactccacgtccccctaccagggctccagcccccagggaaatctccgaccaggcccgcccaggaggtattctgcctttgactgcaactcttgtcgtcttatgtgggtgttgaattgatctgtctctgcagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaagcatggcttgtttgttttgatttctgctgtgcttataaatcactttcggtgggcaagggagagaggggaaaatgggtgttgactgaggaatcccccttgcttgtcttcttttgaaaccgggcatctctgaagtcctggtgtcaaggggatcaagagatgacttctcagaggttctaggtgatgctgagaccttggtgtctctaaactctgggcatgtggacaggaggggcttgcggccgtgtctctgacctgtgtgatgtgcaggagggtctcattgactcagcgcctgcgcgttgtgcctggctgtgctctcttttatgccccctctattctcctctctcccccaggggattttcatctcaacaacagagtgtcctcacccaggcctgccttccggc

SEQ ID NO: 8115 - DNA, 1461 bp, Homo sapiens
gatgtcacgagcccgcaggaagtctcgtatcgcgcccgggaggcgccggagcccagcggctggcgggccgccgtcccacccccacctcgcccgagtccggggcggccccggtgtcccctccgagcctgctgcactccacgtccccctaccagggctccagcccccagggaaatctccgaccaggcccgcccaggagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaagc

SEQ ID NO: 8116 - DNA, 1485 bp, Homo sapiens
cccgggaggcgccggagcccagcggctggcggtaaggccgcctccgcggggctgtgggaagcttgggctgtcccaggaccgtcagtctcctcctctgaccctccctttccccttgtgtgtagggccgccgtcccacccccacctcgcccgagtccggggcggccccggtgtcccctccgagcctgctgcactccacgtccccctaccagggctccagcccccagggaaatctccgaccaggcccgcccaggagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatgtaggctgggtaccctgaatcaccccctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtat

SEQ ID NO: 8117 - DNA, 1552 bp, Homo sapiens
gatgtcacgagcccgcaggaagtctcgtatcgcgcccgggaggcgccggagcccagcggctggcggtaaggccgcctccgcggggctgtgggaagcttgggctgtcccaggaccgtcagtctcctcctctgaccctccctttccccttgtgtgtagggccgccgtcccacccccacctcgcccgagtccggggcggccccggtgtcccctccgagcctgctgcactccacgtccccctaccagggctccagcccccagggaaatctccgaccaggcccgcccaggagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttgagctgtagttcccgtttatttacacatgtggatcctcgttttccaagc

SEQ ID NO: 8118 - DNA, 1348 bp, Homo sapiens
gatgtcacgagcccgcaggaagtctcgtatcgcgcccgggaggcgccggagcccagcggctggcggtattctgcctttgactgcaactcttgtcgtcttatgtgggtgttgaattgatctgtctctgcagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgcagtgtgtgtaactggtgtgtgcaccgtttcgaccatcactgtgtttgggtgaacaactgcatcggggcctggaacatcaggtacttcctcatctacgtcttgaccttgacggcctcggctgccaccgtcgccattgtgagcaccacttttctggtccacttggtggtgatgtcagatttataccaggagacttacatcgatgaccttggacacctccatgttatggacacggtctttcttattcagtacctgttcctgacttttccacggattgtcttcatgctgggctttgtcgtggttctgagcttcctcctgggtggctacctgttgtttgtcctgtatctggcggccaccaaccagactactaacgagtggtacagaggtgactgggcctggtgccagcgttgtccccttgtggcctggcctccgtcagcagagccccaagtccaccggaacattcactcccatgggcttcggagcaaccttcaagagatctttctacctgcctttccatgtcatgagaggaagaaacaagaatgacaagtgtatgactgcctttga

SEQ ID NO: 8119 - DNA, 807 bp, Homo sapiens
ggagcccagcggctggcgggccgccgtcccacccccacctcgcccgagtccggggcggccccggtgtcccctccgagcctgctgcactccacgtccccctaccagggctccagcccccagggaaatctccgaccaggcccgcccaggagccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttctacctggcttcggtgctgatgggtcttgttcttatctgcgtctgctcgaaaacccatagcttgaaaggcctggccaggggaggagcacagatattttcctgtataattccagaatgtcttcagagagccgtgcatggattgcttcattaccttttccatacgagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggcattataacaaaagcaaatgaattattatttcttcatgtttatgaatttgatgaagtgatgtttccaaagaacgtgaggtgctctacttgtgatttaaggaaaccagctcgatccaagcactgca

SEQ ID NO: 8120 - DNA, 4666 bp, Homo sapiens
ggggttgggcgcggcagcgcgagccgcatgaatgagacaaacgtgcgccgcgcgagacgtcgcgcgagcccggactagggagccaatgggaacgctggaagggttcgagacccggcactgagggcaacggccgcgcgccggctccgagacgagcgacgcctggcgggagcgcgcggcagcggggcgggcgtggagcgtgcgggggccgcgcgctgcttctctgaggcaggacggcactgccgggaggcggcggtgacaacgacggcggtggtgacgggcaccgggctcgcgggtgagacacagtaacctggttgaactctgcatctggaaagctgaagactgaagaaagataagagacattgactagtctggaaacagggacatctttggaacttcgttttcatccacagtaaacttttgaagtgtcatcaattggaattgatttcttcatcttattctgcctattgggaagaacatggcttcaaggattttaagtttccctttagttttacatgaactttgtaggaaacagagcccttaaagggcttgggaataacaagaagagattgaagacagagaagcttgccctgttttccttgccccttcaaagaaaaggatttacagctcaaacttagaacagctgttgtccagctttagccatcaagagagaaataaattaaaccaccattgccagactacaagccctggtgaagtcagggtgtgggagtggtggcattgagaagactacctaaaagagacaaagactgcagtaaacaaagctcctctttaaagttggaaggggcctcaggttccttcttggattgaaatagaaatagaaacacagggcacacctcttttaggtgcagctcacattttatggaactgtagtcgtggaggtactatagtatctcagaagaatttttctttgcccaaagtttttttgccataccctgatattctctccttcttttgaagacctgcctccatccatgagctgtatcttgatctgtctgactgtccatgttttccacctgcaaccatttgcatgtgtacagcctactgtttgtctccagtttttaaactgtacaagttgtgtttcttaatcttcccttctgccttgttctggggaggtggttattcatcatttggaatcacctttccccctcccatgtgctttccttcatttgagatcttttgacctttggctttatttgggagggggaagggtgataaagttttctgtttccctggttttcttttgtactcctctctgttgcttccctcctcccattttcttgtctgttctgccgctgtgtgggcctgggctatgcggcagggcagatttcccatcagagctccaacatgcccgcagagtctggaaagagattcaaacccagcaagtatgtcccggtctctgcagccgccatcttcctagtgggagctacgacactcttctttgcctttacgtgtccaggactaagcctgtatgtgtcacctgcagtgcccatctacaatgcaattatgtttctctttgtgttggccaacttcagcatggccaccttcatggacccagggattttccctcgagctgaggaggatgaggacaaggaagatgatttccgagctcccctttacaaaacagtggagataaagggcatccaggtgcgcatgaaatggtgtgccacctgccgcttttaccgtccccctcgatgttcccactgcagtgtctgtgacaactgtgtggaggaatttgatcatcactgcccctgggtgaataactgtattggtcgccggaactaccgttattttttccttttcctcctttccctgacagcccacattatgggtgtgtttggctttggcctcctttatgtcctctaccacatagaggaactctcaggggtccgcacggctgtcacaatggcagtaatgtgtgtggctggcttattcttcatccctgtagctggcctcacgggatttcacgtggttctggtggccaggggacgcacaaccaatgaacaggttacgggtaaattccggggaggtgtgaaccccttcaccaatggctgctgtaacaatgtcagccgtgttctctgcagttctccagcacccaggtatttggggagaccaaagaaagagaagacaattgtaatcagacctcccttccttcgaccagaagtttcagatgggcagataactgtgaagatcatggataatggcatccagggagagctgaggagaacaaagtctaagggaagcctggagataacagagagccagtctgcagatgctgaacctccacctcctcctaagccagacctgagccgttacacagggttgcgaacacacctcggcttggctactaatgaggatagtagcttattggccaaggacagccccccgacacctaccatgtacaagtatcggccgggttacagtagcagcagtacgtcagctgccatgccgcattcctccagcgccaagttgagtcgtggggacagcttgaaggagccaacctcaattgcagagagcagccgtcaccccagctaccgctcagagcccagcttggaaccagagagcttccgttctcctacctttggcaaaagttttcacttcgatccactatccagtggctcacgctcctccagcctcaagtcagcccagggcacaggctttgagctgggccagttgcaatccattcgttcagagggcaccacctccacctcctataagagcctggccaaccagacacgcaatggaagcctatcttatgacagcttgctcacaccttcagacagccctgattttgagtcagtgcaggcagggcctgagccagacccacctttaggctatacctctcccttcctgtcagccaggctggcccagcaacgggaagctgagaggcacccacgtttggtgccaactggcccaacacaccgagagccctcaccagtccgttacgacaatctgtcgcgccacattgtggcctctctccaggaacgagagaagttgctgcgccagtcacccccactcccgggccgtgaggaagaaccaggcttgggggactcaggcattcagtcaacaccaggctcgggccatgcccctcgtactagttcctcctcagatgattcaaagagatcacctttgggcaagactccactgggacgcccagctgtcccccgttttggcaagccagatgggctaaggggccggggagtagggtcccctgaaccaggcccaacagccccatacctgggccgatcgatgtcttacagcagccaaaaagcccaacctggtgtctctgagacagaagaagtggccttgcagccattactgacacccaaagatgaagtacagctgaagaccacctacagcaaatccaacgggcagcccaagagcttaggctcagcctcccctggcccaggccagccacctctcagtagccccacgaggggaggagtcaagaaggtgtcaggggttggtggtaccacctatgagatttcggtgtgagccttcggcacctcccctccccaacgcctctgcgcctacaccaaagggccccaggtggccaccttccttccctcaaggggctcccctcccgtgcatggacattttttaaaccaccgattccaagaggatgaggagtgttttctaaaatgcagtaggcttggggagtcggagagttggggccctgagactggggtagcaacccccccttttatcttttaagaccttcccttccttgatccctggaccagactcagtggacatttgtgcaattgctcgccctggagggaaccagatcatttttaaaccagaaataattttttttattattgttacggattctatttttttcctcttctgcgttaccaggtgtgtgtgtacatataatatatatatatatatattataaatatcaaagaaattatatatctatcctgggatgggaaaatgagggagggatacatatacggagggggatcttactcttcccattcctcagaccagcaggaaaagaggggagacgtcagtctttttcctgtggttccctctcatttgtcccagttactaactacggaaatagcatcctctgctggtgctaagtgtgattaggaagaagcctggggagaggtgagtctggaattttggtcacaagagggaaggacttggagaggagaattagttttctaggctcattggcatttagtttccctaggaaaggggtcaaaacttcaagacactggtggtggtgggagatcaggaaaataacttggcctagctcaaacaatattggataatcccctccttgggggagagggattagagtgtgctcctactggccccttggagcctcccctagcttacacagttaacttgattttaaaatccaaggccaggagagaagaatccaaaaagcaatatttttcatcacatgccaaaaacgggggatagagagaaggagtggcaggcctaggcccctccgattgtcccttgggggttacccctcagcccacctcactatggtgctgggtagaggggatacctgggttctaacctctaaataggggagatcccagcctccacaaagaggcccttttattttttattctgattagccattttaaaccaacgaggaataaaaagaaatcctgatctaaccagc

SEQ ID NO: 8121 - DNA, 2817 bp, Homo sapiens
cttacgtgcgcgctctcgtcttctcgcgtgcgtacgtcgttgtgttgctgcagccaatcaggccgcgaggtcgccgcggtcgccagggttcgcgcgcacgccccagatcggagtcggggtgggggctatgggtgaatgggagagtgagcggggttgggcgcggcagcgcgagccgcatgaatgagacaaacgtgcgccgcgcgagacgtcgcgcgagcccggactagggagccaatgggaacgctggaagggttcgagacccggcactgagggcaacggccgcgcgccggctccgagacgagcgacgcctggcgggagcgcgcggcagcggggcgggcgtggagcgtgcgggggccgcgcgctgcttctctgaggcaggacggcactgccgggaggcggcggtgacaacgacggcggtggtgacgggcaccgggctcgcgggtgtccaggactaagcctgtatgtgtcacctgcagtgcccatctacaatgcaattatgtttctctttgtgttggccaacttcagcatggccaccttcatggacccagggattttccctcgagctgaggaggatgaggacaaggaagatgatttccgagctcccctttacaaaacagtggagataaagggcatccaggtgcgcatgaaatggtgtgccacctgccgcttttaccgtccccctcgatgttcccactgcagtgtctgtgacaactgtgtggaggaatttgatcatcactgcccctgggtgaataactgtattggtcgccggaactaccgttattttttccttttcctcctttccctgacagcccacattatgggtgtgtttggctttggcctcctttatgtcctctaccacatagaggaactctcaggggtccgcacggctgtcacaatggcagtaatgtgtgtggctggcttattcttcatccctgtagctggcctcacgggatttcacgtggttctggtggccaggggacgcacaaccaatgaacaggttacgggtaaattccggggaggtgtgaaccccttcaccaatggctgctgtaacaatgtcagccgtgttctctgcagttctccagcacccaggtatttggggagaccaaagaaagagaagacaattgtaatcagacctcccttccttcgaccagaagtttcagatgggcagataactgtgaagatcatggataatggcatccagggagagctgaggagaacaaagtctaagggaagcctggagataacagagagccagtctgcagatgctgaacctccacctcctcctaagccagacctgagccgttacacagggttgcgaacacacctcggcttggctactaatgaggatagtagcttattggccaaggacagccccccgacacctaccatgtacaagtatcggccgggttacagtagcagcagtacgtcagctgccatgccgcattcctccagcgccaagttgagtcgtggggacagcttgaaggagccaacctcaattgcagagagcagccgtcaccccagctaccgctcagagcccagcttggaaccagagagcttccgttctcctacctttggcaaaagttttcacttcgatccactatccagtggctcacgctcctccagcctcaagtcagcccagggcacaggctttgagctgggccagttgcaatccattcgttcagagggcaccacctccacctcctataagagcctggccaaccagacacgcaatggaagcctatcttatgacagcttgctcacaccttcagacagccctgattttgagtcagtgcaggcagggcctgagccagacccacctttaggctatacctctcccttcctgtcagccaggctggcccagcaacgggaagctgagaggcacccacgtttggtgccaactggcccaacacaccgagagccctcaccagtccgttacgacaatctgtcgcgccacattgtggcctctctccaggaacgagagaagttgctgcgccagtcacccccactcccgggccgtgaggaagaaccaggcttgggggactcaggcattcagtcaacaccaggctcgggccatgcccctcgtactagttcctcctcagatgattcaaagagatcacctttgggcaagactccactgggacgcccagctgtcccccgttttggcaagccagatgggctaaggggccggggagtagggtcccctgaaccaggcccaacagccccatacctgggccgatcgatgtcttacagcagccaaaaagcccaacctggtgtctctgagacagaagaagtggccttgcagccattactgacacccaaagatgaagtacagctgaagaccacctacagcaaatccaacgggcagcccaagagcttaggctcagcctcccctggcccaggccagccacctctcagtagccccacgaggggaggagtcaagaaggtgtcaggggttggtggtaccacctatgagatttcggtgtgagccttcggcacctcccctccccaacgcctctgcgcctacaccaaagggccccaggtggccaccttccttccctcaaggggctcccctcccgtgcatggacattttttaaaccaccgattccaagaggatgaggagtgttttctaaaatgcagtaggcttggggagtcggagagttggggccctgagactggggtagcaacccccccttttatcttttaagaccttcccttccttgatccctggaccagactcagtggacatttgtgcaattgctcgccctggagggaaccagatcatttttaaaccagaaataattttttttattattgtta

SEQ ID NO: 8122 - DNA, 1721 bp, Homo sapiens
gggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggataccatgtatctccagtattgtaaagtctgccaagcatacaaggcaccacgttcacatcactgcagaaagtgtaacagatgtgtgatgaagatggaccatcactgtccttggatcaacaactgttgtggttaccaaaatcatgcttcgttcacactgtttctccttttagcaccactgggttgtatccatgctgctttcatttttgtgatgactatgtacacacagctttatcatcggctctcctttgggtggaacacagtgaagatcgacatgagtgcagcccggagagatcctcttccaattgttccatttggattagctgcatttgctaccaccttgtttgccttgggattagctttaggaacaaccatagctgttgggatgttgttttttatccagatgaaaataattctcagaaacaaaacttctattgagtcatggattgaagagaaggctaaagatcgaattcagtattatcaactagatgaagtctttgtttttccatatgatatgggaagtagatggaggaactttaaacaggtatttacgtggtcaggggtccctgaaggagatggacttgagtggccagtaagagaaggctgtcaccaatacagcttaacaatagaacagttgaaacaaaaagcagataagagagtcagaagtgttcgctataaagtaatagaagattatagtggtgcctgctgccctctgaataaaggaatcaaaaccttcttcacaagtccctgcaccgaagagcctcgaatacagctgcaaaaaggggaattcattttagccacaagaggtttacgatactggttatatggagacaaaattcttgatgattcctttatagaaggtgtttcaagaataaggggttggttccctagaaaatgtgtggaaaagtgtccctgtgatgctgaaacagatcaagccccagagggggagaagaaaaatagatagctgctgttaaaacaaaattatcctttaagtctgcttaattacttgaaaattgtacatattactaaagaattatgcaatga

SEQ ID NO: 8123 - DNA, 2170 bp, Homo sapiens
agagtcctggcgagggcgctggccgagaggtgctcggcttgtagcaggtcccgcactccagcctctcgctgccagggtttgctctctgcttgtcctgggctgaggtgtccatgacggagtcatccaaggaggaaaaaatctgttccgggtgagcccaggccgccccggatatgcgatggctgaggagcagacaccagggaccacactgaggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggaaatttctcaggataccatgtatctccagtattgtaaagtctgccaagcatacaaggcaccacgttcacatcactgcagaaagtgtaacagatgtgtgatgaagatggaccatcactgtccttggatcaacaactgttgtggttaccaaaatcatgcttcgttcacactgtttctccttttagcaccactgggttgtatccatgctgctttcatttttgtgatgactatgtacacacagctttatcatcggctctcctttgggtggaacacagtgaagatcgacatgagtgcagcccggagagatcctcttccaattgttccatttggattagctgcatttgctaccaccttgtttgccttgggattagctttaggaacaaccatagctgttgggatgttgttttttatccagatgaaaataattctcagaaacaaaacttctattgagtcatggattgaagagaaggctaaagatcgaattcagtattatcaactagatgaagtctttgtttttccatatgatatgggaagtagatggaggaactttaaacaggtatttacgtggtcaggggtccctgaaggagatggacttgagtggccagtaagagaaggctgtcaccaatacagcttaacaatagaacagttgaaacaaaaagcagataagagagtcagaagtgttcgctataaagtaatagaagattatagtggtgcctgctgccctctgaataaaggaatcaaaaccttcttcacaagtccctgcaccgaagagcctcgaatacagctgcaaaaaggggaattcattttagccacaagaggtttacgatactggttatatggagacaaaattcttgatgattcctttatagaaggtgtttcaagaataaggggttggttccctagaaaatgtgtggaaaagtgtccctgtgatgctgaaacagatcaagccccagagggggagaagaaaaatagatagctgctgttaaaacaaaattatcctttaagtctgcttaattacttgaaaattgtacatattactaaagaattatgcaatgagcctactctggttaagatgttcttttcctcaaaggtgccctagtgccatgatttaaatatttttattaccattttgaaatggagaagccattctgcatatgcctttgaattcctgcccctctttaccacctcttcctccccctcaaaggaaaaacatttcatccaagtaagttaacggcattttctgtaggattttcttatgcactgcacactctggacctcacctgcagatacagttccccccttgccaggagcatctgcatgtggtacttctcttttccctcagttgatatttcttatatgatattctagatactatagaactcaatttgtcagattcagtataacctcagattttgttacctgtcttttaaaaatgcagattttgtcaaatcaaataaagatcaatggatgttgggtataa

SEQ ID NO: 8124 - DNA, 3442 bp, Homo sapiens
acttccggcgctcgcaccgccccgctctccagccaaggctccgggctgaggcatttgcttggctgcagcctccttccgacctgcccggcgggacccaggggaccaagccgagccgagccgcggggcccgctccagcccggccatgagcgcggccgcatgatgcgtccctgcctcggccgctgcagtcgccgccgccgccgccgcaggccgggaggagccgcagcgccgggcgaccccgcccgggcctcggatccgatcacataggacagtatgcaccttaagatcctgaagaaacggcacaaaatgttcaagtgatgtttagaaataacttgtgagggtgcgtcagggaaatcatgcagccatcaggacacaggctccgggacgtcgagcatcatcctctcctggctgaaaatgacaactatgactcttcatcgtcctcctcctccgaggctgacgtggctgaccgggtctggttcatccgtgacggctgcggcatgatctgtgctgtcatgacgtggcttctggtcgcctatgcagacttcgtggtgactttcgtcatgctgctgccttccaaagacttctggtactctgtggtcaacggggtcatctttaactgcttggccgtgcttgccctgtcatcccacctgagaaccatgctcaccgaccctggggcagtacccaaaggaaacgctacgaaagaatacatggagagcttgcagctgaagcccggggaagtcatctacaagtgccccaagtgctgctgtattaaacccgagcgcgcccaccactgcagtatttgcaaaagatgtattcggaaaatggatcatcactgcccgtgggtgaacaattgtgtaggagaaaagaatcaaagattttttgtgctcttcactatgtatatagctctgtcttcagtccatgctctgatcctttgtggatttcagttcatctcctgtgtccgagggcagtggactgaatgcagtgatttttcacctccgataactgtaatcctgttgatcttcctgtgccttgagggtcttctgtttttcactttcactgcagttatgtttggcacccaaatccactccatatgcaacgacgagacggagatcgagcgattgaaaagtgagaagcccacatgggagcggaggctgcgatgggaagggatgaagtccgtctttggggggcccccctcactcctctggatgaatccctttgtgggcttccgatttaggcgactgcccacgagacccagaaaaggtggcccggagttctcagtgtgaggcgtggctcatcagactgaaacttgctcacagacttccagttatttatttggggtctgaaggatatcaacagctcatctgtgaccaacagggcaactggaacctacacaaaccaattgcttgcagcaagcagagttttatatatttatagtcacagatggcagaggaagaggctctcagtccccacctgtacaacaacggaaaggtgtgtggccacacgaagaagccaaacgccgtggcctcctgcagagctggggcttctgtggagaatacttcgggttattacatgggttattcaaatcctgggtcctgagctgctgtttccaatcatgaagaaaaacagtgaatccagtgaacagggattctccaagcagtcatttcagggggctcctgctgaccccgccactcagcagtgcactccccggatcacagcagggcgtttacatagaaagacgttttggtctcgattagctccgatgctttgcactgaagttgcaaaagatctgtgcactgaacagtgaaggtggcttccggcacactccccgctgccccggaagagacatcctttgaccctctcagcaagtctgtgtgtgtgcgtgtctgtgcgtgtgcgcgcgtgtgtgcatgtgtgtcaaaattgccagtgttgtttaggcaatgtaacatttaccggctgtgtacagcaaacaagctattttttagaaaccgacgtttcagggaagaggggagagagccgcggggtcctgcccgtggttactatgaatgtattgctgttggaggacatctcgatccaaagaacagccgttcctgtgcggcccttcgttgccctcctgctttcattttttaaagaaatcttgagtgcttgagggccttggaactgattttttttttttgttccagccaaattagcagtgtataaatggcacctaggtaagagcagagctgcggctcggtgacttgatacttggggcagcccgatgctgtgtgtggggcaggggaggcatccttactggagaggcagggcccagccattgggcacctctgggaaggggaggggaccatgaggcagccagcccctggcaggggcgactgtgccaccgcaggcagcgctccagtcgggaatggccaggatggcgccctcttgttggagtttttggttagcttttacgttttcttctccacccacggcacaggtgataaaataggatccttggtgcggagcttaaaattatgccagaaagccaacagctcccctcgtggggccttgccttaaacttgcctggtttgtacattttttgccggacgcatcaagaagcaatctgtgacaaagtctgagggtcttcctttatgcttgccctccacactaagagaagttggcgtctccctcctgggaattgttttgcctttctgttcatctgtgaactgttttttgtttttaattactctgtaccccatccgaatcagggcttctaccactgctgatgcaaaaccacaaagggacctacctgagccaccgtcctagccaagcgagcaaacctgcagggggtttggaagtggacttggtcaccgcagaagcgtgtgcgccgttgggggaagagctgcgtcacagccagagggacaaagtgtgggtgatcctggagacgccagtttccgagattgttctgcatattcatttgcacattgttgtctgggttggacatgcgtgtgggcttcagtgtgaggcttttaatatgtatatcctgttatcaataaaacaattatccaagtggttgaatcctgtgagacttggcaagtgtgtgcaaatcaagtatacttgacttttcaacctcttctttcaatgtaacttttatatgaaataaagtaatcaattaacagttctcaaatggcttccaaagcgcccgttcttcctggatggtggtgttttcagggggtgcctttccgtgcttcgtgggcccagccccaggctgttaaggtcactcccaaacagtttccagaaactctaaatgcttttgtgcccatgacaagtgacctgggcactcaagcgcgactcacaaatgttgcccagtgagtactgttgcttgttgaatgtttaattcgactcccatcgttttacttagtcctttttttagtgcacgttgaaataaaaacaatgtttcaaaatc

SEQ ID NO: 8125 - DNA, 3271 bp, Homo sapiens
acttccggcgctcgcaccgccccgctctccagccaaggctccgggctgaggcatttgcttggctgcagcctccttccgacctgcccggcgggacccaggggaccaagccgagccgagccgcggggcccgctccagcccggccatgagcgcggccgcatgatgcgtccctgcctcggccgctgcagtcgccgccgccgccgccgcaggccgggaggagccgcagcgccgggcgaccccgcccgggcctcggatccgatcacataggacagtatgcaccttaagatcctgaagaaacggcacaaaatgttcaagtgatgtttagaaataacttgtgagggtgcgtcagggaaatcatgcagccatcaggacacaggctccgggacgtcgagcatcatcctctcctggctgaaaatgacaactatgactcttcatcgtcctcctcctccgaggctgacgtggctgaccgggtctggttcatccgtgacggctgcggcatgatctgtgctgtcatgacgtggcttctggtcgcctatgcagacttcgtggtgactttcgtcatgctgctgccttccaaagacttctggtactctgtggtcaacggggtcatctttaactgcttggccgtgcttgccctgtcatcccacctgagaaccatgctcaccgaccctgaaaaatccagtgactgccgaccatctgcctgcacagtgaaaactgggctggacccaacccttgtgggcatttgtggtgagggaaccgagtctgtgcaaagcctcctgcttggggcagtacccaaaggaaacgctacgaaagaatacatggagagcttgcagctgaagcccggggaagtcatctacaagtgccccaagtgctgctgtattaaacccgagcgcgcccaccactgcagtatttgcaaaagatgtattcggaaaatggatcatcactgcccgtgggtgaacaattgtgtaggagaaaagaatcaaagattttttgtgctcttcactatgtatatagctctgtcttcagtccatgctctgatcctttgtggatttcagttcatctcctgtgtccgagggcagtggactgaatgcagtgatttttcacctccgataactgtaatcctgttgatcttcctgtgccttgagggtcttctgtttttcactttcactgcagttatgtttggcacccaaatccactccatatgcaacgacgagacggagatcgagcgattgaaaagtgagaagcccacatgggagcggaggctgcgatgggaagggatgaagtccgtctttggggggcccccctcactcctctggatgaatccctttgtgggcttccgatttaggcgactgcccacgagacccagaaaaggtggcccggagttctcagtgtgaggcgtggctcatcagactgaaacttgctcacagacttccagttatttatttggggtctgaaggatatcaacagctcatctgtgaccaacagggcaactggaacctacacaaaccaattgcttgcagcaagcagagttttatatatttatagtcacagatggcagaggaagaggctctcagtccccacctgtacaacaacggaaaggtgtgtggccacacgaagaagccaaacgccgtggcctcctgcagagctggggcttctgtggagaatacttcgggttattacatgggttattcaaatcctgggtcctgagctgctgtttccaatcatgaagaaaaacagtgaatccagtgaacagggattctccaagcagtcatttcagggggctcctgctgaccccgccactcagcagtgcactccccggatcacagcagggcgtttacatagaaagacgttttggtctcgattagctccgatgctttgcactgaagttgcaaaagatctgtgcactgaacagtgaaggtggcttccggcacactccccgctgccccggaagagacatcctttgaccctctcagcaagtctgtgtgtgtgcgtgtctgtgcgtgtgcgcgcgtgtgtgcatgtgtgtcaaaattgccagtgttgtttaggcaatgtaacatttaccggctgtgtacagcaaacaagctattttttagaaaccgacgtttcagggaagaggggagagagccgcggggtcctgcccgtggttactatgaatgtattgctgttggaggacatctcgatccaaagaacagccgttcctgtgcggcccttcgttgccctcctgctttcattttttaaagaaatcttgagtgcttgagggccttggaactgattttttttttttgttccagccaaattagcagtgtataaatggcacctaggtaagagcagagctgcggctcggtgacttgatacttggggcagcccgatgctgtgtgtggggcaggggaggcatccttactggagaggcagggcccagccattgggcacctctgggaaggggaggggaccatgaggcagccagcccctggcaggggcgactgtgccaccgcaggcagcgctccagtcgggaatggccaggatggcgccctcttgttggagtttttggttagcttttacgttttcttctccacccacggcacaggtgataaaataggatccttggtgcggagcttaaaattatgccagaaagccaacagctcccctcgtggggccttgccttaaacttgcctggtttgtacattttttgccggacgcatcaagaagcaatctgtgacaaagtctgagggtcttcctttatgcttgccctccacactaagagaagttggcgtctccctcctgggaattgttttgcctttctgttcatctgtgaactgttttttgtttttaattactctgtaccccatccgaatcagggcttctaccactgctgatgcaaaaccacaaagggacctacctgagccaccgtcctagccaagcgagcaaacctgcagggggtttggaagtggacttggtcaccgcagaagcgtgtgcgccgttgggggaagagctgcgtcacagccagagggacaaagtgtgggtgatcctggagacgccagtttccgagattgttctgcatattcatttgcacattgttgtctgggttggacatgcgtgtgggcttcagtgtgaggcttttaatatgtatatcctgttatcaataaaacaattatccaagtggttgaatcctgtgagacttggcaagtgtgtgcaaatcaagtatacttgacttttcaacctcttctttcaatgtaacttttatatgaaataaagtaatcaattaacagttctc

SEQ ID NO: 8126 - DNA, 6773 bp, Homo sapiens
ctctgcgctgcccggtggggcggggaaagaagccctgagccgggatctggcactcccaggactcccggccggggtagctcttcactcctcagcgcgacgtcgtgtcgagttcccaaaaagctccgcaggggctgtagggaggcatacaagaattaaattctgaataagtctgcaggtaggatggacagttattttaaagcagctgtcagtgacttggacaaactccttgatgattttgaacagaacccagatgaacaagattatctccaagatgtacaaaatgcatatgattctaaccactgctcagtttcttcagagttggcttcctcacagcgaacttcattgctcccaaaagaccaagagtgcgttaatagttgtgcctcatcagaaacaagctatggaacaaatgagagttccctgaatgaaaaaacactcaagggacttacttctatacaaaatgaaaaaaatgtaacaggacttgatcttctttcttctgtggatggtggtacttcagatgaaatccagccgttatatatgggacgatgtagtaaacctatctgtgatctgataagtgacatgggtaacttagttcatgcaaccaatagtgaagaagatattaaaaaattattgccagatgattttaagtctaatgcagattccttgattggattggatttatcttcagtgtcagatactccctgtgtttcttcaacagaccatgatagtgatactgtcagagaacaacagaatgatatcagttctgaattacaaaatagagaaatcggaggaatcaaagaattgggtataaaagtagatacaacactttcagattcctataattacagtggaacagaaaatttaaaagataaaaagatctttaatcagttagaatcaattgttgattttaacatgtcatctgctttgactcgacaaagttccaaaatgtttcatgccaaagacaagctacaacacaagagccagccatgtggattactaaaagatgttggcttagtaaaagaggaagtagatgtggcagtcataactgccgcagaatgtttaaaagaagagggcaagacaagtgctttgacctgcagccttccgaaaaatgaagatttatgcttaaatgattcaaattcaagagatgaaaatttcaaattacctgacttttcctttcaggaagataagactgttataaaacaatctgcacaagaagactcaaaaagtttagaccttaaggataatgatgtaatccaagattcctcttcagctttacatgtttccagtaaagatgtgccgtcctcattgtcctgtcttcctgcgtctgggtctatgtgtggatcattaattgaaagtaaagcacggggtgattttttacctcagcatgaacataaagataatatacaagatgcagtgactatacatgaagaaatacagaacagtgttgttctaggtggggaaccattcaaagagaatgatcttttgaaacaggaaaaatgtaaaagcatactccttcagtcattaattgaagggatggaagacagaaagatagatcctgaccagacagtaatcagagctgagtctttggatggtggtgacaccagttctacagttgtagaatctcaagaggggctttctggcactcatgtcccagagtcttctgattgttgtgaaggttttattaatactttttcaagcaatgatatggatgggcaagacttagattactttaatattgatgaaggcgcaaaaagtggcccactaattagtgatgctgaacttgatgcctttctgacagaacagtatcttcagaccactaacataaagtcttttgaagaaaatgtaaatgactctaaatcgcaaatgaatcagatagatatgaaaggcttagatgatggaaacatcaataatatatatttcaatgcagaagcaggagctattggggaaagtcatggtattaatataatttgtgaaatagttgataaacaaaatacaatagaaaatggcctttctttaggagaaaaaagcactattccagttcaacaagggttacctaccagtaagtctgagattacaaatcaattatcggtctctgatattaacagtcaatctgttggaggggccagacctaagcaattgtttagccttccatcaagaacaaggagttcaaaggacctgaataagccagatgttccagatacaatagaaagtgaacccagcacagcagataccgttgttccaatcacttgtgctatagattctacagctgatccacaggttagcttcaactctaattacattgatatagaaagtaattctgaaggtggatctagtttcgtaactgcaaatgaagattctgtacctgaaaacacttgcaaagaaggcttggttttgggccagaaacagcctacttgggttcctgattcagaagctccaaactgtatgaactgccaagtcaaatttacttttaccaaacggcgacaccattgccgagcatgtgggaaagtattttgtggtgtctgttgtaataggaagtgtaaactgcaatatctagaaaaggaagcaagagtatgtgtagtctgctatgaaactattagtaaagctcaggcatttgaaaggatgatgagtccaactggttctaatcttaagtctaatcattctgatgaatgtactactgtccagcctcctcaggagaaccaaacatccagtataccttcaccagcaactttgccagtctcagcacttaaacaaccaggtgttgaaggactatgttccaaagaacagaagagagtatggtttgcagatggtatattgcccaatggtgaagttgcagatacaacaaaattatcatctggaagtaaaagatgttctgaagactttagtcctctctcacctgatgtgcctatgacagtaaacacagtggatcattcccattctactacagtggaaaagccaaacaatgagacaggagatattacaagaaatgagataattcagagtcctatttctcaggttccatcagtggaaaaattgtctatgaacacaggaaatgaggggttacctacttctggttcatttacactagatgatgatgtttttgcagaaactgaagaaccatctagtcctactggtgtcttagttaacagcaatttacctattgctagtatttcagattataggttactgtgtgatattaacaagtatgtctgcaataagattagtcttctacctaatgatgaggacagtttgcccccacttctggttgcatctggagaaaagggatcagtgcctgtagtagaagaacatccatctcatgagcagatcattttgcttcttgaaggtgaaagctttcatcctgttacatttgtcctaaatgctaatctactcgtgaatgtcaaattcatattttattcctcagacaaatattggtacttttcaaccaatggattgcatggcttgggacaggcagaaattattattctattgttatgtttgccaaatgaagatactattcctaaggacatcttcagactatttatcaccatatataaggatgctctaaaaggaaaatacatagaaaacttggacaatattacctttactgagagttttctcagtagcaaggatcacggaggattcctgtttattacacctacttttcagaaacttgatgatctctcattaccaagtaatccttttctttgtggaattcttatccagaagcttgagattccctgggcaaaggtttttcctatgcgtttaatgttgagattgggtgcagaatataaagcatatcctgctcctctaacaagcatcagaggccgaaaacctctttttggagaaataggacacactattatgaacttacttgttgaccttcgaaattaccagtataccttgcataatatagatcaactgttgattcatatggaaatgggaaaaagctgcataaaaataccacggaaaaagtacagtgatgtaatgaaagtactaaattcttccaatgagcatgtcattagcattggagcaagtttcagtacagaagcagattctcatctagtctgtatacagaatgatggaatttatgaaacacaggccaacagtgccactggccatcctagaaaagtgacaggtgcaagttttgtggtattcaatggagctctaaaaacatcttcaggatttcttgctaagtccagcatagttgaagatggcttaatggtacaaataactccagagaccatgaatggcttgcggctagctttacgagaacagaaagactttaaaattacatgtgggaaagttgatgcagtagacctgagagaatacgtggatatctgctgggtagatgctgaagaaaaaggaaacaaaggagttatcagttcagtggatggaatatcattacaaggatttccaagtgaaaaaataaaactggaagcagattttgaaaccgatgagaagattgtaaaatgtaccgaggtgttctactttctaaaggaccaggatttatctattttatcaacttcttatcagtttgcaaaagaaatagccatggcttgtagtgctgcgctgtgccctcacctgaaaactctaaaaagtaatgggatgaataaaattggactcagagtttccattgacactgatatggttgaatttcaggcaggatctgaaggccaacttctgcctcagcattatctaaatgatcttgatagtgctctgatacctgtgatccatggtgggacctccaactctagtttaccattagaaatagaattagtgtttttcattatagaacatcttttttagtgaaagaatgtgccatattacatattgcaacctaatttgttaaaactaactccagcactaaagctgaaatgccacaaacactaaaagtataaatatgtctgatttttgaaacacataagctttgctctttaggcaggaatgatcttttcaaatcattagcacaatatttaaatatctaaaaatttaagagatccatactttctgtagctttacaattaatttaagtactaaaaagacaaggatttcttttaagaaatttatagcatttactgtgttatttaaatgctaagccaaagtatctgcacttaggtatacctctttatgccaataatgattttaatgaaggctcttttcagatgtaaccttatgaaggaaatatctgctttgtgtatatgccagttagaatactggtttctaaagtctgtcaaattgtatttcagtggcacaaaaaccagttttgaggtcttagacttataattctttgaataaaactgataacttatttgtataattggagtggagacctacctccataattagataaactctttttggattataatcagaattttgccttttttcttctcaaattattacatatgtatgtattatatatccacatatatagttttccctgattaaatggatattaaaataattgcgggtgcttcaggactttttgcttctatatttaagtatattgtttttatagcaagaacatattctgaatgttttataaatctttaataatttatatgtaggtaatatttttgtatcacaatgcattatttttttcctcctttccttccaaactataccactgtatttaccacttctaagagtgactgacgacgggccagatgacccttgaagtagtcattatgtagcaataaatgaagcctgaaacaggtttttttacttccactttaatccttagaaatttcttggcaacttcgcatattttcattgacaccagtgtataagtataaatttaaatgaactaattacttttgcatattttaaattctttatatggtagttattttttataacaggatattaacataagttaaatcctatgtatttgaaattgttacagagctttcctctttacttcaaacagcaaaaaagtggggggcatattgtagtcctgtcatttaagttatgtaaaaaatttaatcattattttgatgctttaaacattctcatgtgtaatatatgtttttgtatcaaaaacactcatatatttcaagaaaaagaaattatgttaaatagccctgttttaagaaaaatatttatgaagcatctcaacttgaagatcaagtcaaagttataactcaggatctgaggtctcaagctaggagagactgagaattttaatcagtttgggcatatagtttggactgaatcacatctgtagtacttagccaaagacaatttggaggagaatatcagccttctggaagtagctacttcctgaacaatgtaaagtgtcgcagatattcaataaaatggcaacctgttataatttgtgaaatttattgaaatggtgtaagatgaaaacaattgcatatcaaacccaatttatgttttctaaatatagtgtatgtattctgccatgtaagtaattgaacagtcttaaaataaccaaatggtagagggctgttccatgatgggacagctttggatttgttttcataaaatctctatattcaataaaaattggaattatgtgcctgaagtttggaggcacattttgaagtattctttgtagacatatagtatgtttctgaatgtgtttgttacttatttggtcattggtacttaatttgaaattttaattttttaagagaagaaatagaatggttctttgtactcagtctgcaatgatctatttttggcttatgtcttttaatactactctctttctctgaattttgaaatatgaagtaaaatctagcccatttgtttta

SEQ ID NO: 8127 - DNA, 6599 bp, Homo sapiens
ggtggggcggggaaagaagccctgagccgggatctggcactcccaggactcccggccggggtagctcttcactcctcagcgcgacgtcgtgtcgagttcccaaaaagctccgcaggggctgtagggagattcctgtgaggtttctcgggcttatttggtggagtttctgttccagaccagaggcatacaagaattaaattctgaataagtctgcaggtaggatggacagttattttaaagcagctgtcagtgacttggacaaactccttgatgattttgaacagaacccagatgaacaagattatctccaagatgtacaaaatgcatatgattctaaccactgctcagtttcttcagagttggcttcctcacagcgaacttcattgctcccaaaagaccaagagtgcgttaatagttgtgcctcatcagaaacaagctatggaacaaatgagagttccctgaatgaaaaaacactcaagggacttacttctatacaaaatgaaaaaaatgtaacaggacttgatcttctttcttctgtggatggtggtacttcagatgaaatccagccgttatatatgggacgatgtagtaaacctatctgtgatctgataagtgacatgggtaacttagttcatgcaaccaatagtgaagaagatattaaaaaattattgccagatgattttaagtctaatgcagattccttgattggattggatttatcttcagtgtcagatactccctgtgtttcttcaacagaccatgatagtgatactgtcagagaacaacagaatgatatcagttctgaattacaaaatagagaaatcggaggaatcaaagaattgggtataaaagtagatacaacactttcagattcctataattacagtggaacagaaaatttaaaagataaaaagatctttaatcagttagaatcaattgttgattttaacatgtcatctgctttgactcgacaaagttccaaaatgtttcatgccaaagacaagctacaacacaagagccagccatgtggattactaaaagatgttggcttagtaaaagaggaagtagatgtggcagtcataactgccgcagaatgtttaaaagaagagggcaagacaagtgctttgacctgcagccttccgaaaaatgaagatttatgcttaaatgattcaaattcaagagatgaaaatttcaaattacctgacttttcctttcaggaagataagactgttataaaacaatctgcacaagaagactcaaaaagtttagaccttaaggataatgatgtaatccaagattcctcttcagctttacatgtttccagtaaagatgtgccgtcctcattgtcctgtcttcctgcgtctgggtctatgtgtggatcattaattgaaagtaaagcacggggtgattttttacctcagcatgaacataaagataatatacaagatgcagtgactatacatgaagaaatacagaacagtgttgttctaggtggggaaccattcaaagagaatgatcttttgaaacaggaaaaatgtaaaagcatactccttcagtcattaattgaagggatggaagacagaaagatagatcctgaccagacagtaatcagagctgagtctttggatggtggtgacaccagttctacagttgtagaatctcaagaggggctttctggcactcatgtcccagagtcttctgattgttgtgaaggttttattaatactttttcaagcaatgatatggatgggcaagacttagattactttaatattgatgaaggcgcaaaaagtggcccactaattagtgatgctgaacttgatgcctttctgacagaacagtatcttcagaccactaacataaagtcttttgaagaaaatgtaaatgactctaaatcgcaaatgaatcagatagatatgaaaggcttagatgatggaaacatcaataatatatatttcaatgcagaagcaggagctattggggaaagtcatggtattaatataatttgtgaaatagttgataaacaaaatacaatagaaaatggcctttctttaggagaaaaaagcactattccagttcaacaagggttacctaccagtaagtctgagattacaaatcaattatcggtctctgatattaacagtcaatctgttggaggggccagacctaagcaattgtttagccttccatcaagaacaaggagttcaaaggacctgaataagccagatgttccagatacaatagaaagtgaacccagcacagcagataccgttgttccaatcacttgtgctatagattctacagctgatccacaggttagcttcaactctaattacattgatatagaaagtaattctgaaggtggatctagtttcgtaactgcaaatgaagattctgtacctgaaaacacttgcaaagaaggcttggttttgggccagaaacagcctacttgggttcctgattcagaagctccaaactgtatgaactgccaagtcaaatttacttttaccaaacggcgacaccattgccgagcatgtgggaaagtattttgtggtgtctgttgtaataggaagtgtaaactgcaatatctagaaaaggaagcaagagtatgtgtagtctgctatgaaactattagtaaagctcaggcatttgaaaggatgatgagtccaactggttctaatcttaagtctaatcattctgatgaatgtactactgtccagcctcctcaggagaaccaaacatccagtataccttcaccagcaactttgccagtctcagcacttaaacaaccaggtgttgaaggactatgttccaaagaacagaagagagtatggtttgcagatggtatattgcccaatggtgaagttgcagatacaacaaaattatcatctggaagtaaaagatgttctgaagactttagtcctctctcacctgatgtgcctatgacagtaaacacagtggatcattcccattctactacagtggaaaagccaaacaatgagacaggagatattacaagaaatgagataattcagagtcctatttctcaggttccatcagtggaaaaattgtctatgaacacaggaaatgaggggttacctacttctggttcatttacactagatgatgatgtttttgcagaaactgaagaaccatctagtcctactggtgtcttagttaacagcaatttacctattgctagtatttcagattataggttactgtgtgatattaacaagtatgtctgcaataagattagtcttctacctaatgatgaggacagtttgcccccacttctggttgcatctggagaaaagggatcagtgcctgtagtagaagaacatccatctcatgagcagatcattttgcttcttgaaggtgaaagctttcatcctgttacatttgtcctaaatgctaatctactcgtgaatgtcaaattcatattttattcctcagacaaatattggtacttttcaaccaatggattgcatggcttgggacaggcagaaattattattctattgttatgtttgccaaatgaagatactattcctaaggacatcttcagactatttatcaccatatataaggatgctctaaaaggaaaatacatagaaaacttggacaatattacctttactgagagttttctcagtagcaaggatcacggaggattcctgtttattacacctacttttcagaaacttgatgatctctcattaccaagtaatccttttctttgtggaattcttatccagaagcttgagattccctgggcaaaggtttttcctatgcgtttaatgttgagattgggtgcagaatataaagcatatcctgctcctctaacaagcatcagaggccgaaaacctctttttggagaaataggacacactattatgaacttacttgttgaccttcgaaattaccagtataccttgcataatatagatcaactgttgattcatatggaaatgggaaaaagctgcataaaaataccacggaaaaagtacagtgatgtaatgaaagtactaaattcttccaatgagcatgtcattagcattggagcaagtttcagtacagaagcagattctcatctagtctgtatacagaatgatggaatttatgaaacacaggccaacagtgccactggccatcctagaaaagtgacaggtgcaagttttgtggtattcaatggagctctaaaaacatcttcaggatttcttgctaagtccagcatagttgaagatggcttaatggtacaaataactccagagaccatgaatggcttgcggctagctttacgagaacagaaagactttaaaattacatgtgggaaagttgatgcagtagacctgagagaatacgtggatatctgctgggtagatgctgaagaaaaaggaaacaaaggagttatcagttcagtggatggaatatcattacaaggatttccaagtgaaaaaataaaactggaagcagattttgaaaccgatgagaagattgtaaaatgtaccgaggtgttctactttctaaaggaccaggatttatctattttatcaacttcttatcagtttgcaaaagaaatagccatggcttgtagtgctgcgctgtgccctcacctgaaaactctaaaaagtaatgggatgaataaaattggactcagagtttccattgacactgatatggttgaatttcaggcaggatctgaaggccaacttctgcctcagcattatctaaatgatcttgatagtgctctgatacctgtgatccatggtgggacctccaactctagtttaccattagaaatagaattagtgtttttcattatagaacatcttttttagtgaaagaatgtgccatattacatattgcaacctaatttgttaaaactaactccagcactaaagctgaaatgccacaaacactaaaagtataaatatgtctgatttttgaaacacataagctttgctctttaggcaggaatgatcttttcaaatcattagcacaatatttaaatatctaaaaatttaagagatccatactttctgtagctttacaattaatttaagtactaaaaagacaaggatttcttttaagaaatttatagcatttactgtgttatttaaatgctaagccaaagtatctgcacttaggtatacctctttatgccaataatgattttaatgaaggctcttttcagatgtaaccttatgaaggaaatatctgctttgtgtatatgccagttagaatactggtttctaaagtctgtcaaattgtatttcagtggcacaaaaaccagttttgaggtcttagacttataattctttgaataaaactgataacttatttgtataattggagtggagacctacctccataattagataaactctttttggattataatcagaattttgccttttttcttctcaaattattacatatgtatgtattatatatccacatatatagttttccctgattaaatggatattaaaataattgcgggtgcttcaggactttttgcttctatatttaagtatattgtttttatagcaagaacatattctgaatgttttataaatctttaataatttatatgtaggtaatatttttgtatcacaatgcattatttttttcctcctttccttccaaactataccactgtatttaccacttctaagagtgactgacgacgggccagatgacccttgaagtagtcattatgtagcaataaatgaagcctgaaacaggtttttttacttccactttaatccttagaaatttcttggcaacttcgcatattttcattgacaccagtgtataagtataaatttaaatgaactaattacttttgcatattttaaattctttatatggtagttattttttataacaggatattaacataagttaaatcctatgtatttgaaattgttacagagctttcctctttacttcaaacagcaaaaaagtggggggcatattgtagtcctgtcatttaagttatgtaaaaaatttaatcattattttgatgctttaaacattctcatgtgtaatatatgtttttgtatcaaaaacactcatatatttcaagaaaaagaaattatgttaaatagccctgttttaagaaaaatatttatgaagcatctcaacttgaagatcaagtcaaagttataactcaggatctgaggtctcaagctaggagagactgagaattttaatcagtttgggcatatagtttggactgaatcacatctgtagtacttagccaaagacaatttggaggagaatatcagccttctggaagtagctacttcctgaacaatgtaaagtgtcgcagatattcaataaaatggcaacctgttataatttgtgaaatttattgaaatggtgtaagatgaaaacaattgcatatcaaacccaatttatgttttctaaatatagtgtatgtattctgccatgtaagtaattgaacagtcttaaaataaccaaatggtagagggctgttccatgatgggacagctttggatttgttttcataaaatctctatattcaataaaaattggaattatgtgcctgaagtttggaggcacatttt

SEQ ID NO: 8128 - DNA, 6680 bp, Homo sapiens
ccggtggggcggggaaagaagccctgagccgggatctggcactcccaggactcccggccggggtagctcttcactcctcagcgcgacgtcgtgtcgagttcccaaaaagctccgcaggggctgtagggaggtgatctcatccattaacagctgtgtgttgccagttcccaaatctttatctatctcagacttctctcctgcattccagattcttatattcagctgccttttggatatctctcccaggatgttctcaaggcatacaagaattaaattctgaataagtctgcaggtaggatggacagttattttaaagcagctgtcagtgacttggacaaactccttgatgattttgaacagaacccagatgaacaagattatctccaagatgtacaaaatgcatatgattctaaccactgctcagtttcttcagagttggcttcctcacagcgaacttcattgctcccaaaagaccaagagtgcgttaatagttgtgcctcatcagaaacaagctatggaacaaatgagagttccctgaatgaaaaaacactcaagggacttacttctatacaaaatgaaaaaaatgtaacaggacttgatcttctttcttctgtggatggtggtacttcagatgaaatccagccgttatatatgggacgatgtagtaaacctatctgtgatctgataagtgacatgggtaacttagttcatgcaaccaatagtgaagaagatattaaaaaattattgccagatgattttaagtctaatgcagattccttgattggattggatttatcttcagtgtcagatactccctgtgtttcttcaacagaccatgatagtgatactgtcagagaacaacagaatgatatcagttctgaattacaaaatagagaaatcggaggaatcaaagaattgggtataaaagtagatacaacactttcagattcctataattacagtggaacagaaaatttaaaagataaaaagatctttaatcagttagaatcaattgttgattttaacatgtcatctgctttgactcgacaaagttccaaaatgtttcatgccaaagacaagctacaacacaagagccagccatgtggattactaaaagatgttggcttagtaaaagaggaagtagatgtggcagtcataactgccgcagaatgtttaaaagaagagggcaagacaagtgctttgacctgcagccttccgaaaaatgaagatttatgcttaaatgattcaaattcaagagatgaaaatttcaaattacctgacttttcctttcaggaagataagactgttataaaacaatctgcacaagaagactcaaaaagtttagaccttaaggataatgatgtaatccaagattcctcttcagctttacatgtttccagtaaagatgtgccgtcctcattgtcctgtcttcctgcgtctgggtctatgtgtggatcattaattgaaagtaaagcacggggtgattttttacctcagcatgaacataaagataatatacaagatgcagtgactatacatgaagaaatacagaacagtgttgttctaggtggggaaccattcaaagagaatgatcttttgaaacaggaaaaatgtaaaagcatactccttcagtcattaattgaagggatggaagacagaaagatagatcctgaccagacagtaatcagagctgagtctttggatggtggtgacaccagttctacagttgtagaatctcaagaggggctttctggcactcatgtcccagagtcttctgattgttgtgaaggttttattaatactttttcaagcaatgatatggatgggcaagacttagattactttaatattgatgaaggcgcaaaaagtggcccactaattagtgatgctgaacttgatgcctttctgacagaacagtatcttcagaccactaacataaagtcttttgaagaaaatgtaaatgactctaaatcgcaaatgaatcagatagatatgaaaggcttagatgatggaaacatcaataatatatatttcaatgcagaagcaggagctattggggaaagtcatggtattaatataatttgtgaaatagttgataaacaaaatacaatagaaaatggcctttctttaggagaaaaaagcactattccagttcaacaagggttacctaccagtaagtctgagattacaaatcaattatcggtctctgatattaacagtcaatctgttggaggggccagacctaagcaattgtttagccttccatcaagaacaaggagttcaaaggacctgaataagccagatgttccagatacaatagaaagtgaacccagcacagcagataccgttgttccaatcacttgtgctatagattctacagctgatccacaggttagcttcaactctaattacattgatatagaaagtaattctgaaggtggatctagtttcgtaactgcaaatgaagattctgtacctgaaaacacttgcaaagaaggcttggttttgggccagaaacagcctacttgggttcctgattcagaagctccaaactgtatgaactgccaagtcaaatttacttttaccaaacggcgacaccattgccgagcatgtgggaaagtattttgtggtgtctgttgtaataggaagtgtaaactgcaatatctagaaaaggaagcaagagtatgtgtagtctgctatgaaactattagtaaagctcaggcatttgaaaggatgatgagtccaactggttctaatcttaagtctaatcattctgatgaatgtactactgtccagcctcctcaggagaaccaaacatccagtataccttcaccagcaactttgccagtctcagcacttaaacaaccaggtgttgaaggactatgttccaaagaacagaagagagtatggtttgcagatggtatattgcccaatggtgaagttgcagatacaacaaaattatcatctggaagtaaaagatgttctgaagactttagtcctctctcacctgatgtgcctatgacagtaaacacagtggatcattcccattctactacagtggaaaagccaaacaatgagacaggagatattacaagaaatgagataattcagagtcctatttctcaggttccatcagtggaaaaattgtctatgaacacaggaaatgaggggttacctacttctggttcatttacactagatgatgatgtttttgcagaaactgaagaaccatctagtcctactggtgtcttagttaacagcaatttacctattgctagtatttcagattataggttactgtgtgatattaacaagtatgtctgcaataagattagtcttctacctaatgatgaggacagtttgcccccacttctggttgcatctggagaaaagggatcagtgcctgtagtagaagaacatccatctcatgagcagatcattttgcttcttgaaggtgaaagctttcatcctgttacatttgtcctaaatgctaatctactcgtgaatgtcaaattcatattttattcctcagacaaatattggtacttttcaaccaatggattgcatggcttgggacaggcagaaattattattctattgttatgtttgccaaatgaagatactattcctaaggacatcttcagactatttatcaccatatataaggatgctctaaaaggaaaatacatagaaaacttggacaatattacctttactgagagttttctcagtagcaaggatcacggaggattcctgtttattacacctacttttcagaaacttgatgatctctcattaccaagtaatccttttctttgtggaattcttatccagaagcttgagattccctgggcaaaggtttttcctatgcgtttaatgttgagattgggtgcagaatataaagcatatcctgctcctctaacaagcatcagaggccgaaaacctctttttggagaaataggacacactattatgaacttacttgttgaccttcgaaattaccagtataccttgcataatatagatcaactgttgattcatatggaaatgggaaaaagctgcataaaaataccacggaaaaagtacagtgatgtaatgaaagtactaaattcttccaatgagcatgtcattagcattggagcaagtttcagtacagaagcagattctcatctagtctgtatacagaatgatggaatttatgaaacacaggccaacagtgccactggccatcctagaaaagtgacaggtgcaagttttgtggtattcaatggagctctaaaaacatcttcaggatttcttgctaagtccagcatagttgaagatggcttaatggtacaaataactccagagaccatgaatggcttgcggctagctttacgagaacagaaagactttaaaattacatgtgggaaagttgatgcagtagacctgagagaatacgtggatatctgctgggtagatgctgaagaaaaaggaaacaaaggagttatcagttcagtggatggaatatcattacaaggatttccaagtgaaaaaataaaactggaagcagattttgaaaccgatgagaagattgtaaaatgtaccgaggtgttctactttctaaaggaccaggatttatctattttatcaacttcttatcagtttgcaaaagaaatagccatggcttgtagtgctgcgctgtgccctcacctgaaaactctaaaaagtaatgggatgaataaaattggactcagagtttccattgacactgatatggttgaatttcaggcaggatctgaaggccaacttctgcctcagcattatctaaatgatcttgatagtgctctgatacctgtgatccatggtgggacctccaactctagtttaccattagaaatagaattagtgtttttcattatagaacatcttttttagtgaaagaatgtgccatattacatattgcaacctaatttgttaaaactaactccagcactaaagctgaaatgccacaaacactaaaagtataaatatgtctgatttttgaaacacataagctttgctctttaggcaggaatgatcttttcaaatcattagcacaatatttaaatatctaaaaatttaagagatccatactttctgtagctttacaattaatttaagtactaaaaagacaaggatttcttttaagaaatttatagcatttactgtgttatttaaatgctaagccaaagtatctgcacttaggtatacctctttatgccaataatgattttaatgaaggctcttttcagatgtaaccttatgaaggaaatatctgctttgtgtatatgccagttagaatactggtttctaaagtctgtcaaattgtatttcagtggcacaaaaaccagttttgaggtcttagacttataattctttgaataaaactgataacttatttgtataattggagtggagacctacctccataattagataaactctttttggattataatcagaattttgccttttttcttctcaaattattacatatgtatgtattatatatccacatatatagttttccctgattaaatggatattaaaataattgcgggtgcttcaggactttttgcttctatatttaagtatattgtttttatagcaagaacatattctgaatgttttataaatctttaataatttatatgtaggtaatatttttgtatcacaatgcattatttttttcctcctttccttccaaactataccactgtatttaccacttctaagagtgactgacgacgggccagatgacccttgaagtagtcattatgtagcaataaatgaagcctgaaacaggtttttttacttccactttaatccttagaaatttcttggcaacttcgcatattttcattgacaccagtgtataagtataaatttaaatgaactaattacttttgcatattttaaattctttatatggtagttattttttataacaggatattaacataagttaaatcctatgtatttgaaattgttacagagctttcctctttacttcaaacagcaaaaaagtggggggcatattgtagtcctgtcatttaagttatgtaaaaaatttaatcattattttgatgctttaaacattctcatgtgtaatatatgtttttgtatcaaaaacactcatatatttcaagaaaaagaaattatgttaaatagccctgttttaagaaaaatatttatgaagcatctcaacttgaagatcaagtcaaagttataactcaggatctgaggtctcaagctaggagagactgagaattttaatcagtttgggcatatagtttggactgaatcacatctgtagtacttagccaaagacaatttggaggagaatatcagccttctggaagtagctacttcctgaacaatgtaaagtgtcgcagatattcaataaaatggcaacctgttataatttgtgaaatttattgaaatggtgtaagatgaaaacaattgcatatcaaacccaatttatgttttctaaatatagtgtatgtattctgccatgtaagtaattgaacagtcttaaaataaccaaatggtagagggctgttccatgatgggacagctttggatttgttttcataaaatctctatattcaataaaaattggaattatgtgcctgaagtttggaggcacattttgaagt

SEQ ID NO: 8129 - DNA, 6678 bp, Homo sapiens
gagttccgagcgaccgatggagatggcggctgcggctgagtgacggacggtggaggcccagagcccgggcctgaagggggggacaaacctgggtgcccgcaggagcccggcagggtactgtgctaaaccctggggagacggcgaagtggaaaacatatagagtctgtgccctcccagattttacagtcttacttggtcacttcacgtatgtacctgcggttataaattgagatgagtgctgtgaaggagaagtccattctgatgctctgagtgtcttacaagtatcaagaacttactatatgtggttgaataaacaatcaaggtaaagagcatcaagtaaaaacttctgcttgttgataagtacttcagacattcccccagtggctgaagtggcatatgaattatgaagttggatcatttggaatgaatgtaagagaattgccaagggctcctcctactccagagaggaaacctcatccagggccatgaagccacttcctcaccatctgtgtgctgcttaagctaatgctgcgggaaccatggttccttgggaggaatcaagctgactcttggcatgagattcctgccttcctagggttgagagcggcactgccatggcttctctggacgacccaggggaagtgagggagggcttcctctgccctctgtgcctgaaggatctgcagtctttctatcagcttcactcacattacgaggaagaacactcaggggaagaccgtgatgtcaaagggcaaattaaaagtcttgtccagaaggctaaaaaagcaaaggacaggttgttgaaacgagaaggggatgatcgagcagagtcagggacccaaggatatgagtctttcagctatggaggggttgatccttacatgtgggaaccccaggagcttggtgctgtgagaagccatctttccgacttcaaaaaacaccgagctgctagaattgaccactatgttgtggaagtcaataaactaataatcaggttagagaagctcactgcatttgacagaacaaatactgagtctgcaaagattcgagcaatagaaaagtctgtggtgccttgggtcaacgaccaggatgtccctttctgtccagactgtgggaataagttcagcatccggaaccgccgccaccactgccgcctctgcgggtctattatgtgcaagaagtgtatggagctcatcagccttcccttggcaaacaagctcaccagtgccagcaaggagtccctgagcacccacaccagccccagccagtcacccaacagtgtccatggctcccgccgaggcagcatcagcagcatgagcagtgtcagctcggtcctggatgagaaggacgatgaccggatccgctgctgtacacactgcaaggacacgctgctcaagagagagcagcagattgatgagaaggagcacacacctgacatcgtgaagctctacgagaaattacgactttgcatggagaaagttgaccagaaagctccagaatacatcaggatggcagcatcattaaatgctggggagacaacctacagtctggaacatgccagtgaccttcgagtggaagtgcagaaagtgtatgagctgatagacgctttaagtaagaagatcttaaccttgggcttgaaccaggaccctccaccacatccaagcaatttgcggctgcagagaatgatcagatactcagctacactttttgtgcaggaaaagttgcttggtttgatgtcactgccaaccaaagaacagtttgaggaactgaaaaagaaaaggaaggaggaaatggagaggaagagggccgtggagagacaagctgccctggagtcccagcgaaggcttgaggaaaggcagagtggcctggcttctcgagcggccaacggggaggtggcatctctccgcaggggccctgcccccttgagaaaggctgagggctggctcccactgtcaggaggtcaggggcagagtgaggactcagacccgctcctccagcagatccacaacatcacatcattcatcaggcaggccaaggccgcgggccgcatggatgaagtgcgcactctgcaggagaacctgcggcagctgcaggacgagtatgaccagcagcagacagagaaggccatcgagctgtcccggaggcaggctgaggaggaggacctgcagcgggaacagctgcagatgttgcgtgaacgggagttggaacgagaaagggagcagtttcgggtggcatccctgcacacacggactcggtccctggacttcagagaaatcggcccttttcagctggagcccagcagagagcctcgcacccaccttgcttatgctttggatctaggctcttccccagttccaagcagcacagctcccaagaccccttcacttagctcaactcaacccaccagagtgtggtctgggcccccagccgttggccaggagcgcttaccccagagcagcatgccacagcaacatgaggggccctccttaaacccctttgatgaggaagacctctccagccccatggaagaggccactactggtcctcctgctgcaggggtttccttagacccttcagcccgcatcctgaaagagtacaatcctttcgaggaagaggacgaggaggaggaagcagtggcagggaatccattcattcagccagacagcccagctcctaaccccttcagtgaggaagacgaacatccccagcagaggctctcaagccctctggttcctggtaacccctttgaggaacccacctgtatcaacccctttgagatggacagtgacagtgggccagaggctgaggagcccatagaggaagagctcctcctgcagcagatcgataacatcaaggcatacatctttgatgccaagcagtgcggccgcctggatgaggtagaggtgctgacagagaatctgcgggagctgaagcacaccctggccaagcagaaggggggcactgactgaccagcagtggagagggcacctttgggcccaggggtctggcaggagccagtggagcaggacagagggcaggcaggatggatggggaaggtggcagggtgagaactcagatgcacacaggtgaggggcaggaatctgctgttttgtgttgcgcactttgaggtatttccactacagttgaataataaaatagaaactagaacagggagaatcagcattcagttgctgcttttcctgtttattattactatcttttgtaatcggaggtttaccccttttgaagggactttacatttttactaccgagatataactaaatgcagctctgttgggcccagggcagaaatggctgctgtgtacctcttgggtccatttgctactgcctagtcttggttccttatgcagtattatagggcagcctttttagagcccttcctttagccaagacagagaagatagattccactgagctctattctgctctgacagaagtccatccctagtaggctgtgagttccatttcacctggggccgcctctcccctgctctgcacttcctgtctgtacaatagaagggggaggtgctgctatgaaggggagagtttagacccaggagagcccagcacctctttttaaggtggggtgatgggaatatttcaccagggtctattttctcagtttaagttcttttttgtctctttcaggaagttaagctcccagtgcagggtatcaatgtgaatctggtcctgagctttttagaaaataagagtggtggccgggcgcgctggctcacgcctgtaatcgcaacactttgggaggccgaggcaggcagatcacaaggtcaggagatcgagaccaccctggctaacacagtgaaatcccgtctctactaaaaatacaaaaaattagccaggcgtggtggtgggtgcctgtagtcccagctactttggaggctgaggcaggagaatgctgtgaacccgggaggcagagcttgcagtgagccgagatcgcaccactgcactccagcctgggcagtgagagtgagactccgtctcaaaaaaaaataagagtggttaactttttggttgatattagtattatttgtgagaagagtttccccacccttcttctgatagaacaattgtctgtcactggagaaatctccctccagagctttggcaaagttactctgatctgggtctgtttaaaaggccgggtctctaatttaggaatcggtgatttggaagcttttgcagaacatcaccagaagaagggaagcttcccagagtcagaagctaaattaaaataatttccaaggctatttgatcagccttcttcctttttggttcattgtgtcctgacttggggcactgatgagattttttattttttttgagacagagtttcactttgttgcccaggctggagtgtagtggcatgatctcagctcactgcaacctccacctccctggttcaagtgatatttgtgcctcagccccctgaatagctaggattacaggcgtgggccaccacgcctggttaatctctgtatttttagtagaggtagagtttcaccattttggccaggctggtttcgaactcctggcctcaagtgatctgccaccttggcctcccaaagtgctgggaatacaggcgtgagccactgtgcccgccctgatgagatattttattaccaatgttagtattgagaaactgaaatgtttgaagaagcacaacccaggatcgtgctggtagcaccacagtacttaaactgttggtcaattaaggccagaaagggaaattgttaatttagctctggtgctttggtttacaggaacataactcttaactgacatctgacatcatgatagccatatgtgctcagctctgggtagagtttctgcagttactcatctgaactaatgaacaataactgaccactagtcactttatgccgtgtaactagctctaggccatactttcactggttactggtgtgaaagctgaaattcattttgttacattctggtgaagacccctcttgataatgggaatgttttaactctcttgatgaaaaaataatctgtatttgtgttgatgttcacatttctgtagcacatttcttatccttttggttgaatgaaaagatcttgtataggggtgtggagatggggagtgggtagaagtgtgtgaaggacgctttgcatttgggatctgttcacaaacagccatatgagtgtgttaatgaatgtcagccagttaccaaccctgctggttgttatgggttgttttgagaagttggcaaccaggcatctaagatgttgcctggtacaggcctcttttcttccctgaggcccatgacatttctctgttactctagagggtttctcagatggccagtaggctcctccctgcttagggtctcatttctctgaaaagaggatgaactgaaaagcaggtagttccagaagctaattgctgctttccatcataattatttttcttgtgagaacatttctcttttaattagctagtgattttgattaagactaattcactaaacatacccttccctcaaatcacctcaggtagcaatctgtaagtaactaaaagcattgaaaaacacacaagaaacatttttaaaaactatttttaaaggcctggccgggtgcagtggctcactcctgtaatcccagcactttgggaggccgagacgggtggatcacctgaggtcaggaatttgagactagcatggccaacatggtgaaaccccgtgtctactaaaaatacaaaaattagctgggcgtggtggcagacgcctgtaatcccagctactcagggaggctgaggcacgagaatcgcttgaacctgggaggcggaggttgcagtgagccaagattgcgccactgcactccaacctgggtgacaagagcaagactccgtctcacaaaaaacaaacaaaactgactgattgaatatactaaaccaaactaaaatcatattcttttgattaagtttatccatggctgtattcttctatgaattcttccatttaattcttccacgattatcttctcctgtaaatacatcacaggagttagaattctctacccatcagctgtaccatgtcgcagaattcatgcaggcacaaagttggagttacagagatgggttgacagcaggcaaacttggcctatgtattataaccacaacttcaagttcttacctcatgtgaatattcaccctttctttagtcttccaaggcaaacagccccgtctcatcaccagatgagcaaggtcttgatatggcatagcagatctccctagacacagatcatgagaaaagatggaagagacttagggattcaggcatcagatgaagttggcttttcccttttatgccttgtttgtatttaccctgtctaatacactaaggatacttactcattgtacttgcagctcaatatgtctttgctgttcagatactaaaatgtacctctgagtcattgtgagctgtgtggtaggttggacattggcatagttggtgatgggactcaaaatgaaaaggtggtctctttaccaggtcacagactgtagcagattgtgcttgttatctgacaatgactgtcactttgagggtcgttgatttgcatgcactactctggggccttgtattggagccttttttaaaaaaaataaaatctgagatagag

SEQ ID NO: 8130 - DNA, 1915 bp, Homo sapiens
gcggctgagtgacggacggtggaggcccagagcccgggcctgaagggggggacaaacctgggtgcccgcaggagcccggcagggtactgtgctaaaccctggggagacggcgaagtggaaaacatatagagtctgtgccctcccagattttacagtcttacttggtcacttcacgtatgtacctgcggttataaattgagatgagtgctgtgaaggagaagtccattctgatgctctgagtgtcttacaagtatcaagaacttactatatgtggttgaataaacaatcaaggtaaagagcatcaagtaaaaacttctgcttgttgataagtacttcagacattcccccagtggctgaagtggcatatgaattatgaagttggatcatttggaatgaatgtaagagaattgccaagggctcctcctactccagagaggaaacctcatccagggccatgaagccacttcctcaccatctgtgtgctgcttaagctaatgctgcgggaaccatggttccttgggaggaatcaagctgactcttggcatgagattcctgccttcctagggttgagagcggcactgccatggcttctctggacgacccaggggaagtgagggagggcttcctctgccctctgtgcctgaaggatctgcagtctttctatcagcttcactcacattacgaggaagaacactcaggggaagaccgtgatgtcaaagggcaaattaaaagtcttgtccagaaggctaaaaaagcaaaggacaggttgttgaaacgagaaggggatgatcgagcagagtcagggacccaaggatatgagtctttcagctatggaggggttgatccttacatgtgggaaccccaggagcttggtgctgtgagaagccatctttccgacttcaaaaaacaccgagctgctagaattgaccactatgttgtggaagtcaataaactaataatcaggttagagaagctcactgcatttgacagaacaaatactgagtctgcaaagattcgagcaatagaaaagtctgtggtgccttgggtcaacgaccaggatgtccctttctgtccagactgtgggaataagttcagcatccggaaccgccgccaccactgccgcctctgcgggtctattatgtgcaagaagtgtatggagctcatcagccttcccttggcaaacaagctcaccagtgccagcaaggagtccctgagcacccacaccagccccagccagtcacccaacagtgtccatggctcccgccgaggcagcatcagcagcatgagcagtgtcagctcggtcctggatgagaaggacgatgaccggatccgctgctgtacacactgcaaggacacgctgctcaagagagagcagcagattgatgagaaggagcacacacctgacatcgtgaagctctacgagaaattacgactttgcatggagaaagttgaccagaaagctccagaatacatcaggatggcagcatcattaaatgctggggagacaacctacagtctggaacatgccagtgaccttcgagtggaagtgcagaaagtgtatgagctgatagacgctttaagtaagaagatcttaaccttgggcttgaaccaggaccctccaccacatccaagcaatttgcggctgcagagaatgatcagatactcagctacactttttgtgcaggaaaagttgcttggtttgatgtcactgccaaccaaagaacagtttgaggaactgaaaaagaaaaggaaggaggaaatggagaggaagagggccgtggagagacaagctgccctggagtcccagcgaaggcttgaggaaaggcagagagcctcgcacccaccttgcttatgctttggatctaggctcttccccagttccaagcagcacagctcccaagaccccttcacttag

SEQ ID NO: 8131 - DNA, 1127 bp, Homo sapiens
gagttccgagcgaccgatggagatggcggctgcggctgagtgacggacggtggaggcccagagcccgggcctgaagggggggacaaacctgggtgcccgcaggagcccggcagggtgtcttacaagtatcaagaacttactatatgtggttgaataaacaatcaaggtaaagagcatcaagtaaaaacttctgcttgttgataagtacttcagacattcccccagtggctgaagtggcatatgaattatgaagttggatcatttggaatgaatgtaagagaattgccaagggctcctcctactccagagaggaaacctcatccagggccatgaagccacttcctcaccatctgtgtgctgcttaagctaatgctgcgggaaccatggttccttgggaggaatcaagctgactcttggcatgagattcctgccttcctagggttgagagcggcactgccatggcttctctggacgacccaggggaagtgagggagggcttcctctgccctctgtgcctgaaggatctgcagtctttctatcagcttcactcacattacgaggaagaacactcaggggaagaccgtgatgtcaaagggcaaattaaaagtcttgtccagaaggctaaaaaagcaaaggacaggttgttgaaacgagaaggggatgatcgagcagagtcagggacccaaggatatgagtctttcagctatggaggggttgatccttacatgtgggaaccccaggagcttggtgctgtgagaagccatctttccgacttcaaaaaacaccgagctgctagaattgaccactatgttgtggaagtcaataaactaataatcaggttagagaagctcactgcatttgacagaacaaatactgagtctgcaaagattcgagcaatagaaaagtctgtggtgccttgggtcaacgaccaggatgtccctttctgtccagactgtgggaataagttcagcatccggaaccgccgccaccactgccgcctctgcgggtctattatgtgcaagaagtgtatggagctcatcagccttcccttggcaaaaattacgactttgcatggagaaagttgaccagaaagctccagaatacatcaggatggcagcatcattaaa

SEQ ID NO: 8132 - DNA, 3005 bp, Homo sapiens
gcaggcgcacctgccgagttccgagcgaccgatggagatggcggctgcggctgagtgacggacggtggaggcccagagcccgggcctgaagggggggacaaacctgggtgcccgcaggagcccggcagggtgtcttacaagtatcaagaacttactatatgtggttgaataaacaatcaaggtaaagagcatcaagtaaaaacttctgcttgttgataagtacttcagacattcccccagtggctgaagtggcatatgaattatgaagttggatcatttggaatgaatgtaagagaattgccaagggctcctcctactccagagaggaaacctcatccagggccatgaagccacttcctcaccatctgtgtgctgcttaagctaatgctgcgggaaccatggttccttgggaggaatcaagctgactcttggcatgagattcctgccttcctagggttgagagcggcactgccatggcttctctggacgacccaggggaagtgagggagggcttcctctgccctctgtgcctgaaggatctgcagtctttctatcagcttcactcacattacgaggaagaacactcaggggaagaccgtgatgtcaaagggcaaattaaaagtcttgtccagaaggctaaaaaagcaaaggacaggttgttgaaacgagaaggggatgatcgagcagagtcagggacccaaggatatgagtctttcagctatggaggggttgatccttacatgtgggaaccccaggagcttggtgctgtgagaagccatctttccgacttcaaaaaacaccgagctgctagaattgaccactatgttgtggaagtcaataaactaataatcaggttagagaagctcactgcatttgacagaacaaatactgagtctgcaaagattcgagcaatagaaaagtctgtggtgccttgggtcaacgaccaggatgtccctttctgtccagactgtgggaataagttcagcatccggaaccgccgccaccactgccgcctctgcgggtctattatgtgcaagaagtgtatggagctcatcagccttcccttggcaaacaagctcaccagtgccagcaaggagtccctgagcacccacaccagccccagccagtcacccaacagtgtccatggctcccgccgaggcagcatcagcagcatgagcagtgtcagctcggtcctggatgagaaggacgatgaccggatccgctgctgtacacactgcaaggacacgctgctcaagagagagcagcagattgatgagaaggagcacacacctgacatcgtgaagctctacgagaaattacgactttgcatggagaaagttgaccagaaagctccagaatacatcaggatggcagcatcattaaatgctggggagacaacctacagtctggaacatgccagtgaccttcgagtggaagtgcagaaagtgtatgagctgatagacgctttaagtaagaagatcttaaccttgggcttgaaccaggaccctccaccacatccaagcaatttgcggctgcagagaatgatcagatactcagctacactttttgtgcaggaaaagttgcttggtttgatgtcactgccaaccaaagaacagtttgaggaactgaaaaagaaaaggaaggaggaaatggagaggaagagggccgtggagagacaagctgccctggagtcccagcgaaggcttgaggaaaggcagagtggcctggcttctcgagcggccaacggggaggtggcatctctccgcaggggccctgcccccttgagaaaggctgagggctggctcccactgtcaggaggtcaggggcagagtgaggactcagacccgctcctccagcagatccacaacatcacatcattcatcaggcaggccaaggccgcgggccgcatggatgaagtgcgcactctgcaggagaacctgcggcagctgcaggacgagtatgaccagcagcagacagagaaggccatcgagctgtcccggaggcaggctgaggaggaggacctgcagcgggaacagctgcagatgttgcgtgaacgggagttggaacgagaaagggagcagtttcgggtggcatccctgcacacacggactcggtccctggacttcagagaaatcggcccttttcagctggagcccagcagagagcctcgcacccaccttgcttatgctttggatctaggctcttccccagttccaagcagcacagctcccaagaccccttcacttagctcaactcaacccaccagagtgtggtctgggcccccagccgttggccaggagcgcttaccccagagcagcatgccacagcaacatgaggggccctccttaaacccctttgatgaggaagacctctccagccccatggaagaggccactactggtcctcctgctgcaggggtttccttagacccttcagcccgcatcctgaaagagtacaatcctttcgaggaagaggacgaggaggaggaagcagtggcagggaatccattcattcagccagacagcccagctcctaaccccttcagtgaggaagacgaacatccccagcagaggctctcaagccctctggttcctggtaacccctttgaggaacccacctgtatcaacccctttgagatggacagtgacagtgggccagaggctgaggagcccatagaggaagagctcctcctgcagcagatcgataacatcaaggcatacatctttgatgccaagcagtgcggccgcctggatgaggtagaggtgctgacagagaatctgcgggagctgaagcacaccctggccaagcagaaggggggcactgactgaccagcagtggagagggcacctttgggcccaggggtctggcaggagccagtggagcaggacagagggcaggcaggatggatggggaaggtggcagggtgagaactcagatgcacacaggtgaggggcaggaatctgctgttttgtgttgcgcactttgaggtatttccactacagttg

SEQ ID NO: 8133 - DNA, 582 bp, Homo sapiens
accgatggagatggcggctgcggctgagtgacggacggtggaggcccagagcccgggcctgaagggggggacaaacctgggtgcccgcaggagcccggcagggtacatacagagggtgtcttacaagtatcaagaacttactatatgtggttgaataaacaatcaaggtaaagagcatcaagtaaaaacttctgcttgttgataagtacttcagacattcccccagtggctgaagtggcatatgaattatgaagttggatcatttggaatgaatgtaagagaattgccaagggctcctcctactccagagaggaaacctcatccagggccatgaagccacttcctcaccatctgtgtgctgcttaagctaatgctgcgggaaccatggttccttgggaggaatcaagctgactcttggcatgagattcctgccttcctagggttgagagcggcactgccatggcttctctggacgacccaggggaagtgagggagggcttcctctgccctctgtgcctgaaggatctgcagtctttctatcagcttcactcacattacgaggaagaacactcaggggaagac

SEQ ID NO: 8134 - DNA, 4914 bp, Homo sapiens
atgctgaagcggaggcggccgctgctcgaggatcaaacagagcatactgaatcagcaggactggctggtggtgcagcagacatcatgagtaagcaccgagaagtctgttccttatcacgtgtgtaaggggaaaaaggtttaaacaagtctcttaagtggtgtttcctcaccgatggagaattacttccaagcagaagcttacaacctggacaaggtgttagatgaatttgaacaaaacgaagatgaaacagtttcttctactttattggatacaaagtggaataagattctagatcccccttctcaccggctgtcatttaaccctactttggccagtgtgaatgaatctgcagtttctaatgagtcacaaccacaactgaaagtcttctccctggctcattcagctcccctgaccacagaggaagaggatcactgtgctaatggacaggactgtaatctaaatccagagattgccacaatgtggattgatgaaaatgctgttgcagaagaccagttaattaagagaaactatagttgggatgatcaatgcagtgctgttgaagtgggagagaagaaatgtggaaacctggcttgtctgccagatgagaagaatgttcttgttgtagccgtcatgcataactgtgataaaaggacattacaaaacgatttacaggattgtaataattataatagtcaatcccttatggatgcttttagctgttcactggataatgaaaacagacaaactgatcaatttagttttagtataaatgagtccactgaaaaagatatgaattcagagaaacaaatggatccattgaatagaccgaaaacagaggggagatctgttaaccatctgtgtcctacttcatctgatagtctagccagtgtctgttccccttcacaattaaaggatgacggaagtataggtagagacccctccatgtctgcgattacaagtttaacggttgattcagtaatctcatcccagggaacagatggatgtcctgctgttaaaaagcaagagaactatataccagatgaggacctcactggcaaaatcagctctcctaggacagatctagggagtccaaattccttttcccacatgagtgaggggattttgatgaaaaaagagccagcagaggagagcaccactgaagaatccctccggtctggtttacctttgcttctcaaaccagacatgcctaatgggtctggaaggaataatgactgtgaacggtgttcagattgccttgtgcctaatgaagttagggctgatgaaaatgaaggttatgaacatgaagaaactcttggcactacagaattccttaatatgacagagcatttctctgaatctcaggacatgactaattggaagttgactaaactaaatgagatgaatgatagccaagtaaacgaagaaaaggaaaagtttctacagattagtcagcctgaggacactaatggtgatagtggaggacagtgtgttggattggcagatgcaggtctagatttaaaaggaacttgcattagtgaaagtgaagaatgtgatttctccactgttatagacacaccagcagcaaattatctatctaatggttgtgattcctatggaatgcaagacccaggtgtttcttttgttccaaagactttaccctccaaagaagattcagtaacagaagaaaaagaaatagaggaaagcaagtcagaatgctactcaaatatttatgaacagagaggaaatgaggccacagaagggagtggactacttttaaacagcactggtgacctaatgaagaaaaattatttacataatttctgtagtcaagttccatcagtgcttgggcaatcttcccccaaggtagtagcaagcctgccatctatcagtgttccttttggtggtgcaagacccaagcaaccttctaatcttaaacttcaaattccaaagccattatcagaccatttacaaaatgactttcctgcaaacagtggaaataatactaaaaataaaaatgatattcttgggaaagcaaaattaggggaaaactcagcaaccaatgtatgcagtccatctttgggaaacatctctaatgtcgatacaaatggggaacatttagaaagttatgaggctgagatctccactagaccatgccttgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggttttctgtgcttcctgctgtagcctgaaatgtaaactgttatacatggacagaaaggaagctagagtgtgtgtaatctgccattcagtgctaatgaatgctcaagcctgggagaacatgatgagtgcctcaagccagagccctaaccctaacaatcctgctgaatactgttctactatccctcccttgcagcaagctcaggcctcaggagctctgagctctccacctcccactgtgatggtacctgtgggagttttaaagcaccctggagcagaagtggctcagcccagagagcagaggcgagtttggtttgctgatgggatcttgcccaatggagaagttgctgatgcagccaaattaacaatgaatggaacttcctctgcaggaaccctggctgtgtcacacgacccagtcaagccagtaactaccagtcctctaccagcagagacggatatttgtctattctctgggagtataactcaggttggaagtcctgttggaagtgcaatgaatcttattcctgaagatggccttcctcccattctcatctccactggtgtaaaaggagactatgctgtggaagagaaaccatcacagatttcagtaatgcagcagttggaggatggtggccctgacccacttgtatttgttttaaatgcaaatttgttgtcaatggttaaaattgtaaattatgtgaacaggaagtgctggtgtttcacaaccaagggaatgcatgcagtgggtcagtctgagatagtcattcttctacagtgtttaccggatgaaaagtgtttgccaaaggatatctttaatcactttgtgcagctttatcgggatgctctggcagggaatgtggtgagcaacttgggacattccttcttcagtcaaagtttccttggcagtaaagaacatggtggattcttatatgtgacatctacctaccagtcactgcaagacctagtactcccaaccccaccttacttgtttgggattcttatccagaaatgggaaactccttgggctaaagtatttcctatccgtctgatgttgagacttggagctgaatatcgactttatccatgcccactattcagtgtcagatttcggaagccattgtttggagagacggggcataccatcatgaatcttcttgcagacttcagaaattaccagtataccttgccagtagttcaaggtttggtggttgatatggaagttcggaaaactagcatcaaaattcccagcaacagatacaatgagatgatgaaagccatgaacaagtccaatgagcatgtcctggcaggaggtgcctgcttcaatgaaaaggcagactctcatcttgtgtgtgtacagaatgatgatggaaactatcagacccaggctatcagtattcacaatcagcccagaaaagtgactggtgccagtttctttgtgttcagtggcgctctgaaatcctcttctggataccttgccaagtccagtattgtggaagatggtgttatggtccagattactgcagagaacatggattccttgaggcaggcactgcgagagatgaaggacttcaccatcacctgtgggaaggcggacgcggaggaaccccaggagcacatccacatccagtgggtggatgatgacaagaacgttagcaagggtgtcgtaagtcctatagatgggaagtccatggagactataacaaatgtgaagatattccatggatcagaatataaagcaaatggaaaagtaatcagatggacagaggtgtttttcctagaaaacgatgaccagcacaattgcctcagtgatcctgcagatcacagtagattgactgagcatgttgccaaagctttttgccttgctctctgtcctcacctgaaacttctgaaggaagatggaatgaccaaactgggactacgtgtgacacttgactcagatcaggttggctatcaagcagggagcaatggccagccccttccctcgcagtacatgaatgatctggacagcgccttggtgccggtgatccatggaggggcctgccagcttagtgagggccccgttgtcatggaactcatcttttatattctggaaaacatcgtataaacagagaagacttcatttttttctgttcagacttgttgcaacagcagtcatacccaaatcatttgcactttaaaactggaagattaagcttttgttaacactattaatggggtggggaatagggtgggagtgggggtttgggagacgggtgggaaagggtggttggggggaccgatgttccataattctaagtcttctatgcattgtccaccaagaagatctgggcagcttctgttcctgcacaacagttatgctatccttgcagctaatccccttctgttactgtttagacaagaattccgctcctctctcaagatttacttatggtcatgtgctcagaaatgctcaaatgggtacaaccatcaccaagggtgggatgggagggcagaggggaaataaaatataaagcatcagttcttgcactctttgtacagaattggtataaaaaggataattccacactg

SEQ ID NO: 8135 - DNA, 4567 bp, Homo sapiens
atgctgaagcggaggcggccgctgctcgaggatcaaacagagcatactgaatcagcaggactggctggtggtgcagcagacatcatgagtaagcaccgagaagtctgttccttatcacgtgtgtaaggggaaaaaggtttaaacaagtctcttaagtggtgtttcctcaccgatggagaattacttccaagcagaagcttacaacctggacaaggtgttagatgaatttgaacaaaacgaagatgaaacagtttcttctactttattggatacaaagtggaataagattctagatcccccttctcaccggctgtcatttaaccctactttggccagtgtgaatgaatctgcagtttctaatgagtcacaaccacaactgaaagtcttctccctggctcattcagctcccctgaccacagaggaagaggatcactgtgctaatggacaggactgtaatctaaatccagagattgccacaatgtggattgatgaaaatgctgttgcagaagaccagttaattaagagaaactatagttgggatgatcaatgcagtgctgttgaagtgggagagaagaaatgtggaaacctggcttgtctgccagatgagaagaatgttcttgttgtagccgtcatgcataactgtgataaaaggacattacaaaacgatttacaggattgtaataattataatagtcaatcccttatggatgcttttagctgttcactggataatgaaaacagacaaactgatcaatttagttttagtataaatgagtccactgaaaaagatatgaattcagagaaacaaatggatccattgaatagaccgaaaacagaggggagatctgttaaccatctgtgtcctacttcatctgatagtctagccagtgtctgttccccttcacaattaaaggatgacggaagtataggtagagacccctccatgtctgcgattacaagtttaacggttgattcagtaatctcatcccagggaacagatggatgtcctgctgttaaaaagcaagagaactatataccagatgaggacctcactggcaaaatcagctctcctaggacagatctagggagtccaaattccttttcccacatgagtgaggggattttgatgaaaaaagagccagcagaggagagcaccactgaagaatccctccggtctggtttacctttgcttctcaaaccagacatgcctaatgggtctggaaggaataatgactgtgaacggtgttcagattgccttgtgcctaatgaagttagggctgatgaaaatgaaggttatgaacatgaagaaactcttggcactacagaattccttaatatgacagagcatttctctgaatctcaggacatgactaattggaagttgactaaactaaatgagatgaatgatagccaagtaaacgaagaaaaggaaaagtttctacagattagtcagcctgaggacactaatggtgatagtggaggacagtgtgttggattggcagatgcaggtctagatttaaaaggaacttgcattagtgaaagtgaagaatgtgatttctccactgttatagacacaccagcagcaaattatctatctaatggttgtgattcctatggaatgcaagacccaggtgtttcttttgttccaaagactttaccctccaaagaagattcagtaacagaagaaaaagaaatagaggaaagcaagtcagaatgctactcaaatatttatgaacagagaggaaatgaggccacagaagggagtggactacttttaaacagcactggtgacctaatgaagaaaaattatttacataatttctgtagtcaagttccatcagtgcttgggcaatcttcccccaaggtagtagcaagcctgccatctatcagtgttccttttggtggtgcaagacccaagcaaccttctaatcttaaacttcaaattccaaagccattatcagaccatttacaaaatgactttcctgcaaacagtggaaataatactaaaaataaaaatgatattcttgggaaagcaaaattaggggaaaactcagcaaccaatgtatgcagtccatctttgggaaacatctctaatgtcgatacaaatggggaacatttagaaagttatgaggctgagatctccactagaccatgccttgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggttttctgtgcttcctgctgtagcctgaaatgtaaactgttatacatggacagaaaggaagctagagtgtgtgtaatctgccattcagtgctaatgaatgtggctcagcccagagagcagaggcgagtttggtttgctgatgggatcttgcccaatggagaagttgctgatgcagccaaattaacaatgaatggaacttcctctgcaggaaccctggctgtgtcacacgacccagtcaagccagtaactaccagtcctctaccagcagagacggatatttgtctattctctgggagtataactcaggttggaagtcctgttggaagtgcaatgaatcttattcctgaagatggccttcctcccattctcatctccactggtgtaaaaggagactatgctgtggaagagaaaccatcacagatttcagtaatgcagcagttggaggatggtggccctgacccacttgtatttgttttaaatgcaaatttgttgtcaatggttaaaattgtaaattatgtgaacaggaagtgctggtgtttcacaaccaagggaatgcatgcagtgggtcagtctgagatagtcattcttctacagtgtttaccggatgaaaagtgtttgccaaaggatatctttaatcactttgtgcagctttatcgggatgctctggcagggaatgtggtgagcaacttgggacattccttcttcagtcaaagtttccttggcagtaaagaacatggtggattcttatatgtgacatctacctaccagtcactgcaagacctagtactcccaaccccaccttacttgtttgggattcttatccagaaatgggaaactccttgggctaaagtatttcctatccgtctgatgttgagacttggagctgaatatcgactttatccatgcccactattcagtgtcagatttcggaagccattgtttggagagacggggcataccatcatgaatcttcttgcagacttcagaaattaccagtataccttgccagtagttcaaggtttggtggttgatatggaagttcggaaaactagcatcaaaattcccagcaacagatacaatgagatgatgaaagccatgaacaagtccaatgagcatgtcctggcaggaggtgcctgcttcaatgaaaaggcagactctcatcttgtgtgtgtacagaatgatgatggaaactatcagacccaggctatcagtattcacaatcagcccagaaaagtgactggtgccagtttctttgtgttcagtggcgctctgaaatcctcttctggataccttgccaagtccagtattgtggaagatggtgttatggtccagattactgcagagaacatggattccttgaggcaggcactgcgagagatgaaggacttcaccatcacctgtgggaaggcggacgcggaggaaccccaggagcacatccacatccagtgggtggatgatgacaagaacgttagcaagggtgtcgtaagtcctatagatgggaagtccatggagactataacaaatgtgaagatattccatggatcagaatataaagcaaatggaaaagtaatcagatggacagaggtgtttttcctagaaaacgatgaccagcacaattgcctcagtgatcctgcagatcacagtagattgactgagcatgttgccaaagctttttgccttgctctctgtcctcacctgaaacttctgaaggaagatggaatgaccaaactgggactacgtgtgacacttgactcagatcaggttggctatcaagcagggagcaatggccagccccttccctcgcagtacatgaatgatctggacagcgccttggtgccggtgatccatggaggggcctgccagcttagtgagggccccgttgtcatggaactcatcttttatattctggaaaacatcgtataaacagagaagacttcatttttttctgttcagacttgttgcaacagcagtcatacccaaatcatttgcactttaaaactggaagattaagcttttgttaacactattaatggggtggggaatagggtgggagtgggggtttgggagacgggtgggaaagggtggttggggggaccgatgttccataattctaagtcttctatgcattgtccaccaagaagatctgggcagcttctgttcctgcacaacagttatgctatccttgcagctaatccccttctgttactgtttagacaa

SEQ ID NO: 8136 - DNA, 2625 bp, Homo sapiens
atgctgaagcggaggcggccgctgctcgaggatcaaacagagcatactgaatcagcaggactggctggtggtgcagcagacatcatgagtaagcaccgagaagtctgttccttatcacgtgtgtaaggggaaaaaggtttaaacaagtctcttaagtggtgtttcctcaccgatggagaattacttccaagcagaagcttacaacctggacaaggtgttagatgaatttgaacaaaacgaagatgaaacagtttcttctactttattggatacaaagtggaataagattctagatcccccttctcaccggctgtcatttaaccctactttggccagtgtgaatgaatctgcagtttctaatgagtcacaaccacaactgaaagtcttctccctggctcattcagctcccctgaccacagaggaagaggatcactgtgctaatggacaggactgtaatctaaatccagagattgccacaatgtggattgatgaaaatgctgttgcagaagaccagttaattaagagaaactatagttgggatgatcaatgcagtgctgttgaagtgggagagaagaaatgtggaaacctggcttgtctgccagatgagaagaatgttcttgttgtagccgtcatgcataactgtgataaaaggacattacaaaacgatttacaggattgtaataattataatagtcaatcccttatggatgcttttagctgttcactggataatgaaaacagacaaactgatcaatttagttttagtataaatgagtccactgaaaaagatatgaattcagagaaacaaatggatccattgaatagaccgaaaacagaggggagatctgttaaccatctgtgtcctacttcatctgatagtctagccagtgtctgttccccttcacaattaaaggatgacggaagtataggtagagacccctccatgtctgcgattacaagtttaacggttgattcagtaatctcatcccagggaacagatggatgtcctgctgttaaaaagcaagagaactatataccagatgaggacctcactggcaaaatcagctctcctaggacagatctagggagtccaaattccttttcccacatgagtgaggggattttgatgaaaaaagagccagcagaggagagcaccactgaagaatccctccggtctggtttacctttgcttctcaaaccagacatgcctaatgggtctggaaggaataatgactgtgaacggtgttcagattgccttgtgcctaatgaagttagggctgatgaaaatgaaggttatgaacatgaagaaactcttggcactacagaattccttaatatgacagagcatttctctgaatctcaggacatgactaattggaagttgactaaactaaatgagatgaatgatagccaagtaaacgaagaaaaggaaaagtttctacagattagtcagcctgaggacactaatggtgatagtggaggacagtgtgttggattggcagatgcaggtctagatttaaaaggaacttgcattagtgaaagtgaagaatgtgatttctccactgttatagacacaccagcagcaaattatctatctaatggttgtgattcctatggaatgcaagacccaggtgtttcttttgttccaaagactttaccctccaaagaagattcagtaacagaagaaaaagaaatagaggaaagcaagtcagaatgctactcaaatatttatgaacagagaggaaatgaggccacagaagggagtggactacttttaaacagcactggtgacctaatgaagaaaaattatttacataatttctgtagtcaagttccatcagtgcttgggcaatcttcccccaaggtagtagcaagcctgccatctatcagtgttccttttggtggtgcaagacccaagcaaccttctaatcttaaacttcaaattccaaagccattatcagaccatttacaaaatgactttcctgcaaacagtggaaataatactaaaaataaaaatgatattcttgggaaagcaaaattaggggaaaactcagcaaccaatgtatgcagtccatctttgggaaacatctctaatgtcgatacaaatggggaacatttagaaagttatgaggctgagatctccactagaccatgccttgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggttttctgtgcttcctgctgtagcctgaaatgtaaactgttatacatggacagaaaggaagctagagtgtgtgtaatctgccattcagtgctaatgaatggtaagtattaaaacaggttgatttcatagttattgagacaaaacaagggaattacgatgagaagacttttttccccctgcctttctttacaagttgctcaccttctcaaatgtcataactttaactgaaaatatttagctaaatttccatgttttgaaagtatcttagcatttca

SEQ ID NO: 8137 - DNA, 4874 bp, Homo sapiens
gcatactgaatcagcaggactggctggtggtgcagcagacatcatgagtaagcaccgagaagtctgttccttatcacgtgtgtaaggggaaaaaggtttaaacaagtctcttaagtggtgtttcctcaccgatggagaattacttccaagcagaagcttacaacctggacaaggtgttagatgaatttgaacaaaacgaagatgaaacagtttcttctactttattggatacaaagtggaataagattctagatcccccttctcaccggctgtcatttaaccctactttggccagtgtgaatgaatctgcagtttctaatgagtcacaaccacaactgaaagtcttctccctggctcattcagctcccctgaccacagaggaagaggatcactgtgctaatggacaggactgtaatctaaatccagagattgccacaatgtggattgatgaaaatgctgttgcagaagaccagttaattaagagaaactatagttgggatgatcaatgcagtgctgttgaagtgggagagaagaaatgtggaaacctggcttgtctgccagatgagaagaatgttcttgttgtagccgtcatgcataactgtgataaaaggacattacaaaacgatttacaggattgtaataattataatagtcaatcccttatggatgcttttagctgttcactggataatgaaaacagacaaactgatcaatttagttttagtataaatgagtccactgaaaaagatatgaattcagagaaacaaatggatccattgaatagaccgaaaacagaggggagatctgttaaccatctgtgtcctacttcatctgatagtctagccagtgtctgttccccttcacaattaaaggatgacggaagtataggtagagacccctccatgtctgcgattacaagtttaacggttgattcagtaatctcatcccagggaacagatggatgtcctgctgttaaaaagcaagagaactatataccagatgaggacctcactggcaaaatcagctctcctaggacagatctagggagtccaaattccttttcccacatgagtgaggggattttgatgaaaaaagagccagcagaggagagcaccactgaagaatccctccggtctggtttacctttgcttctcaaaccagacatgcctaatgggtctggaaggaataatgactgtgaacggtgttcagattgccttgtgcctaatgaagttagggctgatgaaaatgaaggttatgaacatgaagaaactcttggcactacagaattccttaatatgacagagcatttctctgaatctcaggacatgactaattggaagttgactaaactaaatgagatgaatgatagccaagtaaacgaagaaaaggaaaagtttctacagattagtcagcctgaggacactaatggtgatagtggaggacagtgtgttggattggcagatgcaggtctagatttaaaaggaacttgcattagtgaaagtgaagaatgtgatttctccactgttatagacacaccagcagcaaattatctatctaatggttgtgattcctatggaatgcaagacccaggtgtttcttttgttccaaagactttaccctccaaagaagattcagtaacagaagaaaaagaaatagaggaaagcaagtcagaatgctactcaaatatttatgaacagagaggaaatgaggccacagaagggagtggactacttttaaacagcactggtgacctaatgaagaaaaattatttacataatttctgtagtcaagttccatcagtgcttgggcaatcttcccccaaggtagtagcaagcctgccatctatcagtgttccttttggtggtgcaagacccaagcaaccttctaatcttaaacttcaaattccaaagccattatcagaccatttacaaaatgactttcctgcaaacagtggaaataatactaaaaataaaaatgatattcttgggaaagcaaaattaggggaaaactcagcaaccaatgtatgcagtccatctttgggaaacatctctaatgtcgatacaaatggggaacatttagaaagttatgaggctgagatctccactagaccatgccttgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggttttctgtgcttcctgctgtagcctgaaatgtaaactgttatacatggacagaaaggaagctagagtgtgtgtaatctgccattcagtgctaatgaatgctcaagcctgggagaacatgatgagtgcctcaagccagagccctaaccctaacaatcctgctgaatactgttctactatccctcccttgcagcaagctcaggcctcaggagctctgagctctccacctcccactgtgatggtacctgtgggagttttaaagcaccctggagcagaagtggctcagcccagagagcagaggcgagtttggtttgctgatgggatcttgcccaatggagaagttgctgatgcagccaaattaacaatgaatggaacttcctctgcaggaaccctggctgtgtcacacgacccagtcaagccagtaactaccagtcctctaccagcagagacggatatttgtctattctctgggagtataactcaggttggaagtcctgttggaagtgcaatgaatcttattcctgaagatggccttcctcccattctcatctccactggtgtaaaaggagactatgctgtggaagagaaaccatcacagatttcagtaatgcagcagttggaggatggtggccctgacccacttgtatttgttttaaatgcaaatttgttgtcaatggttaaaattgtaaattatgtgaacaggaagtgctggtgtttcacaaccaagggaatgcatgcagtgggtcagtctgagatagtcattcttctacagtgtttaccggatgaaaagtgtttgccaaaggatatctttaatcactttgtgcagctttatcgggatgctctggcagggaatgtggtgagcaacttgggacattccttcttcagtcaaagtttccttggcagtaaagaacatggtggattcttatatgtgacatctacctaccagtcactgcaagacctagtactcccaaccccaccttacttgtttgggattcttatccagaaatgggaaactccttgggctaaagtatttcctatccgtctgatgttgagacttggagctgaatatcgactttatccatgcccactattcagtgtcagatttcggaagccattgtttggagagacggggcataccatcatgaatcttcttgcagacttcagaaattaccagtataccttgccagtagttcaaggtttggtggttgatatggaagttcggaaaactagcatcaaaattcccagcaacagatacaatgagatgatgaaagccatgaacaagtccaatgagcatgtcctggcaggaggtgcctgcttcaatgaaaaggcagactctcatcttgtgtgtgtacagaatgatgatggaaactatcagacccaggctatcagtattcacaatcagcccagaaaagtgactggtgccagtttctttgtgttcagtggcgctctgaaatcctcttctggataccttgccaagtccagtattgtggaagatggtgttatggtccagattactgcagagaacatggattccttgaggcaggcactgcgagagatgaaggacttcaccatcacctgtgggaaggcggacgcggaggaaccccaggagcacatccacatccagtgggtggatgatgacaagaacgttagcaagggtgtcgtaagtcctatagatgggaagtccatggagactataacaaatgtgaagatattccatggatcagaatataaagcaaatggaaaagtaatcagatggacagaggtgtttttcctagaaaacgatgaccagcacaattgcctcagtgatcctgcagatcacagtagattgactgagcatgttgccaaagctttttgccttgctctctgtcctcacctgaaacttctgaaggaagatggaatgaccaaactgggactacgtgtgacacttgactcagatcaggttggctatcaagcagggagcaatggccagccccttccctcgcagtacatgaatgatctggacagcgccttggtgccggtgatccatggaggggcctgccagcttagtgagggccccgttgtcatggaactcatcttttatattctggaaaacatcgtataaacagagaagacttcatttttttctgttcagacttgttgcaacagcagtcatacccaaatcatttgcactttaaaactggaagattaagcttttgttaacactattaatggggtggggaatagggtgggagtgggggtttgggagacgggtgggaaagggtggttggggggaccgatgttccataattctaagtcttctatgcattgtccaccaagaagatctgggcagcttctgttcctgcacaacagttatgctatccttgcagctaatccccttctgttactgtttagacaagaattccgctcctctctcaagatttacttatggtcatgtgctcagaaatgctcaaatgggtacaaccatcaccaagggtgggatgggagggcagaggggaaataaaatataaagcatcagttcttgcactctttgtacagaattggtataaaaaggataattccacactga

SEQ ID NO: 8138 - DNA, 4622 bp, Homo sapiens
ccccctcctcttctcgcagaaattccaccgagtccgttactgggctcagacttttaagttaatttactgcccccctaccttggccagtaaccagcgcctttagggctagcctcccccccagctcctgcctgaaaaatgacatttcgccggtgtctccggagggggctgaatttcactttgtaactttctgcggaacccgagcccgggtggcagctcgggtggtggtatcgtatgcaaatacgcatgctgacgttacagatcatgtgggttttggcgtagattccccactgatcgaggcattttttttccctttttttttcctttttttttttcttttaaaaattttggccatcgttctccgtacgggggctttttctgtctgtctgtctggctggcaggctggctttccccctctttcccacggagcccgagccgggcgcccggtggggagtggggagtgggtggggggagccagcagagttccattttggaacgcccgtgccgcgtctccgcgttcccagcccgggtccccgcgttcacagccccagcgcaggtctggatgtaccgactgcttttggaataaaaagattcccaggatgtgagcaacacgggaccgatatgatgcttcctggtgtgtttagtggttggtgccattccaattttctgtgctgaaatcattctgaaaactcaaacagtagacttcagcacacaaggaaagccaaagccatttgagggggaataaagccaaaagcctttcaccttattcgttccaagaatctcaccgccccctccttatccccctccaaaaataagccattgcacacagacaggcagcatggctagcaaacgaaaatctacaactccatgcatggttcggacatcacaagtagtagaacaagatgtgcccgaggaagtagacagggccaaagagaaaggaatcggcacaccacagcctgacgtggccaaggacagttgggcagcagaacttgaaaactcttccaaagaaaacgaagtgatagaggtgaaatctatgggggaaagccagtccaaaaaactccaaggtggttatgagtgcaaatactgcccctactccacgcaaaacctgaacgagttcacggagcatgtcgacatgcagcatcccaacgtgattctcaaccccctctacgtgtgtgcagaatgtaacttcacaaccaaaaagtacgactccctatccgaccacaactccaagttccatcccggggaggccaacttcaagctgaagttaattaaacgcaataatcaaactgtcttggaacagtccatcgaaaccaccaaccatgtcgtgtccatcaccaccagtggccctggaactggtgacagtgattctgggatctcggtgagtaaaacccccatcatgaagcctggaaaaccaaaagcggatgccaagaaggtgcccaagaagcccgaggagatcacccccgagaaccacgtggaagggaccgcccgcctggtgacagacacagctgagatcctctcgagactcggcggggtggagctcctccaagacacattaggacacgtcatgccttctgtacagctgccaccaaatatcaaccttgtgcccaaggtccctgtcccactaaatactaccaaatacaactctgccctggatacaaatgccacgatgatcaactctttcaacaagtttccttacccgacccaggctgagttgtcctggctgacagctgcctccaaacacccagaggagcacatcagaatctggtttgccacccagcgcttaaagcatggcatcagctggtccccagaagaggtggaggaggcccggaagaagatgttcaacggcaccatccagtcagtacccccgaccatcactgtgctgcccgcccagttggcccccacaaaggtgacgcagcccatcctccagacggctctaccgtgccagatcctcggccagactagcctggtgctgactcaggtgaccagcgggtcaacaaccgtctcttgctcccccatcacacttgccgtggcaggagtcaccaaccatggccagaagagacccttggtgactccccaagctgcccccgaacccaagcgtccacacatcgctcaggtgccagagcccccacccaaggtggccaaccccccgctcacaccagccagtgaccgcaagaagacaaaggagcagatagcacatctcaaggccagctttctccagagccagttccctgacgatgccgaggtttaccggctcatcgaggtgactggccttgccaggagcgagatcaagaagtggttcagtgaccaccgatatcggtgtcaaaggggcatcgtccacatcaccagcgaatcccttgccaaagaccagttggccatcgcggcctcccgacacggtcgcacgtatcatgcgtacccagactttgccccccagaagttcaaagagaaaacacagggtcaggttaaaatcttggaagacagctttttgaaaagttcttttcctacccaagcagaactggatcggctaagggtggagaccaagctgagcaggagagagatcgactcctggttctcggagaggcggaagcttcgagacagcatggaacaagctgtcttggattccatggggtctggcaaaaaaggccaagatgtgggagcccccaatggtgctctgtctcgactcgaccagctctccggtgcccagttaacaagttctctgcccagcccttcgccagcaattgcaaaaagtcaagaacaggttcatctcctgaggagcacgtttgcaagaacccagtggcctactccccaggagtacgaccagttagcggccaagactggcctggtccgaactgagattgtgcgttggttcaaggagaacagatgcttgctgaaaacgggaaccgtgaagtggatggagcagtaccagcaccagcccatggcagatgatcacggctacgatgccgtagcaaggaaagcaacaaaacccatggccgagagcccaaagaacgggggtgatgtggttccacaatattacaaggaccccaaaaagctctgcgaagaggacttggagaagttggtgaccagggtaaaagtaggcagcgagccagcaaaagactgtttgccagcaaagccctcagaggccacctcagaccggtcagagggcagcagccgggacggccagggtagcgacgagaacgaggagtcgagcgttgtggattacgtggaggtgacggtcggggaggaggatgcgatctcagatagatcagatagctggagtcaggctgcggcagaaggtgtgtcggaactggctgaatcagactccgactgcgtccctgcagaggctggccaggcctagacagggaagtctgttagaactgctgtgctgatcaacgggacgctccgtctttgaagaaagaagagatggtctctccccagccatgggccacccttgccagtgactccaagtggaactacttagctcgcgtgtgcctggagggtgcgggaagtccagcgactctcagacgcacctcccagaggaccggtgggaattgttcatagtgccaaagtcctactactgcgttttcaatgggtccttgtacatagtttgctcctctgccctagccctcacctcttgctatactggaaccgatttgtacaatgtgggaattttgttacctttttaatcaagggcaacttccttttccagcactaccattgtaaggtttttttcaggagggagggctaaccaccttgcttttctcttttctctttttcttttttttatttttgttttattaatttggggaaaggggtgttagcattagtgccatgatatctactggattttaagtagggagactttatttttaaaggtaggttgaaatttgggagatttctcggcaggaagggctgaaatccaggcccctgtctcaacttggagagaggtgacagacggcagatcttccaaatcaaattcctttccagttcttcccctggctgcctttttgggggtccctgccttagccccacacaaggctttctgaactgccaagaggggatctggcttctcaactgctcggcctcttgggccaggctgtgcccagccagccctgggagaactgggtagcaggtggctgacttctttaagcacctttctaaataccagcagaagaggctcccgcctctgttagcatgatcagtactattgtgacattaaaacaacaacaataagatcttcctatctggagggtacagaggtgaatggctttggttttcatttctcttcttcactgccttttctcggtgtggtatttgacaagattttagctcaaagcctcaccatgaattgattttttttgtttgtgtgtgtgtttgttttgggacaattttagatacctgagtgcactttttcagttagtcctaacttttaaaagaaggaaaaccaagagacatatctggtgtacgtgttgcagtatgaactctggttgcaatccctccccgtcccacactgccccccatttgagtacaccgcacaagtcaaacgctaggaagtttgaataaaaccaatttttctaacttgttgctcatttgttgtaactcaataaagcaaagactaaacatttttataa

SEQ ID NO: 8139 - DNA, 873 bp, Homo sapiens
cccagtcccccattgactccatcctgctagaaaagagatggacacccaattgctctgccctgcttttgatactgagtttctgtcccctgtaggtctggatgtaccgactgcttttggaataaaaagattcccaggatgtgagcaacacgggaccgatatgatgcttcctggtgtgtttagtggttggtgccattccaattttctgtgctgaaatcattctgaaaactcaaacagtagacttcagcacacaaggaaagccaaagccatttgagggggaataaagccaaaagcctttcaccttattcgttccaagaatctcaccgccccctccttatccccctccaaaaataagccattgcacacagacaggcagcatggctagcaaacgaaaatctacaactccatgcatggttcggacatcacaagtagtagaacaagatgtgcccgaggaagtagacagggccaaagagaaaggaatcggcacaccacagcctgacgtggccaaggacagttgggcagcagaacttgaaaactcttccaaagaaaacgaagtgatagaggtgaaatctatgggggaaagccagtccaaaaaactccaaggtggttatgagtgcaaatactgcccctactccacgcaaaacctgaacgagttcacggagcatgtcgacatgcagcatcccaacgtgattctcaaccccctctacgtgtgtgcagaatgtaacttcacaaccaaaaagtacgactccctatccgaccacaactccaagttccatcccggggaggccaacttcaagctgaagttaattaaacgcaataatcaaactgtcttggaacagtccatcgaaaccaccaaccatgtcgtgtccatcacca

SEQ ID NO: 8140 - DNA, 922 bp, Homo sapiens
aggggcgggttttcggcggggccaacccacggtggggggagcgcggccatggcgctcctgctttcggtgctgcgtgtactgctgggcggcttcttcgcgctcgtggggttggccaagctctcggaggagatctcggctccagtttcggagcggatgaatgccctgttcgtgcagtttgctgaggtgttcccgctgaaggtatttggctaccagccagatcccctgaactaccaaatagctgtgggctttctggaactgctggctgggttgctgctggtcatgggcccaccgatgctgcaagagatcagtaacttgttcttgattctgctcatgatgggggctatcttcaccttggcagctctgaaagagtcactaagcacctgtatcccagccattgtctgcctggggttcctgctgctgctgaatgtcggccagctcttagcccagactaagaaggtggtcagacccactaggaagaagactctaagtacattcaaggaatcctggaagtagagcatctctgtctctttatgccatgcagctgtcacagcaggaacatggtagaacacagagtctatcatcttgttaccagtataatatccagggtcagccagtgttgaaagagacattttgtctacctggcactgctttctctttttagctttactactcttttgtgaggagtacatgttatgcatattaacattcctcatgtcatatgaaaatacaaaataagcagaaaagaaatttaaatcaaccaaaattctgatgccccaaataaccacttttaatgccttggtgtaagtatacctctgaacttttttctgtgcctttaaacagatatatattttttttaaatgaaaataaaaccatatatcctattttatttcctccttttaaaaccttataaactataacactg

SEQ ID NO: 8141 - DNA, 3619 bp, Homo sapiens
taaagggtgttaacataatcccccaatcccatacaattcaatttcagaaaagtatttagggactgtgctaaaatagcatctccaagcttgctatggcaagatgatgctcaggttttccatgtgcaggggaaatgatgaaggttttgcaatggaacaaatatggttgctgctgcttctaacaattagagtgcttccggggtctgctcagttcaacggctacaactgtgatgccaacctccacagtagatttcctgctgaaagagacatcagtgtctattgtggagtgcaggctattacgatgaagattaatttttgcacggtacttttctcgggttattcggaaacagatctggcactgaatggaaggcatggggactcccactgcagagggttcatcaataacaacacctttccagcagtggtcatttttatcatcaatctcagcaccttggagggctgtggaaacaacctggtggtatccacaattcctggagtcagtgcttatggaaatgcaacttcagtgcaagtaggaaatatttcaggatatattgatactccagacccaccaacaatcatcagctatctacctgggcttctttacaaatttagttgtagttatccattggaatacctggttaataatacccagcttgcttcgtcctcagcggctatttctgtgagagagaacaatggcacatttgtcagcactttgaacctgctcctttataacgattcaacctacaaccagcagttaattatccccagtataggattacctttgaaaaccaaagtatttgcagctgtccaagccactaatttggatggcagatggaatgttttaatggattattgctatactaccccatcaggaaacccaaatgatgacattcgatatgatcttttccttagctgtgacaaggaccctcagaccaccgtcattgagaatggccgaagccagcggggccggttttcttttgaagtgttccgatttgtgaaacacaagaatcagaaaatgtccactgtcttcttgcactgcgttaccaagctctgcagagcagatgactgccccttccttatgccgatttgcagccacagagaaaggagagatgctgggaggaggacgacttggagcccccagagctcttctggcagcgcggtgctctctgctggtcccatcattactcggagtgatgagactccaaccaacaattcgcaacttggttctccaagtatgcctcccttccagctgaacgccatcaccagcgcactgatatcaggaatggtcattctgggagttacgagcttttctcttcttctgtgctcactggcccttctgcacaggaagggacccacaagtttagtgttgaatggcataagaaacccagtctttgactgactataacagattcctgctctctggagaaggcttcactgactaaactatgtgtgactgcagtcagtgttccgtctgaatttcatgtcagtccacattcaatatttgtaggtttgataaatttcacagtatagcttgtcagcataatgatagtgaaagaagtttattatattgctattgtcacttatgtacgtggcgagccgtatttttatgccaccagtgaatatattgacaataagtgaaaaatattcaggacttagggcttacaggatcagtaatatttcattttatttcagttttcttttgattgttggttaaaagataaaaggtgggagtagacaaaaaatgaaatgtgttgcatttcccccttaagcattaatggcatttagatttgcacacgtggtcctagaataaatgttgctttttgttttaatccggatattcccagcttcaggatgtgttttaataggactggccaatttggatacctgagatttaactactcattctatgacctcctgtgtttttggccgattttcatgtctgaccatattcattttaaaagaaactcttgggacatatctcttaacctggggcacccttttgtgtagaagatagtgaaaatagttgttagcttccaaggctactgctaagtggccctagatcattattcattagaataggaatggctgcgatcagttttcttcttctggttcaggtgagaacaccagcacatgttaactctcctcccaggtaaacagttcagctgctgttgcagctgtgcttccagcagtgaggtaactatgcaaagattatttttaattcaagaatcatcacatgtgaaaacaagctgtagttgtgaaaagagttcctagaagggtttttaacaatttagattccctttttcctaaaacaaaaaggaaacttaggttaagtgtagtttgcagaacattgttggaatctacataaaaagatattccttcccccatattttcgatgccaggcaataatcaggagagggtttctttttaaggtatcttcttgtaggtgtcataattgccatgaataaacaatattttcctctaacagtaaactgcaagaagcttctgatcctttatcagttttgcaaaaaagcaagctttaagcagcccatgttcttacaaaaaaaatcaacattctctttgtttaagctacctatgcactgaacaaacaaaacaatttaatagccaacaccaaaacccagcatgtgaagttactagaattgccatgttaactataagcaattgctgtaatcactaatttctattcaacatttgtgacccattagtccggacttaatttactatactgcatgcaaatcatcaagcaattgcttcaaaggaaatgtctacaatgtgagttaataattaaatcaatcctcaagttgaaaaacactttttctccaatttgcctgaatatttcaggaggaagtgtttatattataataattagctatataattgcatcaactttttatttcaaggtatagttgccaagtaaagtgggatctggaaagtctctggataatttctttacaaaaaaagtttaaatcacataaaaagccaatctactcttccctgtgttactttaaaataactttgaagtgactattctgagctttatctgtgttaacatgattaactgaccatactactaatgtgaccctgtatatacatggatagtattgaaatatgctggtaaatctatttcagatactttaagtgaattgccattgattctacgattaagttctgtgaataggacattatatcatttaagctgttttgtcaatttgatttttatgcttttggaacggctgctgtttcagctgttggccttttcaattctatactccattttatagaattgaataatggacacatgtcacttgggaagcaacgtaagtatcacattattttttgccaccctttcatcataaatggaagaatcagagttataatgagataaaccaggtctgttttttacaactttgttcttataaatctgcagttatatggagtatttagttatactgaattttacagttattatagtgtgaaaaaccttacaaaatatgtgcaaatgtttcttcagttttaatacctcaaactgttttttgcacttcaggggtaaggtctgatgacatgtaaaagatgatcgtttaataaaataattgtttaaaatgtt

SEQ ID NO: 8142 - DNA, 1531 bp, Homo sapiens
tcccccaatcccatacaattcaatttcagaaaagtatttagggactgtgctaaaatagcatctccaagcttgctatggcaagatgatgctcaggttttccatgtgcaggggaaatgatgaaggatacacctctgtgttggggacaacagtgtgggtctagagtttccaatgtcttccaggagttcttgggacccatcatgagaaggaagtggtggagcatggagcatggaataaatgttttgcaatggaacaaatatggttgctgctgcttctaacaattagagtgcttccggggtctgctcagttcaacggctacaactgtgatgccaacctccacagtagatttcctgctgaaagagacatcagtgtctattgtggagtgcaggctattacgatgaagattaatttttgcacggtacttttctcgggttattcggaaacagatctggcactgaatggaaggcatggggactcccactgcagagggttcatcaataacaacacctttccagcagtggtcatttttatcatcaatctcagcaccttggagggctgtggaaacaacctggtggtatccacaattcctggagtcagtgcttatggaaatgcaacttcagtgcaagtaggaaatatttcaggatatattgatactccagacccaccaacaatcatcagctatctacctgggcttctttacaaatttagttgtagttatccattggaatacctggttaataatacccagcttgcttcgtcctcagcggctatttctgtgagagagaacaatggcacatttgtcagcactttgaacctgctcctttataacgattcaacctacaaccagcagttaattatccccagtataggattacctttgaaaaccaaagtatttgcagctgtccaagccactaatttggatggcagatggaatgttttaatggattattgctatactaccccatcaggaaacccaaatgatgacattcgatatgatcttttccttagctgtgacaaggaccctcagaccaccgtcattgagaatggccgaagccagcggggccggttttcttttgaagtgttccgatttgtgaaacacaagaatcagaaaatgtccactgtcttcttgcactgcgttaccaagctctgcagagcagatgactgccccttccttatgccgatttgcagccacagagaaaggagagatgctgggaggaggacgacttggagcccccagagctcttctggcagcgcggtgctctctgctggtcccatcattactcggagtgatgagactccaaccaacaattcgcaacttggttctccaagtatgcctcccttccagctgaacgccatcaccagcgcactgatatcaggaatggtcattctgggagttacgagcttttctcttcttctgtgctcactggcccttctgcacaggaagggacccacaagtttagtgttgaatggcataagaaacccagtctttgactgactataacagattcctgctctctggagaaggcttcactga

SEQ ID NO: 8143 - DNA, 2189 bp, Homo sapiens
agtatgtataaagtgcttagaagagggcctggaacataggacatggatgaagctggaaaccatcattctcagcagactaacacaggaacagaaaaccaaacaccagtgttccagatttgcattaagctgtcacccggtggctgtgtaactagctgcttttgtgactgttacagccgcaaaagccttaacagacctgcagttacagactcagggaaaagcttgtactgttgtttgtggatcgcagggaagccagagttgcagctgactttctgtccacgagatggcggtagaggagcacagaaaaaagaaaccatcttgggctgttaatcatgttgactgttgagaagctaagagggaagccgatctgtcattagggtgaaaaaaaaagtcactgtaacaggagtcaagaaggggcttagaacctagtcatgtgaatattttcaagtttttcttgccttgtgttttttcatcaaatgaggttcagtgaattcgggactcagtaactccattagtgactgcacccacatagacctttttctaaaagtctccacatttgtccagttgtttcctccttggtccaatgccaacgctccgtcaatgctattgccacccccattctgcctcttccaaaagcctgcatcagtcatggagtcctcttcacctgaaataagcacttagtataaaccgatgcaactggttttgtgctggaagacaagcttagcaacgacatttcaaaaagagcagctcttctctcatttgaagccttgactcttttctgaaaaagtttggtaaggtcaggcatttgaacactcagtcacatgcggcagaacctagcacatggaggacagctgactccacagaaccagggatttgggttttgcaatggaacaaatatggttgctgctgcttctaacaattagagtgcttccggggtctgctcagttcaacggctacaactgtgatgccaacctccacagtagatttcctgctgaaagagacatcagtgtctattgtggagtgcaggctattacgatgaagattaatttttgcacggtacttttctcgggttattcggaaacagatctggcactgaatggaaggcatggggactcccactgcagagggttcatcaataacaacacctttccagcagtggtcatttttatcatcaatctcagcaccttggagggctgtggaaacaacctggtggtatccacaattcctggagtcagtgcttatggaaatgcaacttcagtgcaagtaggaaatatttcaggatatattgatactccagacccaccaacaatcatcagctatctacctgggcttctttacaaatttagttgtagttatccattggaatacctggttaataatacccagcttgcttcgtcctcagcggctatttctgtgagagagaacaatggcacatttgtcagcactttgaacctgctcctttataacgattcaacctacaaccagcagttaattatccccagtataggattacctttgaaaaccaaagtatttgcagctgtccaagccactaatttggatggcagatggaatgttttaatggattattgctatactaccccatcaggaaacccaaatgatgacattcgatatgatcttttccttagctgtgacaaggaccctcagaccaccgtcattgagaatggccgaagccagcggggccggttttcttttgaagtgttccgatttgtgaaacacaagaatcagaaaatgtccactgtcttcttgcactgcgttaccaagctctgcagagcagatgactgccccttccttatgccgatttgcagccacagagaaaggagagatgctgggaggaggacgacttggagcccccagagctcttctggcagcgcggtgctctctgctggtcccatcattactcggagtgatgagactccaaccaacaattcgcaacttggttctccaagtatgcctcccttccagctgaacgccatcaccagcgcactgatatcaggaatggtcattctgggagttacgagcttttctcttcttctgtgctcactggcccttctgcacaggaagggacccacaagtttagtgttgaatggcataagaaacccagtctttgactgactataacagattcctgctctctggagaaggcttcactgactaaactatgtgtgactgca

SEQ ID NO: 8144 - protein, 376 aa, Artificial Sequence
  Description of Artificial Sequence: Synthetic coding sequence
MGLLAFLKTQFVLHLLVGFVFVVSGLVINFVQLCTLALWPVSKQLYRRLNCRLAYSLWSQLVMLLEWWSCTECTLFTDQATVERFGKEHAVIILNHNFEIDFLCGWTMCERFGVLGSSKVLAKKELLYVPLIGWTWYFLEIVFCKRKWEEDRDTVVEGLRRLSDYPEYMWFLLYCEGTRFTETKHRVSMEVAAAKGLPVLKYHLLPRTKGFTTAVKCLRGTVAAVYDVTLNFRGNKNPSLLGILYGKKYEADMCVRRFPLEDIPLDEKEAAQWLHKLYQEKDALQEIYNQKGMFPGEQFKPARRPWTLLNFLSWATILLSPLFSFVLGVFASGSPLLILTFLGFVGAASFGVRRLIGVTEIEKGSSYGNQEFKKKE

SEQ ID NO: 8145 - protein, 376 aa, Artificial Sequence; identical to SEQ ID NO: 8144
  Description of Artificial Sequence: Synthetic coding sequence

SEQ ID NO: 8146 - protein, 376 aa, Artificial Sequence; identical to SEQ ID NO: 8144
  Description of Artificial Sequence: Synthetic coding sequence

SEQ ID NO: 8147 - protein, 376 aa, Artificial Sequence; identical to SEQ ID NO: 8144
  Description of Artificial Sequence: Synthetic coding sequence

SEQ ID NO: 8148 - protein, 376 aa, Artificial Sequence; identical to SEQ ID NO: 8144
  Description of Artificial Sequence: Synthetic coding sequence

SEQ ID NO: 8149 - protein, 255 aa, Artificial Sequence
  Description of Artificial Sequence: Synthetic coding sequence
MGLLAFLKTQFVLHLLVGFVFVVSGLVINFVQLCTLALWPVSKQLYRRLNCRLAYSLWSQLVMLLEWWSCTECTLFTDQATVERFGKEHAVIILNHNFEIDFLCGWTMCERFGVLGSSKVLAKKELLYVPLIGWTWYFLEIVFCKRKWEEDRDTVVEGLRRLSDYPEYMWFLLYCEGTRFTETKHRVSMEVAAAKGLPVLKYHLLPRTKGFTTAVKCLRGTVAAVYDVTLNFRGNKNPSLLGILYGKKYEADMCV

SEQ ID NO: 8150 - protein, 370 aa, Artificial Sequence
  Description of Artificial Sequence: Synthetic coding sequence
MGLLAFLKTQFVLHLLVGFVFVVSGLVINFVQLCTLALWPVSKQLYRRLNCRLAYSLWSQLVMLLEWWSCTECTLFTDQATVERFGKEHAVIILNHNFEIDFLCGWTMCERFGVLGSSKVLAKKELLYVPLIGWTWYFLEIVFCKRKWEEDRDTVVEGLRRLSDYPEYMWFLLYCEGTRFTETKHRVSMEVAAAKGLPVLKYHLLPRTKGFTTAVKCLRGTVAAVYDVTLNFRGNKNPSLLGILYGKKYEADMCVRRFPLEDIPLDEKEGHCWPVAPVTHPEPGATLEAPRREGPGPPTGVWPVKLPAWAVVSWGRRWPPSLGPGARCHGVSCPSSQGCHCCLHRLPPCETLVVWYSATVYQTRTLCEVL

SEQ ID NO: 8151 - protein, 128 aa, Artificial Sequence
  Description of Artificial Sequence: Synthetic coding sequence
MGLLAFLKTQFVLHLLVGFVFVVSGLVINFVQLCTLALWPVSKQLYRRLNCRLAYSLWSQLVMLLEWWSCTECTLFTDQATVERFGKEHAVIILNHNFEIDFLCGWTMCERFGVLGSSKVLAKKELLY

SEQ ID NO: 8152 - protein, 79 aa, Artificial Sequence
  Description of Artificial Sequence: Synthetic coding sequence
MGLLAFLKTQFVLHLLVGFVFVVSGLVINFVQLCTLALWPVSKQLYRRLNCRLAYSLWSQLVMLLEWWSCTECTLFTDQ

SEQ ID NO: 8153 - protein, 38 aa, Artificial Sequence
  Description of Artificial Sequence: Synthetic coding sequence
MGLLAFLKTQFVLHLLVGFVFVVSGLVINFVQLCTLAL

SEQ ID NO: 8154 - protein, 255 aa, Artificial Sequence; identical to SEQ ID NO: 8149
  Description of Artificial Sequence: Synthetic coding sequence

SEQ ID NO: 8155 - protein, 376 aa, Artificial Sequence; identical to SEQ ID NO: 8144
  Description of Artificial Sequence: Synthetic coding sequence

SEQ ID NO: 8156 - protein, 378 aa, Artificial Sequence
  Description of Artificial Sequence: Synthetic coding sequence
MDLAGLLKSQFLCHLVFCYVFIASGLIINTIQLFTLLLWPINKQLFRKINCRLSYCISSQLVMLLEWWSGTECTIFTDPRAYLKYGKENAIVVLNHKFEIDFLCGWSLSERFGLLGGSKVLAKKELAYVPIIGWMWYFTEMVFCSRKWEQDRKTVATSLQHLRDYPEKYFFLIHCEGTRFTEKKHEISMQVARAKGLPRLKHHLLPRTKGFAITVRSLRNVVSAVYDCTLNFRNNENPTLLGVLNGKKYHADLYVRRIPLEDIPEDDDECSAWLHKLYQEKDAFQEEYYRTGTFPETPMVPPRRPWTLVNWLFWASLVLYPFFQFLVSMIRSGSSLTLASFILVFFVASVGVRWMIGVTEIDKGSAYGNSDSKQKLND

SEQ ID NO: 8157 - protein, 159 aa, Artificial Sequence
  Description of Artificial Sequence: Synthetic coding sequence
MDLAGLLKSQFLCHLVFCYVFIASGLIINTIQLFTLLLWPINKQLFRKINCRLSYCISSQLVMLLEWWSGTECTIFTDPRAYLKYGKENAIVVLNHKFEIDFLCGWSLSERFGLLGVSQKCIPPCLTHFSGSAPPLVFLLLVIQNLQKNQQSFYLMKWS

SEQ ID NO: 8158 - protein, 124 aa, Artificial Sequence
  Description of Artificial Sequence: Synthetic coding sequence
MLLEWWSGTECTIFTDPRAYLKYGKENAIVVLNHKFEIDFLCGWSLSERFGLLGGSKVLAKKELAYVPIIGWMWYFTEMVFCSRKWEQDRKTVATSLQHLRDYPEKYFVCRHQSSCVPRAPAGL

SEQ ID NO: 8159 - protein, 133 aa, Artificial Sequence
  Description of Artificial Sequence: Synthetic coding sequence
MDLAGLLKSQFLCHLVFCYVFIASGLIINTIQLFTLLLWPINKQLFRKINCRLSYCISSQLVMLLEWWSGTECTIFTDPRAYLKYGKENAIVVLNHKFEIDFLCGWSLSERFGLLGFDLLHVACMPLELGLFS

SEQ ID NO: 8160 - protein, 118 aa, Artificial Sequence
  Description of Artificial Sequence: Synthetic coding sequence
MDLAGLLKSQFLCHLVFCYVFIASGLIINTIQLFTLLLWPINKQLFRKINCRLSYCISSRLQGPGQERAGLCPNYRLDVVLHRDGLLFAQVGAGSQDGCHQFAAPPGLPREVFFPDSL

SEQ ID NO: 8161 - protein, 105 aa, Artificial Sequence
  Description of Artificial Sequence: Synthetic coding sequence
  MOD_RES (1)..(1): Any amino acid
XSAVYDCTLNFRNNENPTLLGVLNGKKYHADLYVRRIPLEDIPEDDDECSAWLHKLYQEKGWGDTEFSKQYVSVSRPGRLALCPSEKIAEQQVEVVHGFSKQSGE

SEQ ID NO: 8162 - protein, 216 aa, Artificial Sequence
  Description of Artificial Sequence: Synthetic coding sequence
MDLAGLLKSQFLCHLVFCYVFIASGLIINTIQLFTLLLWPINKQLFRKINCRLSYCISSLSAVYDCTLNFRNNENPTLLGVLNGKKYHADLYVRRIPLEDIPEDDDECSAWLHKLYQEKDAFQEEYYRTGTFPETPMVPPRRPWTLVNWLFWASLVLYPFFQFLVSMIRSGSSLTLASFILVFFVASVGVRWMIGVTEIDKGSAYGNSDSKQKLND

SEQ ID NO: 8163 - protein, 364 aa, Artificial Sequence [sequence omitted]

SEQ ID NO: 8164 - protein, 292 aa, Artificial Sequence
  Description of Artificial Sequence: Synthetic coding sequence
MAQPPPDVEGDDCLPAYRHLFCPDLLRDKVAFITGGGSGIGFRIAEIFMRHGCHTVIASRSLPRVLTAARKLAGATGRRCLPLSMDVRAPPAVMAAVDQALKEFGRIDILINCAAGNFLCPAGALSFNAFKTVMDIDTSGTFNVSRVLYEKFFRDHGGVIVNITATLGNRGQALQVHAGSAKAAVDAMTRHLAVEWGPQNIRVNSLAPGPISGTEGLRRLGGPQASLSTKVTASPLQRLGNKTEIAHSVLYLASPLASYVTGAVLVADGGAWLTFPNGVKGLPDFASFSAKL

SEQ ID NO: 8165 - protein, 211 aa, Artificial Sequence
  Description of Artificial Sequence: Synthetic coding sequence
MAQPPPDVEGDDCLPAYRHLFCPDLLRDKVAFITGGGSGIGFRIAEIFMRASEDQMGHCSSSGTCLAGVATFMVIVGKQPPNQKSRETKEQGRQIPFVCVRHGCHTVIASRSLPRVLTAARKLAGATGRRCLPLSMDVRAPPAVMAAVDQALKEFGRIDILINCSSSSCGLPFCRCGRELPVPRWRLVLQRLQDRDGHRYQRHLQCVSCAL

SEQ ID NO: 8166 - protein, 270 aa, Artificial Sequence
  Description of Artificial Sequence: Synthetic coding sequence
MPRDNMASLIQRIARQACLTFRGSGGGRGASDRDAASGPEAPMQPGFPENLSKLKSLLTQLRAEDLNIAPRKATLQPLPPNLPPVTYMHIYETDGFSLGVFLLKSGTSIPLHDHPGMHGMLKVLYGTVRISCMDKLDAGGGQRPRALPPEQQFEPPLQPREREAVRPGVLRSRAEYTEASGPCILTPHRDNLHQIDAVEGPAAFLDILAPPYDPDDGRDCHYYRVLEPVRPKEASSSACDLPREVWLLETPQADDFWCEGEPYPGPKVFP

SEQ ID NO: 8167 - protein, 343 aa, Artificial Sequence
  Description of Artificial Sequence: Synthetic coding sequence
MLATRLSRPLSRLPGKTLSACDRENGARRPLLLGSTSFIPIGRRTYASAAEPVGSKAVLVTGCDSGFGFSLAKHLHSKGFLVFAGCLMKDKGHDGVKELDSLNSDRLRTVQLNVCSSEEVEKVVEIVRSSLKDPEKGMWGLVNNAGISTFGEVEFTSLETYKQVAEVNLWGTVRMTKSFLPLIRRAKGRVVNISSMLGRMANPARSPYCITKFGVEAFSDCLRYEMYPLGVKVSVVEPGNFIAATSLYSPESIQAIAKKMWEELPEVVRKDYGKKYFDEKIAKMETYCSSGSTDTSPVIDAVTHALTATTPYTRYHPMDYYWWLRMQIMTHLPGAISDMIYIR

SEQ ID NO: 8168 - protein, 343 aa, Artificial Sequence; identical to SEQ ID NO: 8167
  Description of Artificial Sequence: Synthetic coding sequence

SEQ ID NO: 8169 - protein, 343 aa, Artificial Sequence; identical to SEQ ID NO: 8167
  Description of Artificial Sequence: Synthetic coding sequence

SEQ ID NO: 8170 - protein, 89 aa, Artificial Sequence
  Description of Artificial Sequence: Synthetic coding sequence
MLATRLSRPLSRLPGKTLSACDRENGARRPLLLGSTSFIPIGRRTYASAAEPVGSKAVLVTGCDSGFGFSLAKHLHSKGFLVFAGCLMK

SEQ ID NO: 8171 - protein, 256 aa, Artificial Sequence
  Description of Artificial Sequence: Synthetic coding sequence
MKDKGHDGVKELDSLNSDRLRTVQLNVCSSEEVEKVVEIVRSSLKDPEKGMWGLVNNAGISTFGEVEFTSLETYKQVAEVNLWGTVRMTKSFLPLIRRAKGRVVNISSMLGRMANPARSPYCITKFGVEAFSDCLRYEMYPLGVKVSVVEPGNFIAATSLYSPESIQAIAKKMWEELPEVVRKDYGKKYFDEKIAKMETYCSSGSTDTSPVIDAVTHALTATTPYTRYHPMDYYWWLRMQIMTHLPGAISDMIYIR

SEQ ID NO: 8172 - protein, 50 aa, Artificial Sequence
  Description of Artificial Sequence: Synthetic coding sequence
MLATRLSRPLSRLPGKTLSACDRENGARRPLLLGSTSFIPIGRRTYASAA

SEQ ID NO: 8173 - protein, 336 aa, Artificial Sequence
  Description of Artificial Sequence: Synthetic coding sequence
MAASLRLLGAASGLRYWSRRLRPAAGSFAAVCSRSVASKTPVGFIGLGNMGNPMAKNLMKHGYPLIIYDVFPDACKEFQDAGEQVVSSPADVAEKADRIITMLPTSINAIEAYSGANGILKKVKKGSLLIDSSTIDPAVSKELAKEVEKMGAVFMDAPVSGGVGAARSGNLTFMVGGVEDEFAAAQELLGCMGSNVVYCGAVGTGQAAKICNNMLLAISMIGTAEAMNLGIRLGLDPKLLAKILNMSSGRCWSSDTYNPVPGVMDGVPSANNYQGGFGTTLMAKDLGLAQDSATSTKSPILLGSLAHQIYRMMCAKGYSKKDFSSVFQFLREEETF

SEQ ID NO: 8174 - protein, 517 aa, Artificial Sequence
  Description of Artificial Sequence: Synthetic coding sequence
MAALRLLASVLGRGVPAGGSGLALSQGCARCFATSPRLRAKFYADPVEMVKDISDGATVMIGGFGLCGIPENLIAALLRTRVKDLQVVSSNVGVEDFGLGLLLAARQVRRIVCSYVGENTLCESQYLAGELELELTPQGTLAERIRAGGAGVPAFYTPTGYGTLVQEGGAPIRYTPDGHLALMSQPREVREFNGDHFLLERAIRADFALVKGWKADRAGNVVFRRSARNFNVPMCKAADVTAVEVEEIVEVGAFPPEDIHVPNIYVDRVIKGQKYEKRIERLTILKEEDGDAGKEEDARTRIIRRAALEFEDGMYANLGIGIPLLASNFISPSMTVHLHSENGILGLGPFPTEDEVDADLINAGKQTVTVLPGGCFFASDDSFAMIRGGHIQLTMLGAMQVSKYGDLANWMIPGKKVKGMGGAMDLVSSQKTRVVVTMQHCTKDNTPKIMEKCTMPLTGKRCVDRIITEKAVFDVHRKKELTLRELWEGLTVDDIKKSTGCAFAVSPNLRPMQQVAP

SEQ ID NO: 8175 - protein, 265 aa, Artificial Sequence
  Description of Artificial Sequence: Synthetic coding sequence
MAALRLLASVLGRGVPAGGSGLALSQGCARCFATSPRLRAKFYADPVEMVKDISDGATVMIGGFGLCGIPENLIAALLRTRVKDLQVVSSNVGVEDFGLGLLLAARQVRRIVCSYVGENTLCESQYLAGELELELTPQGTLAERIRAGGAGVPAFYTPTGYGTLVQEGGAPIRYTPDGHLALMSQPREVREFNGDHFLLERAIRADFALVKGWKADRAGNVVFRRSARNFNVPMCKAADVTAVEVEEIVEVGASPQKTSTFLTFM

SEQ ID NO: 8176 - protein, 327 aa, Artificial Sequence [sequence omitted]

SEQ ID NO: 8177 - protein, 164 aa, Artificial Sequence
  Description of Artificial Sequence: Synthetic coding sequence
MLGPQVWSSVRQGLSRSLSRNVGVWASGEGKKVDIAGIYPPVTTPFTATAEVDYGKLEENLHKLGTFPFRGAVGGVCALANVLGAQVCQLERLCCTGQWEDAQKLQHRLIEPNAAVTRRFGIPGLKKIMDWFGYYGGPCRAPLQELSPAEEEALRMDFTSNGWL

SEQ ID NO: 8178 - protein, 203 aa, Artificial Sequence
  Description of Artificial Sequence: Synthetic coding sequence
MAAAAVSSAKRSLRGELKQRLRAMSAEERLRQSRVLSQKVIAHSEYQKSKRISIFLSMQDEIETEEIIKDIFQRGKICFIPRYRFQSNHMDMVRIESPEEISLLPKTSWNIPQPGEGDVREEALSTGGLDLIFMPGLGFDKHGNRLGRGKGYYDAYLKRCLQHQEVKPYTLALAFKEQICLQVPVNENDMKVDEVLYEDSSTA

SEQ ID NO: 8179 - protein, 463 aa, Artificial Sequence
  Description of Artificial Sequence: Synthetic coding sequence
MHRSFLQARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 8180 - protein, 516 aa, Artificial Sequence
  Description of Artificial Sequence: Synthetic coding sequence
MLGKLAMLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGKAPPGSRAQSGEKPAPSHLLHVSLASALGCTGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 8181 - protein, 484 aa, Artificial Sequence
  Description of Artificial Sequence: Synthetic coding sequence
MLGKLAMLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 8182 - protein, 478 aa, Artificial Sequence
  Description of Artificial Sequence: Synthetic coding sequence
MLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 8183 - protein, 510 aa, Artificial Sequence
  Description of Artificial Sequence: Synthetic coding sequence
MLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGKAPPGSRAQSGEKPAPSHLLHVSLASALGCTGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 8184 - protein, 238 aa, Artificial Sequence
  Description of Artificial Sequence: Synthetic coding sequence
MLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTSGHPPAAPLLCGQPATAQHLPHGHGHRGLLPAPQQWREGLFQDYTPPGLLGLPDHRF

SEQ ID NO: 8185 - protein, 222 aa, Artificial Sequence
  Description of Artificial Sequence: Synthetic coding sequence
MVMDIVGFYLPPNSGERVSFKITLLLGYSVFLIIVSDTLPATAIGTPLIGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 8186 - protein, 1782 aa, Artificial Sequence
  Description of Artificial Sequence: Synthetic coding sequence
MGAGSSTEQRSPEQPPEGSSTPAEPEPSGGGPSAEAAPDTTADPAIAASDPATKLLQKNGQLSTINGVAEQDELSLQEGDLNGQKGALNGQGALNSQEEEEVIVTEVGQRDSEDVSKRDSDKEMATKSAVVHDITDDGQEETPEIIEQIPSSESNLEELTQPTESQANDIGFKKVFKFVGFKFTVKKDKTEKPDTVQLLTVKKDEGEGAAGAGDHKDPSLGAGEAASKESEPKQSTEKPEETLKREQSHAEISPPAESGQAVEECKEEGEEKQEKEPSKSAESPTSPVTSETGSTFKKFFTQGWAGWRKKTSFRKPKEDEVEASEKKKEQEPEKVDTEEDGKAEVASEKLTASEQAHPQEPAESAHEPRLSAEYEKVELPSEEQVSGSQGPSEEKPAPLATEVFDEKIEVHQEEVVAEVHVSTVEERTEEQKTEVEETAGSVPAEELVEMDAEPQEAEPAKELVKLKETCVSGEDPTQGADLSPDEKVLSKPPEGVVSEVEMLSSQERMKVQGSPLKKLFTSTGLKKLSGKKQKGKRGGGDEESGEHTQVPADSPDSQEEQKGESSASSPEEPEEITCLEKGLAEVQQDGEAEEGATSDGEKKREGVTPWASFKKMVTPKKRVRRPSESDKEDELDKVKSATLSSTESTASEMQEEMKGSVEEPKPEEPKRKVDTSVSWEALICVGSSKKRARRGSSSDEEGGPKAMGGDHQKADEAGKDKETGTDGILAGSQEHDPGQGSSSPEQAGSPTEGEGVSTWESFKRLVTPRKKSKSKLEEKSEDSIAGSGVEHSTPDTEPGKEESWVSIKKFIPGRRKKRPDGKQEQAPVEDAGPTGANEDDSDVPAVVPLSEYDAVEREKMEAQQAQKSAEQPEQKAATEVSKELSESQVHMMAAAVADGTRAATIIEERSPSWISASVTEPLEQVEAEAALLTEEVLEREVIAEEEPPTVTEPLPENREARGDTVVSEAELTPEAVTAAETAGPLGAEEGTEASAAEETTEMVSAVSQLTDSPDTTEEATPVQEVEGGVPDIEEQERRTQEVLQAVAEKVKEESQLPGTGGPEDVLQPVQRAEAERPEEQAEASGLKKETDVVLKVDAQEAKTEPFTQGKVVGQTTPESFEKAPQVTESIESSELVTTCQAETLAGVKSQEMVMEQAIPPDSVETPTDSETDGSTPVADFDAPGTTQKDEIVEIHEENEVASGTQSGGTEAEAVPAQKERPPAPSSFVFQEETKEQSKMEDTLEHTDKEVSVETVSILSKTEGTQEADQYADEKTKDVPFFEGLEGSIDTGITVSREKVTEVALKGEGTEEAECKKDDALELQSHAKSPPSPVEREMVVQVEREKTEAEPTHVNEEKLEHETAVTVSEEVSKQLLQTVNVPIIDGAKEVSSLEGSPPPCLGQEEAVCTKIQVQSSEASFTLTAAAEEEKVLGETANILETGETLEPAGAHLVLEEKSSEKNEDFAAHPGEDAVPTGPDCQAKSTPVIVSATTKKGLSSDLEGEKTTSLKWKSDEVDEQVACQEVKVSVAIEDLEPENGILELETKSSKLVQNIIQTAVDQFVRTEETATEMLTSELQTQAHVIKADSQDAGQETEKEGEEPQASAQDETPITSAKEESESTAVGQAHSDISKDMSEASEKTMTVEVEGSTVNDQQLEEVVLPSEEEGGGAGTKSVPEDDGHALLAERIEKSLVEPKEDEKGDDVDDPENQNSALADTDASGGLTKESPDTNGPKQKEKEDAQEVELQEGKVHSESDKAITPQAQEELQKQERESAKSELTES

SEQ ID NO: 8187 - protein, 1684 aa, Artificial Sequence
  Description of Artificial Sequence: Synthetic coding sequence
MLGTITITVGQRDSEDVSKRDSDKEMATKSAVVHDITDDGQEETPEIIEQIPSSESNLEELTQPTESQANDIGFKKVFKFVGFKFTVKKDKTEKPDTVQLLTVKKDEGEGAAGAGDHKDPSLGAGEAASKESEPKQSTEKPEETLKREQSHAEISPPAESGQAVEECKEEGEEKQEKEPSKSAESPTSPVTSETGSTFKKFFTQGWAGWRKKTSFRKPKEDEVEASEKKKEQEPEKVDTEEDGKAEVASEKLTASEQAHPQEPAESAHEPRLSAEYEKVELPSEEQVSGSQGPSEEKPAPLATEVFDEKIEVHQEEVVAEVHVSTVEERTEEQKTEVEETAGSVPAEELVEMDAEPQEAEPAKELVKLKETCVSGEDPTQGADLSPDEKVLSKPPEGVVSEVEMLSSQERMKVQGSPLKKLFTSTGLKKLSGKKQKGKRGGGDEESGEHTQVPADSPDSQEEQKGESSASSPEEPEEITCLEKGLAEVQQDGEAEEGATSDGEKKREGVTPWASFKKMVTPKKRVRRPSESDKEDELDKVKSATLSSTESTASEMQEEMKGSVEEPKPEEPKRKVDTSVSWEALICVGSSKKRARRGSSSDEEGGPKAMGGDHQKADEAGKDKETGTDGILAGSQEHDPGQGSSSPEQAGSPTEGEGVSTWESFKRLVTPRKKSKSKLEEKSEDSIAGSGVEHSTPDTEPGKEESWVSIKKFIPGRRKKRPDGKQEQAPVEDAGPTGANEDDSDVPAVVPLSEYDAVEREKMEAQQAQKSAEQPEQKAATEVSKELSESQVHMMAAAVADGTRAATIIEERSPSWISASVTEPLEQVEAEAALLTEEVLEREVIAEEEPPTVTEPLPENREARGDTVVSEAELTPEAVTAAETAGPLGAEEGTEASAAEETTEMVSAVSQLTDSPDTTEEATPVQEVEGGVPDIEEQERRTQEVLQAVAEKVKEESQLPGTGGPEDVLQPVQRAEAERPEEQAEASGLKKETDVVLKVDAQEAKTEPFTQGKVVGQTTPESFEKAPQVTESIESSELVTTCQAETLAGVKSQEMVMEQAIPPDSVETPTDSETDGSTPVADFDAPGTTQKDEIVEIHEENEVASGTQSGGTEAEAVPAQKERPPAPSSFVFQEETKEQSKMEDTLEHTDKEVSVETVSILSKTEGTQEADQYADEKTKDVPFFEGLEGSIDTGITVSREKVTEVALKGEGTEEAECKKDDALELQSHAKSPPSPVEREMVVQVEREKTEAEPTHVNEEKLEHETAVTVSEEVSKQLLQTVNVPIIDGAKEVSSLEGSPPPCLGQEEAVCTKIQVQSSEASFTLTAAAEEEKVLGETANILETGETLEPAGAHLVLEEKSSEKNEDFAAHPGEDAVPTGPDCQAKSTPVIVSATTKKGLSSDLEGEKTTSLKWKSDEVDEQVACQEVKVSVAIEDLEPENGILELETKSSKLVQNIIQTAVDQFVRTEETATEMLTSELQTQAHVIKADSQDAGQETEKEGEEPQASAQDETPITSAKEESESTAVGQAHSDISKDMSEASEKTMTVEVEGSTVNDQQLEEVVLPSEEEGGGAGTKSVPEDDGHALLAERIEKSLVEPKEDEKGDDVDDPENQNSALADTDASGGLTKESPDTNGPKQKEKEDAQEVELQEGKVHSESDKAITPQAQEELQKQERESAKSELTES

SEQ ID NO: 8188 - protein, 1677 aa, Artificial Sequence
  Description of Artificial Sequence: Synthetic coding sequence
MVGQRDSEDVSKRDSDKEMATKSAVVHDITDDGQEETPEIIEQIPSSESNLEELTQPTESQANDIGFKKVFKFVGFKFTVKKDKTEKPDTVQLLTVKKDEGEGAAGAGDHKDPSLGAGEAASKESEPKQSTEKPEETLKREQSHAEISPPAESGQAVEECKEEGEEKQEKEPSKSAESPTSPVTSETGSTFKKFFTQGWAGWRKKTSFRKPKEDEVEASEKKKEQEPEKVDTEEDGKAEVASEKLTASEQAHPQEPAESAHEPRLSAEYEKVELPSEEQVSGSQGPSEEKPAPLATEVFDEKIEVHQEEVVAEVHVSTVEERTEEQKTEVEETAGSVPAEELVEMDAEPQEAEPAKELVKLKETCVSGEDPTQGADLSPDEKVLSKPPEGVVSEVEMLSSQERMKVQGSPLKKLFTSTGLKKLSGKKQKGKRGGGDEESGEHTQVPADSPDSQEEQKGESSASSPEEPEEITCLEKGLAEVQQDGEAEEGATSDGEKKREGVTPWASFKKMVTPKKRVRRPSESDKEDELDKVKSATLSSTESTASEMQEEMKGSVEEPKPEEPKRKVDTSVSWEALICVGSSKKRARRGSSSDEEGGPKAMGGDHQKADEAGKDKETGTDGILAGSQEHDPGQGSSSPEQAGSPTEGEGVSTWESFKRLVTPRKKSKSKLEEKSEDSIAGSGVEHSTPDTEPGKEESWVSIKKFIPGRRKKRPDGKQEQAPVEDAGPTGANEDDSDVPAVVPLSEYDAVEREKMEAQQAQKSAEQPEQKAATEVSKELSESQVHMMAAAVADGTRAATIIEERSPSWISASVTEPLEQVEAEAALLTEEVLEREVIAEEEPPTVTEPLPENREARGDTVVSEAELTPEAVTAAETAGPLGAEEGTEASAAEETTEMVSAVSQLTDSPDTTEEATPVQEVEGGVPDIEEQERRTQEVLQAVAEKVKEESQLPGTGGPEDVLQPVQRAEAERPEEQAEASGLKKETDVVLKVDAQEAKTEPFTQGKVVGQTTPESFEKAPQVTESIESSELVTTCQAETLAGVKSQEMVMEQAIPPDSVETPTDSETDGSTPVADFDAPGTTQKDEIVEIHEENEVASGTQSGGTEAEAVPAQKERPPAPSSFVFQEETKEQSKMEDTLEHTDKEVSVETVSILSKTEGTQEADQYADEKTKDVPFFEGLEGSIDTGITVSREKVTEVALKGEGTEEAECKKDDALELQSHAKSPPSPVEREMVVQVEREKTEAEPTHVNEEKLEHETAVTVSEEVSKQLLQTVNVPIIDGAKEVSSLEGSPPPCLGQEEAVCTKIQVQSSEASFTLTAAAEEEKVLGETANILETGETLEPAGAHLVLEEKSSEKNEDFAAHPGEDAVPTGPDCQAKSTPVIVSATTKKGLSSDLEGEKTTSLKWKSDEVDEQVACQEVKVSVAIEDLEPENGILELETKSSKLVQNIIQTAVDQFVRTEETATEMLTSELQTQAHVIKADSQDAGQETEKEGEEPQASAQDETPITSAKEESESTAVGQAHSDISKDMSEASEKTMTVEVEGSTVNDQQLEEVVLPSEEEGGGAGTKSVPEDDGHALLAERIEKSLVEPKEDEKGDDVDDPENQNSALADTDASGGLTKESPDTNGPKQKEKEDAQEVELQEGKVHSESDKAITPQAQEELQKQERESAKSELTES

SEQ ID NO: 8189 - protein, 1782 aa, Artificial Sequence; identical to SEQ ID NO: 8186
  Description of Artificial Sequence: Synthetic coding sequence

SEQ ID NO: 8190 - protein, 427 aa, Artificial Sequence
  Description of Artificial Sequence: Synthetic coding sequence
METTISEIHVENKDEKRSAEGSPGAERQKEKASMLCFKRRKKAAKALKPKAGSEAADVARKCPQEAGASDQPEPTRGAWASLKRLVTRRKRSESSKQQKPLEGEMQPAINAEDADLSKKKAKSRLKIPCIKFPRGPKRSNHSKIIEDSDCSIKVQEEAEILDIQTQTPLNDQATKAKSTQDLSEGISRKDGDEVCESNVSNSTTSGEKVISVELGLDNGHSAIQTGTLILEEIETIKEKQDVQPQQASPLETSETDHQQPVLSDVPPLPAIPDQQIVEEASNSTLESAPNGKDYESTEIVAEETKPKDTELSQESDFKENGITEEKSKSEESKRMEPIAIIITDTEISEFDVTKSKNVPKQFLISAENEQVGVFANDNGFEDRTSEQYETLLIETASSLVKNAIQLSIEQLVNEMASDDNKINNLLQ

SEQ ID NO: 8191 - protein, 427 aa, Artificial Sequence; identical to SEQ ID NO: 8190
  Description of Artificial Sequence: Synthetic coding sequence

SEQ ID NO: 8192 - protein, 2319 aa, Artificial Sequence
  Description of Artificial Sequence: Synthetic coding sequence
MLTMSVTLSPLRSQDLDPMATDASPMAINMTPTVEQGEGEEAMKDMDSDQQYEKPPPLHTGADWKIVLHLPEIETWLRMTSERVRDLTYSVQQDSDSKHVDVHLVQLKDICEDISDHVEQIHALLETEFSLKLLSYSVNVIVDIHAVQLLWHQLRVSVLVLRERILQGLQDANGNYTRQTDILQAFSEETKEGRLDSLTEVDDSGQLTIKCSQNYLSLDCGITAFELSDYSPSEDLLSGLGDMTSSQVKTKPFDSWSYSEMEKEFPELIRSVGLLTVAADSISTNGSEAVTEEVSQVSLSVDDKGGCEEDNASAVEEQPGLTLGVSSSSGEALTNAAQPSSETVQQESSSSSHHDAKNQQPVPCENATPKRTIRDCFNYNEDSPTQPTLPKRGLFLKEETFKNDLKGNGGKRQMVDLKPEMSRSTPSLVDPPDRSKLCLVLQSSYPNSPSAASQSYECLHKVGNGNLENTVKFHIKEISSSLGRLNDCYKEKSRLKKPHKTSEEVPPCRTPKRGTGSGKQAKNTKSSAVPNGELSYTSKAIEGPQTNSASTSSLEPCNQRSWNAKLQLQSETSSSPAFTQSSESSVGSDNIMSPVPLLSKHKSKKGQASSPSHVTRNGEVVEAWYGSDEYLALPSHLKQTEVLALKLENLTKLLPQKPRGETIQNIDDWELSEMNSDSEIYPTYHVKKKHTRLGRVSPSSSSDIASSLGESIESGPLSDILSDEESSMPLAGMKKYADEKSERASSSEKNESHSATKSALIQKLMQDIQHQDNYEAIWEKIEGFVNKLDEFIQWLNEAMETTENWTPPKAEMDDLKLYLETHLSFKLNVDSHCALKEAVEEEGHQLLELIASHKAGLKDMLRMIASQWKELQRQIKRQHSWILRALDTIKAEILATDVSVEDEEGTGSPKAEVQLCYLEAQRDAVEQMSLKLYSEQYTSSSKRKEEFADMSKVHSVGSNGLLDFDSEYQELWDWLIDMESLVMDSHDLMMSEEQQQHLYKRYSVEMSIRHLKKTELLSKVEALKKGGVLLPNDLLEKVDSINEKWELLGKTLGEKIQDTMAGHSGSSPRDLLSPESGSLVRQLEVRIKELKGWLRDTELFIFNSCLRQEKEGTMNTEKQLQYFKSLCREIKQRRRGVASILRLCQHLLDDRETCNLNADHQPMQLIIVNLERRWEAIVMQAVQWQTRLQKKMGKESETLNVIDPGLMDLNGMSEDALEWDEMDISNKLISLNEESNDLDQELQPVIPSLKLGETSNEDPGYDEEADNHGGSQYASNITAPSSPHIYQVYSLHNVELYEDNHMPFLKNNPKVTGMTQPNVLTKSLSKDSSFSSTKSLPDLLGGSNLVKPCACHGGDMSQNSGSESGIVSEGDTETTTNSEMCLLNAVDGSPSNLETEHLDPQMGDAVNVLKQKFTDEGESIKLPNSSQSSISPVGCVNGKVGDLNSITKHTPDCLGEELQGKHDVFTFYDYSYLQGSKLKLPMIMKQSQSEKAHVEDPLLRGFYFDKKSCKSKHQTTELQPDVPPHERILASASHEMDRISYKSGNIEKTFTGMQNAKQLSLLSHSSSIESLSPGGDLFGLGIFKNGSDSLQRSTSLESWLTSYKSNEDLFSCHSSGDISVSSGSVGELSKRTLDLLNRLENIQSPSEQKIKRSVSDITLQSSSQKMSFTGQMSLDIASSINEDSAASLTELSSSDELSLCSEDIVLHKNKIPESNASFRKRLTRSVADESDVNVSMIVNVSCTSACTDDEDDSDLLSSSTLTLTEEELCIKDEDDDSSIATDDEIYEDCTLMSGLDYIKNELQTWIRPKLSLTRDKKRCNVSDEMKGSKDISSSEMTNPSDTLNIETLLNGSVKRVSENNGNGKNSSHTHELGTKRENKKTIFKVNKDPYVADMENGNIEGIPERQKGKPNVTSKVSENLGSHGKEISESEHCKCKALMDSLDDSNTAGKEFVSQDVRHLPKKCPNHHHFENQSTASTPTEKSFSELALETRFNNRQDSDALKSSDDAPSMAGKSAGCCLALEQNGTEENASISNISCCNCEPDVFHQKDAEDCSVHNFVKEIIDMASTALKSKSQPENEVAAPTSLTQIKEKVLEHSHRPIQLRKGDFYSYLSLSSHDSDCGEVTNYIEEKSSTPLPLDTTDSGLDDKEDIECFFEACVEGDSDGEEPCFSSAPPNESAVPSEAAMPLQATACSSEFSDSSLSADDADTVALSSPSSQERAEVGKEVNGLPQTSSGCAENLEFTPSKLDSEKESSGKPGESGMPEEHNAASAKSKVQDLSLKANQPTDKAALHPSPKTLTCEENLLNLHEKRHRNMHR

SEQ ID NO: 8193 - protein, 108 aa, Artificial Sequence
  Description of Artificial Sequence: Synthetic coding sequence
MLTMSVTLSPLRSQDLDPMATDASPMAINMTPTVEQGEGEEAMKDMDSDQQYEKPPPLHTGADWKIVLHLPEIETWLRMTSERVRDLTYSVQQDSDSKHVDVHLVQLK

SEQ ID NO: 8194 - protein, 81 aa, Artificial Sequence
  Description of Artificial Sequence: Synthetic coding sequence
MGQLCCFPFSRDEGKISEKNGGEPDDAELVRLSKRLVENAVLKAVQQYLEETQNKNKPGEGSSVKTEAADQNGNDNENNRK

SEQ ID NO: 8195 - protein, 326 aa, Artificial Sequence
  Description of Artificial Sequence: Synthetic coding sequence
MSEEFEANTMDSLVDMPFATVDIQDDCGITDEPQINLKRSQENEWVKSDQVKKRKKKRKDYQPNYFLSIPITNKEIIKGIKILQNAIIQQDERLAKAMVSDGSFHITLLVMQLLNEDEVNIGIDALLELKPFIEELLQGKHLTLPFQGIGTFGNQVGFVKLAEGDHVNSLLEIAETANRTFQEKGILVGESRSFKPHLTFMKLSKSPWLRKNGVKKIDPDLYEKFISHRFGEEILYRIDLCSMLKKKQSNGYYHCESSIVIGEKNGGEPDDAELVRLSKRLVENAVLKAVQQYLEETQNKNKPGEGSSVKTEAADQNGNDNENNRK

SEQ ID NO: 8196 - protein, 348 aa, Artificial Sequence
  Description of Artificial Sequence: Synthetic coding sequence
MERPEAGGINSNECENVSRKKKMSEEFEANTMDSLVDMPFATVDIQDDCGITDEPQINLKRSQENEWVKSDQVKKRKKKRKDYQPNYFLSIPITNKEIIKGIKILQNAIIQQDERLAKAMVSDGSFHITLLVMQLLNEDEVNIGIDALLELKPFIEELLQGKHLTLPFQGIGTFGNQVGFVKLAEGDHVNSLLEIAETANRTFQEKGILVGESRSFKPHLTFMKLSKSPWLRKNGVKKIDPDLYEKFISHRFGEEILYRIDLCSMLKKKQSNGYYHCESSIVIGEKNGGEPDDAELVRLSKRLVENAVLKAVQQYLEETQNKNKPGEGSSVKTEAADQNGNDNENNRK

SEQ ID NO: 8197 - protein, 104 aa, Artificial Sequence
  Description of Artificial Sequence: Synthetic coding sequence
MGQLCCFPFSRDEGKISELESSSSAVLQRYSKDIPSWSSGEKNGGEPDDAELVRLSKRLVENAVLKAVQQYLEETQNKNKPGEGSSVKTEAADQNGNDNENNRK

SEQ ID NO: 8198 - protein, 227 aa, Artificial Sequence
  Description of Artificial Sequence: Synthetic coding sequence
MAPDYGVMGMQGAGGYDSTMPYGCGRSQPRMRDRDRPKRRGFDRFGPDGTGRKRKQFQLYEEPDTKLARVDSEGDFSENDDAAGDFRSGDEEFKGEDELCDSGRQRGEKEDEDEDVKKRREKQRRRDRTRDRAADRIQFACSVCKFRSFDDEEIQKHLQSKFHKETLRFISTKLPDKTVEFLQEYIVNRNKKIEKRRQELMEKETAKPKPDPFKGELSSQDECFPGW

SEQ ID NO: 8199 - protein, 692 aa, Artificial Sequence
  Description of Artificial Sequence: Synthetic coding sequence
MDQGYGGYGAWSAGPANTQGAYGTGVASWQGYENYNYYGAQNTSVTTGATYSYGPASWEAAKANDGGLAAGAPAMHMASYGPEPCTDNSDSLIAKINQRLDMMSKEGGRGGSGGGGEGIQDRESSFRFQPFESYDSRPCLPEHNPYRPSYSYDYEFDLGSDRNGSFGGQYSECRDPARERGSLDGFMRGRGQGRFQDRSNPGTFMRSDPFVPPAASSEPLSTPWNELNYVGGRGLGGPSPSRPPPSLFSQSMAPDYGVMGMQGAGGYDSTMPYGCGRSQPRMRDRDRPKRRGFDRFGPDGTGRKRKQFQLYEEPDTKLARVDSEGDFSENDDAAGDFRSGDEEFKGEDELCDSGRQRGEKEDEDEDVKKRREKQRRRDRTRDRAADRIQFACSVCKFRSFDDEEIQKHLQSKFHKETLRFISTKLPDKTVEFLQEYIVNRNKKIEKRRQELMEKETAKPKPDPFKGIGQEHFFKKIEAAHCLACDMLIPAQPQLLQRHLHSVDHNHNRRLAAEQFKKTSLHVAKSVLNNRHIVKMLEKYLKGEDPFTSETVDPEMEGDDNLGGEDKKETPEEVAADVLAEVITAAVRAVDGEGAPAPESSGEPAEDEGPTDTAEAGSDPQAEQLLEEQVPCGTAHEKGVPKARSEAAEAGNGAETMAAEAESAQTRVAPAPAAADAEVEQTDAESKDAVPTE

SEQ ID NO: 8200 - protein, 626 aa, Artificial Sequence
  Description of Artificial Sequence: Synthetic coding sequence
MVAPWRVSVRVCLSHLRCFELRQGLSLLRPSECPRDARLCWLLLGTLPKVVSLCGDVGEGAPDVLSRRRVRCSGAAGAGPAESLPRAGPLGGVFLHLRLWLRAGALLVKFFPLLLLYPLTYLAPSVSTLWLHLLLKATETSGPTYIKLGQWASTRRDLFSEAFCAQFSKLHVRVTPHPWTHTERFLRQAFGDDWGSILSFENREPVGSGCVAQVYKAYANTAFLETDSVQRLGRASCLPPFSHTGAVGGLRELFGYLGNGRKPPENLADQSFLERLLLPKADLVGSNAGVSRAQVPGHQPEATNLISVAVKVLHPGLLAQVHMDLLLMKIGSRVLGVLPGIKWLSLPEIVEEFEKLMVQQIDLRYEAQNLEHFQVNFRNVKAVKFPTPLRPFVTREVLVETYEESVPVSSYQQAGIPVDLKRKIARLGINMLLKMIFVDNFVHADLHPGNILVQGANGLSSSQEAQLQQADICDTLVVAVPSSLCPLRLVLLDAGIVAELQAPDLRNFRAVFMAVVMGQGQRVAELILHHARASECRDVEGFKTEMAMLVTQARKNTITLEKLHVSSLLSSVFKLLMTHKVKLESNFASIVFAIMVLEGLGRSLDPKLDILEAARPFLLTGPVCPP

SEQ ID NO: 8201 - protein, 503 aa, Artificial Sequence
  Description of Artificial Sequence: Synthetic coding sequence
MWLKVGGLLRGTGGQLGQTVGWPCGALGPGPHRWGPCGGSWAQKFYQDGPGRGLGEEDIRRAREARPRKTPRPQLSDRSRERKVPASRISRLANFGGLAVGLGLGVLAEMAKKSMPGGRLQSDNSFISPQLQHIFERVRQSADFMPRWQMLRVLEEELGRDWQAKVASLEEVPFAAASIGQVHQGLLRDGTEVAVKIQYPGIAQSIQSDVQNLLAVLKMSAALPAGLFAEQSLQALQQELAWECDYRREAACAQNFRQLLANDPFFRVPAVVKELCTTRVLGMELAGGVPLDQCQGLSQDLRNQICFQLLTLCLRELFEFRFMQTDPNWANFLYDASSHQVTLLDFGASREFGTEFTDHYIEVVKAAADGDRDCVLQKSRDLKFLTGFETKAFSDAHVEAVMILGEPFATQGPYDFGSGETARRIQDLIPVLLRHRLCPPPEETYALHRKLAGAFLACAHLRAHIACRDLFQDTYHRYWASRQPDAATAGSLPTKGDSWVDPS

SEQ ID NO: 8202 - protein, 544 aa, Artificial Sequence
  Description of Artificial Sequence: Synthetic coding sequence
MWLKVGGLLRGTGGQLGQTVGWPCGALGPGPHRWGPCGGSWAQKFYQDGPGRGLGEEDIRRAREARPRKTPRPQLSDRSRERKVPASRISRLANFGGLAVGLGLGVLAEMAKKSMPGGRLQSEGGSGLDSSPFLSEANAERIVQTLCTVRGAALKVGQMLSIQDNSFISPQLQHIFERVRQSADFMPRWQMLRVLEEELGRDWQAKVASLEEVPFAAASIGQVHQGLLRDGTEVAVKIQYPGIAQSIQSDVQNLLAVLKMSAALPAGLFAEQSLQALQQELAWECDYRREAACAQNFRQLLANDPFFRVPAVVKELCTTRVLGMELAGGVPLDQCQGLSQDLRNQICFQLLTLCLRELFEFRFMQTDPNWANFLYDASSHQVTLLDFGASREFGTEFTDHYIEVVKAAADGDRDCVLQKSRDLKFLTGFETKAFSDAHVEAVMILGEPFATQGPYDFGSGETARRIQDLIPVLLRHRLCPPPEETYALHRKLAGAFLACAHLRAHIACRDLFQDTYHRYWASRQPDAATAGSLPTKGDSWVDPS

SEQ ID NO: 8203 - protein, 503 aa, Artificial Sequence; identical to SEQ ID NO: 8201
  Description of Artificial Sequence: Synthetic coding sequence

SEQ ID NO: 8204 - protein, 580 aa, Artificial Sequence
  Description of Artificial Sequence: Synthetic coding sequence
MWRPVQLCHFHSALLHRRQKPWPSPAVFFRRNVRGLPPRFSSPTPLWRKVLSTAVVGAPLLLGARYVMAEAREKRRMRLVVDGMGRFGRSLKVGLQISLDYWWCTNVVLRGVEENSPGYLEVMSACHQRAADALVAGAISNGGLYVKLGQGLCSFNHLLPPEYTRTLRVLEDRALKRGFQEVDELFLEDFQALPHELFQEFDYQPIAAASLAQVHRAKLHDGTSVAVKVQYIDLRDRFDGDIHTLELLLRLVEVMHPSFGFSWVLQDLKGTLAQELDFENEGRNAERCARELAHFPYVVVPRVHWDKSSKRVLTADFCAGCKVNDVEAIRSQGLAVHDIAEKLIKAFAEQIFYTGFIHSDPHPGNVLVRKGPDGKAELVLLDHGLYQFLEEKDRAALCQLWRAIILRDDAAMRAHAAALGVQDYLLFAEMLMQRPVRLGQLWGSHLLSREEAAYMVDMARERFEAVMAVLRELPRPMLLVLRNINTVRAINVALGAPVDRYFLMAKRAVRGWSRLAGATYRGVYGTSLLRHAKVVWEMLKFEVALRLETLAMRLTALLARALVHLSLVPPAEELYQYLET

SEQ ID NO: 8205 - protein, 306 aa, Artificial Sequence
  Description of Artificial Sequence: Synthetic coding sequence
MAVARLAAVAAWVPCRSWGWAAVPFGPHRGLSVLLARIPQRAPRWLPACRQKTSLSFLNRPDLPNLAYKKLKGKSPGIIFIPGYLSYMNGTKALAIEEFCKSLGHACIRFDYSGVGSSDGNSEESTLGKWRKDVLSIIDDLADGPQILVGSSLGGWLMLHAAIARPEKVVALIGVATAADTLVTKFNQLPVELKKEVEMKGVWSMPSKYSEEGVYNVQYSFIKEAEHHCLLHSPIPVNCPIRLLHGMKDDIVPWHTSMQVADRVLSTDVDVILRKHSDHRMREKADIQLLVYTIDDLIDKLSTIVN

SEQ ID NO: 8206 - protein, 149 aa, Artificial Sequence
  Description of Artificial Sequence: Synthetic coding sequence
MLHAAIARPEKVVALIGVATAADTLVTKFNQLPVELKKEVEMKGVWSMPSKYSEEGVYNVQYSFIKEAEHHCLLHSPIPVNCPIRLLHGMKDDIVPWHTSMQVADRVLSTDVDVILRKHSDHRMREKADIQLLVYTIDDLIDKLSTIVN

SEQ ID NO: 8207 - protein, 315 aa, Artificial Sequence
  Description of Artificial Sequence: Synthetic coding sequence
MRAGQQLASMLRWTRAWRLPREGLGPHGPSFARVPVAPSSSSGGRGGAEPRPLPLSYRLLDGEAALPAVVFLHGLFGSKTNFNSIAKILAQQTGRRVLTVDARNHGDSPHSPDMSYEIMSQDLQDLLPQLGLVPCVVVGHSMGGKTAMLLALQRPELVERLIAVDISPVESTGVSHFATYVAAMRAINIADELPRSRARKLADEQLSSVIQDMAVRQHLLTNLVEVDGRFVWRVNLDALTQHLDKILAFPQRQESYLGPTLFLLGGNSQFVHPSHHPEIMRLFPRAQMQTVPNAGHWIHADRPQDFIAAIRGFLV

SEQ ID NO: 8208 - protein, 145 aa, Artificial Sequence
  Description of Artificial Sequence: Synthetic coding sequence
MRAGQQLASMLRWTRAWRLPREGLGPHGPSFARVPVAPSSSSGGRGGAEPRLLDGEAALPAVVFLHGLFGSKTNFNSIAKILAQQTGRRVLTVDARNHGDSPHSPDMSYEIMSQDLQPAPHLGTEGLRQALCGHEVLQGWSDLRL

SEQ ID NO: 8209 - protein, 258 aa, Artificial Sequence
  Description of Artificial Sequence: Synthetic coding sequence
MRAGQQLASMLRWTRAWRLPREGLGPHGPSFARVPVAPSSSSGGRGGAEPRPLPLSYRLLDGEAALPAVVFLHGLFGSKTNFNSIAKILAQQTGRRVLTVDARNHGDSPHSPDMSYEIMSQDLQDLLPQLGLVPCVVVGHSMGGKTAMLLALQRDMAVRQHLLTNLVEVDGRFVWRVNLDALTQHLDKILAFPQRQESYLGPTLFLLGGNSQFVHPSHHPEIMRLFPRAQMQTVPNAGHWIHADRPQDFIAAIRGFLV

SEQ ID NO: 8210 - protein, 308 aa, Artificial Sequence
  Description of Artificial Sequence: Synthetic coding sequence
MRAGQQLASMLRWTRAWRLPREGLGPHGPSFARVPVAPSSSSGGRGGAEPRLLDGEAALPAVVFLHGLFGSKTNFNSIAKILAQQTGRRVLTVDARNHGDSPHSPDMSYEIMSQDLQDLLPQLGLVPCVVVGHSMGGKTAMLLALQRPELVERLIAVDISPVESTGVSHFATYVAAMRAINIADELPRSRARKLADEQLSSVIQDMAVRQHLLTNLVEVDGRFVWRVNLDALTQHLDKILAFPQRQESYLGPTLFLLGGNSQFVHPSHHPEIMRLFPRAQMQTVPNAGHWIHADRPQDFIAAIRGFLV

SEQ ID NO: 8211 - protein, 337 aa, Artificial Sequence
  Description of Artificial Sequence: Synthetic coding sequence
MEKSWMLWNFVERWLIALASWSWALCRISLLPLIVTFHLYGGIILLLLIFISIAGILYKFQDVLLYFPEQPSSSRLYVPMPTGIPHENIFIRTKDGIRLNLILIRYTGDNSPYSPTIIYFHGNAGNIGHRLPNALLMLVNLKVNLLLVDYRGYGKSEGEASEEGLYLDSEAVLDYVMTRPDLDKTKIFLFGRSLGGAVAIHLASENSHRISAIMVENTFLSIPHMASTLFSFFPMRYLPLWCYKNKFLSYRKISQCRMPSLFISGLSDQLIPPVMMKQLYELSPSRTKRLAIFPDGTHNDTWQCQGYFTALEQFIKEVVKSHSPEEMAKTSSNVTII

SEQ ID NO: 8212 - protein, 271 aa, Artificial Sequence
  Description of Artificial Sequence: Synthetic coding sequence
MVGALCGCWFRLGGARPLIPLGPTVVQTSMSRSQVALLGLSLLLMLLLYVGLPGPPEQTSCLWGDPNVTVLAGLTPGNSPIFYREVLPLNQAHRVEVVLLHGKAFNSHTWEQLGTLQLLSQRGYRAVALDLPGFGNSAPSKEASTEAGRAALLERALRDLEVQNAVLVSPSLSGHYALPFLMRGHHQLHGFVPIAPTSTQNYTQEQFWAVKTPTLILYGELDHILARESLRQLRHLPNHSVVKLRNAGHACYLHKPQDFHLVLLAFLDHLP

SEQ ID NO: 8213 - protein, 229 aa, Artificial Sequence [sequence omitted]

SEQ ID NO: 8214 - protein, 205 aa, Artificial Sequence
  Description of Artificial Sequence: Synthetic coding sequence
MLLLYVGLPGPPEQTSCLWGDPNVTVLAGLTPGNSPIFYREVLPLNQAHRVEVVLLHGKAFNSHTWEQLGTLQLLSQRGYRAVALDLPVPGSSNSPASASPVAEITGFVFLMCASASGPQLFPPLWPIAPTSTQNYTQEQFWAVKTPTLILYGELDHILARESLRQLRHLPNHSVVKLRNAGHACYLHKPQDFHLVLLAFLDHLP

SEQ ID NO: 8215 - protein, 154 aa, Artificial Sequence
  Description of Artificial Sequence: Synthetic coding sequence
MLLLYVGLPGPPEQTSCLWGDPNVTVLAGLTPGNSPIFYREVLPLNQAHRVEVVLLHGKAFNSHTWEQLGTLQLLSQRGYRAVALDLPVLGFGNSAPSKEASTEAGRAALLERALRDLEVQNAVLVSPSLSGHYALPFLMRGHHQLHGFVPIAP

SEQ ID NO: 8216 - protein, 337 aa, Artificial Sequence
  Description of Artificial Sequence: Synthetic coding sequence
MDLDVVNMFVIAGGTLAIPILAFVASFLLWPSALIRIYYWYWRRTLGMQVRYVHHEDYQFCYSFRGRPGHKPSILMLHGFSAHKDMWLSVVKFLPKNLHLVCVDMPGHEGTTRSSLDDLSIDGQVKRIHQFVECLKLNKKPFHLVGTSMGGQVAGVYAAYYPSDVSSLCLVCPAGLQYSTDNQFVQRLKELQGSAAVEKIPLIPSTPEEMSEMLQLCSYVRFKVPQQILQGLVDVRIPHNNFYRKLFLEIVSEKSRYSLHQNMDKIKVPTQIIWGKQDQVLDVSGADMLAKSIANCQVELLENCGHSVVMERPRKTAKLIIDFLASVHNTDNNKKLD

SEQ ID NO: 8217 - protein, 225 aa, Artificial Sequence
  Description of Artificial Sequence: Synthetic coding sequence
MDLDVVNMFVIAGGTLAIPILAFVASFLLWPSALIRIYYWYWRRTLGMQVRYVHHEDYQFCYSFRGRPGHKPSILMLHGFSAHKDMWLSVVKFLPKNLHLVCVDMPGHEGTTRSSLDDLSIDGQVKRIHQFVECLKLNKKPFHLVGTSMGGQVAGVYAAYYPSDVSSLCLVCPAGLQYSTDNQFVQRLKELQGSAAVEKIPLIPSTPEEMSEMLQLCSYVRFKVP

SEQ ID NO: 8218 - protein, 337 aa, Artificial Sequence; identical to SEQ ID NO: 8216
  Description of Artificial Sequence: Synthetic coding sequence

SEQ ID NO: 8219 - protein, 173 aa, Artificial Sequence
  Description of Artificial Sequence: Synthetic coding sequence
MDLDVVNMFVIAGGTLAIPILAFVASFLLWPSALIRIYYWYWRRTLGMQVRYVHHEDYQFCYSFRGRPGHKPSILMLHGFSAHKDMWLSVVKFLPKNLHLVCVDMPGHEGTTRSSLDDLSIDGQVKRIHQFVECLKLNKKPFHLVGTSMGGQVAGVYAAYYPSDVSSLCLVCP

SEQ ID NO: 8220 - protein, 318 aa, Artificial Sequence
  Description of Artificial Sequence: Synthetic coding sequence
MDLDVVNMFVIAGGTLAIPILAFVASFLLWPSALIRIYYWYWRRTLGMQVRYVHHEDYQFCYSFRGRPGHKPSILMLHGFSAHKDMWLSVVKFLPKNLHLVCVDMPGHEGTTRSSLDDLSIDGQVKRIHQFVECLKLNKKPFHLVGTSMGGQVAGVYAAYYPSDVSSLCLVCPAGLQYSTDNQFVQRLKELQGSAAVEKIPLIPSTPEEMSEMLQLCSYVRFKVPQQILQGLVDVRIPHNNFYRKLFLEIVSEKSRYSLHQNMDKIKVPTQIIWGKQDQVLDVSGADVGQVNCQLPGGASGKLWALSSDGKPGRQPSS

SEQ ID NO: 8221 - protein, 397 aa, Artificial Sequence
  Description of Artificial Sequence: Synthetic coding sequence
MALLRGVFVVAAKRTPFGAYGGLLKDFTATDLSEFAAKAALSAGKVSPETVDSVIMGNVLQSSSDAIYLARHVGLRVGIPKETPALTINRLCGSGFQSIVNGCQEICVKEAEVVLCGGTESMSQAPYCVRNVRFGTKLGSDIKLEDSLWVSLTDQHVQLPMAMTAENLAVKHKISREECDKYALQSQQRWKAANDAGYFNDEMAPIEVKTKKGKQTMQVDEHARPQTTLEQLQKLPPVFKKDGTVTAGNASGVADGAGAVIIASEDAVKKHNFTPLARIVGYFVSGCDPSIMGIGPVPAISGALKKAGLSLKDMDLVEVNEAFAPQYLAVERSLDLDISKTNVNGGAIALGHPLGGSGSRITAHLVHELRRRGGKYAVGSACIGGGQGIAVIIQSTA

SEQ ID NO: 8222 - protein, 125 aa, Artificial Sequence
  Description of Artificial Sequence: Synthetic coding sequence
MPGRHVSRVRALYKRVLQLHRVLPPDLKSLGDQYVKDEFRRHKTVGSDEAQRFLQEWEVYATALLQQANENRQNSTGKACFGTFLPEEKLNDFRDEQIGQLQELMQEATKPNRQFSISESMKPKF

SEQ ID NO: 8223 - protein, 534 aa, Artificial Sequence
  Description of Artificial Sequence: Synthetic coding sequence
MFQFHAGSWESWCCCCLIPADRPWDRGQHWQLEMADTRSVHETRFEAAVKVIQSLPKNGSFQPTNEMMLKFYSFYKQATEGPCKLSRPGFWDPIGRYKWDAWSSLGDMTKEEAMIAYVEEMKKIIETMPMTEKVEELLRVIGPFYEIVEDKKSGRSSDITSVRLEKISKCLEDLGNVLTSTPNAKTVNGKAESSDSGAESEEEEAQEEVKGAEQSDNDKKMMKKSADHKNLEVIVTNGYDKDGFVQDIQNDIHASSSLNGRSTEEVKPIDENLGQTGKSAVCIHQDINDDHVEDVTGIQHLTSDSDSEVYCDSMEQFGQEESLDSFTSNNGPFQYYLGGHSSQPMENSGFREDIQVPPGNGNIGNMQVVAVEGKGEVKHGGEDGRNNSGAPHREKRGGETDEFSNVRRGRGHRMQHLSEGTKGRQVGSGGDGERWGSDRGSRGSLNEQIALVLMRLQEDMQNVLQRLQKLETLTALQAKSSTSTLQTAPQPTSQRPSWWPFEMSPGVLTFAIIWPFIAQWLVYLYYQRRRRKLN

SEQ ID NO: 8224 - protein, 531 aa, Artificial Sequence
  Description of Artificial Sequence: Synthetic coding sequence
FHAGSWESWCCCCLIPADRPWDRGQHWQLEMADTRSVHETRFEAAVKVIQSLPKNGSFQPTNEMMLKFYSFYKQATEGPCKLSRPGFWDPIGRYKWDAWSSLGDMTKEEAMIAYVEEMKKIIETMPMTEKVEELLRVIGPFYEIVEDKKSGRSSDITSVRLEKISKCLEDLGNVLTSTPNAKTVNGKAESSDSGAESEEEEAQEEVKGAEQSDNDKKMMKKSADHKNLEVIVTNGYDKDGFVQDIQNDIHASSSLNGRSTEEVKPIDENLGQTGKSAVCIHQDINDDHVEDVTGIQHLTSDSDSEVYCDSMEQFGQEESLDSFTSNNGPFQYYLGGHSSQPMENSGFREDIQVPPGNGNIGNMQVVAVEGKGEVKHGGEDGRNNSGAPHREKRGGETDEFSNVRRGRGHRMQHLSEGTKGRQVGSGGDGERWGSDRGSRGSLNEQIALVLMRLQEDMQNVLQRLQKLETLTALQAKSSTSTLQTAPQPTSQRPSWWPFEMSPGVLTFAIIWPFIAQWLVYLYYQRRRRKLN

SEQ ID NO: 8225 - protein, 348 aa, Artificial Sequence
  Description of Artificial Sequence: Synthetic coding sequence
MTKEEAMIAYVEEMKKIIETMPMTEKVEELLRVIGPFYEIVEDKKSGRSSDITSDLGNVLTSTPNAKTVNGKAESSDSGAESEEEEAQEEVKGAEQSDNDINDDHVEDVTGIQHLTSDSDSEVYCDSMEQFGQEESLDSFTSNNGPFQYYLGGHSSQPMENSGFREDIQVPPGNGNIGNMQVVAVEGKGEVKHGGEDGRNNSGAPHREKRGGETDEFSNVRRGRGHRMQHLSEGTKGRQVGSGGDGERWGSDRGSRGSLNEQIALVLMRLQEDMQNVLQRLQKLETLTALQAKSSTSTLQTAPQPTSQRPSWWPFEMSPGVLTFAIIWPFIAQWLVYLYYQRRRRKLN

SEQ ID NO: 8226 - protein, 416 aa, Artificial Sequence
  Description of Artificial Sequence: Synthetic coding sequence
MTKEEAMIAYVEEMKKIIETMPMTEKVEELLRVIGPFYEIVEDKKSGRSSDITSDLGNVLTSTPNAKTVNGKAESSDSGAESEEEEAQEEVKGAEQSDNDKKMMKKSADHKNLEVIVTNGYDKDGFVQDIQNDIHASSSLNGRSTEEVKPIDENLGQTGKSAVCIHQDINDDHVEDVTGIQHLTSDSDSEVYCDSMEQFGQEESLDSFTSNNGPFQYYLGGHSSQPMENSGFREDIQVPPGNGNIGNMQVVAVEGKGEVKHGGEDGRNNSGAPHREKRGGETDEFSNVRRGRGHRMQHLSEGTKGRQVGSGGDGERWGSDRGSRGSLNEQIALVLMRLQEDMQNVLQRLQKLETLTALQAKSSTSTLQTAPQPTSQRPSWWPFEMSPGVLTFAIIWPFIAQWLVYLYYQRRRRKLN

SEQ ID NO: 8227 - protein, 490 aa, Artificial Sequence
  Description of Artificial Sequence: Synthetic coding sequence
MADTRSVHETRFEAAVKVIQSLPKNGSFQPTNEMMLKFYSFYKQATEGPCKLSRPGFWDPIGRYKWDAWSSLGDMTKEEAMIAYVEEMKKIIETMPMTEKVEELLRVIGPFYEIVEDKKSGRSSDITSDLGNVLTSTPNAKTVNGKAESSDSGAESEEEEAQEEVKGAEQSDNDKKMMKKSADHKNLEVIVTNGYDKDGFVQDIQNDIHASSSLNGRSTEEVKPIDENLGQTGKSAVCIHQDINDDHVEDVTGIQHLTSDSDSEVYCDSMEQFGQEESLDSFTSNNGPFQYYLGGHSSQPMENSGFREDIQVPPGNGNIGNMQVVAVEGKGEVKHGGEDGRNNSGAPHREKRGGETDEFSNVRRGRGHRMQHLSEGTKGRQVGSGGDGERWGSDRGSRGSLNEQIALVLMRLQEDMQNVLQRLQKLETLTALQAKSSTSTLQTAPQPTSQRPSWWPFEMSPGVLTFAIIWPFIAQWLVYLYYQRRRRKLN

SEQ ID NO: 8228 - protein, 525 aa, Artificial Sequence
  Description of Artificial Sequence: Synthetic coding sequence
MLFLSFHAGSWESWCCCCLIPADRPWDRGQHWQLEMADTRSVHETRFEAAVKVIQSLPKNGSFQPTNEMMLKFYSFYKQATEGPCKLSRPGFWDPIGRYKWDAWSSLGDMTKEEAMIAYVEEMKKIIETMPMTEKVEELLRVIGPFYEIVEDKKSGRSSDITSDLGNVLTSTPNAKTVNGKAESSDSGAESEEEEAQEEVKGAEQSDNDKKMMKKSADHKNLEVIVTNGYDKDGFVQDIQNDIHASSSLNGRSTEEVKPIDENLGQTGKSAVCIHQDINDDHVEDVTGIQHLTSDSDSEVYCDSMEQFGQEESLDSFTSNNGPFQYYLGGHSSQPMENSGFREDIQVPPGNGNIGNMQVVAVEGKGEVKHGGEDGRNNSGAPHREKRGGETDEFSNVRRGRGHRMQHLSEGTKGRQVGSGGDGERWGSDRGSRGSLNEQIALVLMRLQEDMQNVLQRLQKLETLTALQAKSSTSTLQTAPQPTSQRPSWWPFEMSPGVLTFAIIWPFIAQWLVYLYYQRRRRKLN

SEQ ID NO: 8229 - protein, 251 aa, Artificial Sequence
  Description of Artificial Sequence: Synthetic coding sequence
MADTRSVHETRFEAAVKVIQSLPKNGSFQPTNEMMLKFYSFYKQATEGPCKLSRPGFWDPIGRYKWDAWSSLGDMTKEEAMIAYVEEMKKIIETMPMTEKVEELLRVIGPFYEIVEDKKSGRSSDITSVRLEKISKCLEDLGNVLTSTPNAKTVNGKAESSDSGAESEEEEAQEEVKGAEQSDNDKKMMKKSADHKNLEVIVTNGYDKDGFVQDIQNDIHASSSLNGRSTEEVKPIDENLGQTGKSAVCIH

SEQ ID NO: 8230 - protein, 294 aa, Artificial Sequence
  Description of Artificial Sequence: Synthetic coding sequence
MPGPPLSSARHALPLGSWESWCCCCLIPADRPWDRGQHWQLEMADTRSVHETRFEAAVKVIQSLPKNGSFQPTNEMMLKFYSFYKQATEGPCKLSRPGFWDPIGRYKWDAWSSLGDMTKEEAMIAYVEEMKKIIETMPMTEKVEELLRVIGPFYEIVEDKKSGRSSDITSVRLEKISKCLEDLGNVLTSTPNAKTVNGKAESSDSGAESEEEEAQEEVKGAEQSDNDKKMMKKSADHKNLEVIVTNGYDKDGFVQDIQNDIHASSSLNGRSTEEVKPIDENLGQTGKSAVCIHQ

SEQ ID NO: 8231 - protein, 328 aa, Artificial Sequence
  Description of Artificial Sequence: Synthetic coding sequence
MAHSKQPSHFQSLMLLQWPLSYLAIFWILQPLFVYLLFTSLWPLPVLYFAWLFLDWKTPERGGRRSAWVRNWCVWTHIRDYFPITILKTKDLSPEHNYLMGVHPHGLLTFGAFCNFCTEATGFSKTFPGITPHLATLSWFFKIPFVREYLMAKGVCSVSQPAINYLLSHGTGNLVGIVVGGVGEALQSVPNTTTLILQKRKGFVRTALQHGAHLVPTFTFGETEVYDQVLFHKDSRMYKFQSCFRRIFGFYCCVFYGQSFCQGSTGLLPYSRPIVTVVGEPLPLPQIEKPSQEMVDKYHALYMDALHKLFDQHKTHYGCSETQKLFFL

SEQ ID NO: 8232 - protein, 333 aa, Artificial Sequence
  Description of Artificial Sequence: Synthetic coding sequence
MLLPSKKDLKTALDVFAVFQWSFSALLITTTVIAVNLYLVVFTPYWPVTVLILTWLAFDWKTPQRGGRRFTCVRHWRLWKHYSDYFPLKLLKTHDICPSRNYILVCHPHGLFAHGWFGHFATEASGFSKIFPGITPYILTLGAFFWMPFLREYVMSTGACSVSRSSIDFLLTHKGTGNMVIVVIGGLAECRYSLPGSSTLVLKNRSGFVRMALQHGVPLIPAYAFGETDLYDQHIFTPGGFVNRFQKWFQSMVHIYPCAFYGRGFTKNSWGLLPYSRPVTTIVGEPLPMPKIENPSQEIVAKYHTLYIDALRKLFDQHKTKFGISETQELEII

SEQ ID NO: 8233 - protein, 739 aa, Artificial Sequence
  Description of Artificial Sequence: Synthetic coding sequence
MFLLLALLTELGRLQAHEGSEGIFLHVTVPRKIKSNDSEVSERKMIYIITIDGQPYTLHLGKQSFLPQNFLVYTYNETGSLHSVSPYFMMHCHYQGYAAEFPNSFVTLSICSGLRGFLQFENISYGIEPVESSARFEHIIYQMKNNDPNVSILAVNYSHIWQKDQPYKVPLNSQIKNLSKLLPQYLEIYIIVEKALYDYMGSEMMAVTQKIVQVIGLVNTMFTQFKLTVILSSLELWSNENQISTSGDADDILQRFLAWKRDYLILRPHDIAYLLVYRKHPKYVGATFPGTVCNKSYDAGIAMYPDAIGLEGFSVIIAQLLGLNVGLTYDDITQCFCLRATCIMNHEAVSASGRKIFSNCSMHDYRYFVSKFETKCLQKLSNLQPLHQNQPVCGNGILESNEECDCGNKNECQFKKCCDYNTCKLKGSVKCGSGPCCTSKCELSIAGTPCRKSIDPECDFTEYCNGTSSNCVPDTYALNGRLCKLGTAYCYNGQCQTTDNQCAKIFGKGAQGAPFACFKEVNSLHERSENCGFKNSQPLPCERKDVLCGKLACVQPHKNANKSDAQSTVYSYIQDHVCVSIATGSSMRSDGTDNAYVADGTMCGPEMYCVNKTCRKVHLMGYNCNATTKCKGKGICNNFGNCQCFPGHRPPDCKFQFGSPGGSIDDGNFQKSGDFYTEKGYNTHWNNWFILSFCIFLPFFIVFTTVIFKRNEISKSCNRENAEYNRNSSVVSESDDVGH

SEQ ID NO: 8234 - protein, 715 aa, Artificial Sequence
  Description of Artificial Sequence: Synthetic coding sequence
MFLLLALLTELGRLQAHEGSEGIFLHVTVPRKIKSNDSEVSERKMIYIITIDGQPYTLHLGKQSFLPQNFLVYTYNETGSLHSVSPYFMMHCHYQGYAAEFPNSFVTLSICSGLRGFLQFENISYGIEPVESSARFEHIIYQMKNNDPNVSILAVNYSHIWQKDQPYKVPLNSQIKNLSKLLPQYLEIYIIVEKALMFTQFKLTVILSSLELWSNENQISTSGDADDILQRFLAWKRDYLILRPHDIAYLLVYRKHPKYVGATFPGTVCNKSYDAGIAMYPDAIGLEGFSVIIAQLLGLNVGLTYDDITQCFCLRATCIMNHEAVSASGRKIFSNCSMHDYRYFVSKFETKCLQKLSNLQPLHQNQPVCGNGILESNEECDCGNKNECQFKKCCDYNTCKLKGSVKCGSGPCCTSKCELSIAGTPCRKSIDPECDFTEYCNGTSSNCVPDTYALNGRLCKLGTAYCYNGQCQTTDNQCAKIFGKGAQGAPFACFKEVNSLHERSENCGFKNSQPLPCERKDVLCGKLACVQPHKNANKSDAQSTVYSYIQDHVCVSIATGSSMRSDGTDNAYVADGTMCGPEMYCVNKTCRKVHLMGYNCNATTKCKGKGICNNFGNCQCFPGHRPPDCKFQFGSPGGSIDDGNFQKSGDFYTEKGYNTHWNNWFILSFCIFLPFFIVFTTVIFKRNEISKSCNRENAEYNRNSSVVSESDDVGH

SEQ ID NO: 8235 - protein, 153 aa, Artificial Sequence
  Description of Artificial Sequence: Synthetic coding sequence
MRSDGTDNAYVADGTMCGPEMYCVNKTCRKVHLMGYNCNATTKCKGKGICNNFGNCQCFPGHRPPDCKFQFGSPGGSIDDGNFQKSGDFYTEKGYNTHWNNWFILSFCIFLPFFIVFTTVIFKRNEISKSCNRENAEYNRNSSVVSESDDVGH

SEQ ID NO: 8236 - protein, 182 aa, Artificial Sequence
  Description of Artificial Sequence: Synthetic coding sequence
MFLLLALLTELGRLQAHEGSEGIFLHVTVPRKIKSNDSEVSERKMIYIITIDGQPYTLHLGKQSFLPQNFLVYTYNETGSLHSVSPYFMMHCHYQGYAAEFPNSFVTLSICSGLRGFLQFENISYGIEPVESSARFEHIIYQMKNNDPNVSILAVNYSHIWQKDQPYKVPLNSQVTVIILML

SEQ ID NO: 8237 - protein, 787 aa, Artificial Sequence
  Description of Artificial Sequence: Synthetic coding sequence
MFRLWLLLAGLCGLLASRPGFQNSLLQIVIPEKIQTNTNDSSEIEYEQISYIIPIDEKLYTVHLKQRYFLADNFMIYLYNQGSMNTYSSDIQTQCYYQGNIEGYPDSMVTLSTCSGLRGILQFENVSYGIEPLESAVEFQHVLYKLKNEDNDIAIFIDRSLKEQPMDDNIFISEKSEPAVPDLFPLYLEMHIVVDKTLYDYWGSDSMIVTNKVIEIVGLANSMFTQFKVTIVLSSLELWSDENKISTVGEADELLQKFLEWKQSYLNLRPHDIAYLLIYMDYPRYLGAVFPGTMCITRYSAGVALYPKEITLEAFAVIVTQMLALSLGISYDDPKKCQCSESTCIMNPEVVQSNGVKTFSSCSLRSFQNFISNVGVKCLQNKPQMQKKSPKPVCGNGRLEGNEICDCGTEAQCGPASCCDFRTCVLKDGAKCYKGLCCKDCQILQSGVECRPKAHPECDIAENCNGTSPECGPDITLINGLSCKNNKFICYDGDCHDLDARCESVFGKGSRNAPFACYEEIQSQSDRFGNCGRDRNNKYVFCGWRNLICGRLVCTYPTRKPFHQENGDVIYAFVRDSVCITVDYKLPRTVPDPLAVKNGSQCDIGRVCVNRECVESRIIKASAHVCSQQCSGHGVCDSRNKCHCSPGYKPPNCQIRSKGFSIFPEEDMGSIMERASGKTENTWLLGFLIALPILIVTTAIVLARKQLKKWFAKEEEFPSSESKSEGSTQTYASQSSSEGSTQTYASQTRSESSSQADTSKSKSEDSAEAYTSRSKSQDSTQTQSSSN

SEQ ID NO: 8238 - protein, 278 aa, Artificial Sequence [sequence omitted]

SEQ ID NO: 8239 - protein, 785 aa, Artificial Sequence
  Description of Artificial Sequence: Synthetic coding sequence
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKNDLSQGIQPVQGLALCTLSTMGSAEMCRDLAPEVEKLLLQPSPYVRKKAILTAVHMIRKVPELSSVFLPPCAQLLHERHHGILLGTITLITELCERSPAALRHFRKVVPQLVHILRTLVTMGYSTEHSISGVSDPFLQVQILRLLRILGRNHEESSETMNDLLAQVATNTDTSRNAGNAVLFETVLTIMDIRSAAGLRVLAVNILGRFLLNSDRNIRYVALTSLLRLVQSDHSAVQRHRPTVVECLRETDASLSRRALELSLALVNSSNVRAMMQELQAFLESCPPDLRADCASGILLAAERFAPTKRWHIDTILHVLTTAGTHVRDDAVANLTQLIGGAQELHAYSVRRLYNALAEDISQQPLVQVAAWCIGEYGDLLLAGNCEEIEPLQVDEEEVLALLEKVLQSHMSLPATRGYALTALMKLSTRLCGDNNRIRQVVSIYGSCLDVELQQRAVEYDTLFRKYDHMRAAILEKMPLVERDGPQADEEAKESKEAAQLSEAAPVPTEPQASQLLDLLDLLDGASGDVQHPPHLDPSPGGALVHLLDLPCVPPPPAPIPDLKVFEREGVQLNLSFIRPPENPALLLITITATNFSEGDVTHFICQAAVPKSLQLQLQAPSGNTVPARGGLPITQLFRILNPNKAPLRLKLRLTYDHFHQSVQEIFEVNNLPVESWQ

SEQ ID NO: 8240 - protein, 785 aa, Artificial Sequence; identical to SEQ ID NO: 8239
  Description of Artificial Sequence: Synthetic coding sequence

SEQ ID NO: 8241 - protein, 640 aa, Artificial Sequence
  Description of Artificial Sequence: Synthetic coding sequence
MDRRIENRMGTPAHRRRVVHTHRHTRNRLSCPWPPPFTSPTLTPGILLGTITLITELCERSPAALRHFRKVVPQLVHILRTLVTMGYSTEHSISGVSDPFLQVQILRLLRILGRNHEESSETMNDLLAQVATNTDTSRNAGNAVLFETVLTIMDIRSAAGLRVLAVNILGRFLLNSDRNIRYVALTSLLRLVQSDHSAVQRHRPTVVECLRETDASLSRRALELSLALVNSSNVRAMMQELQAFLESCPPDLRADCASGILLAAERFAPTKRWHIDTILHVLTTAGTHVRDDAVANLTQLIGGAQELHAYSVRRLYNALAEDISQQPLVQVAAWCIGEYGDLLLAGNCEEIEPLQVDEEEVLALLEKVLQSHMSLPATRGYALTALMKLSTRLCGDNNRIRQVVSIYGSCLDVELQQRAVEYDTLFRKYDHMRAAILEKMPLVERDGPQADEEAKESKEAAQLSEAAPVPTEPQASQLLDLLDLLDGASGDVQHPPHLDPSPGGALVHLLDLPCVPPPPAPIPDLKVFEREGVQLNLSFIRPPENPALLLITITATNFSEGDVTHFICQAAVPKSLQLQLQAPSGNTVPARGGLPITQLFRILNPNKAPLRLKLRLTYDHFHQSVQEIFEVNNLPVESWQ

SEQ ID NO: 8242 - protein, 554 aa, Artificial Sequence
  Description of Artificial Sequence: Synthetic coding sequence
MSVTMVVPQLVHILRTLVTMGYSTEHSISGVSDPFLQVQILRLLRILGRNHEESSETMNDLTVLTIMDIRSAAGLRVLAVNILGRFLLNSDRNIRYVALTSLLRLVQSDHSAVQRHRPTVVECLRETDASLSRRALELSLALVNSSNVRAMMQELQAFLESCPPDLRADCASGILLAAERFAPTKRWHIDTILHVLTTAGTHVRDDAVANLTQLIGGAQELHAYSVRRLYNALAEDISQQPLVQVAAWCIGEYGDLLLAGNCEEIEPLQVDEEEVLALLEKVLQSHMSLPATRGYALTALMKLSTRLCGDNNRIRQVVSIYGSCLDVELQQRAVEYDTLFRKYDHMRAAILEKMPLVERDGPQADEEAKESKEAAQLSEAAPVPTEPQASQLLDLLDLLDGASGDVQHPPHLDPSPGGALVHLLDLPCVPPPPAPIPDLKVFEREGVQLNLSFIRPPENPALLLITITATNFSEGDVTHFICQAAVPKSLQLQLQAPSGNTVPARGGLPITQLFRILNPNKAPLRLKLRLTYDHFHQSVQEIFEVNNLPVESWQ

SEQ ID NO: 8243 - protein, 137 aa, Artificial Sequence
  Description of Artificial Sequence: Synthetic coding sequence
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKNDLSQGIQPVQGLALCTLSTMGSAEMCR

SEQ ID NO: 8244 - protein, 200 aa, Artificial Sequence
  Description of Artificial Sequence: Synthetic coding sequence
MVVPSLKLQDLIEEIRGAKTQAQEREVIQKECAHIRASFRDGDPVHRHRQLAKLLYVHMLGYPAHFGQMECLKLIASSRFTDKRVGYLGAMLLLDERHDAHLLITNSIKNDLSQGIQPVQGLALCTLSTMGSAEMCRDLAPEVEKLLLQPSPYVRKKAILTAVHMIRKVPELSSVFLPPCAQLLHERHHGILLGTITLIT

SEQ ID NO: 8245 - protein, 154 aa, Artificial Sequence
  Description of Artificial Sequence: Synthetic coding sequence
MIHFILLFSRQGKLRLQKWYITLPDKERKKITREIVQIILSRGHRTSSFVDWKELKLVYKRYASLYFCCAIENQDNELLTLEIVHRYVELLDKYFGNVCELDIIFNFEKAYFILDEFIIGGEIQETSKKIAVKAIEDSDMLQETMEEYMNKPTF

SEQ ID NO: 8246 - protein, 104 aa, Artificial Sequence
  Description of Artificial Sequence: Synthetic coding sequence
MIHFILLFSRQGKLRLQKWYITLPDKERKKITREIVQIILSRGHRTSSFVDWKELKLVYKRYASLYFCCAIENQDNELLTLEIVHRYVELLDKYFGNTWPFARA

SEQ ID NO: 8247 - protein, 164 aa, Artificial Sequence
  Description of Artificial Sequence: Synthetic coding sequence
MIHFILLFSRQGKLRLQKWYITLPDKERKKITREIVQIILSRGHRTSSFVDWKELKLVYKRYASLYFCCAIENQDNELLTLEIVHRYVELLDKYFGNVCELDIIFNFEKAYFILDEFIIGGEIQETSKKIAVKAIEDSDMLQENRLSPRGRDCSEPRSCHCTLA

SEQ ID NO: 8248 - protein, 154 aa, Artificial Sequence
  Description of Artificial Sequence: Synthetic coding sequence
MIHFILLFSRQGKLRLQKWYITLPDKERKKITREIVQIILSRGHRTSSFVDWKELKLVYKRYASLYFCCAIENQDNELLTLEIVHRYVELLDKYFGNVCELDIIFNFEKAYFILDEFIIGGEIQETSKKIAVKAIEDSDMLQEVSTVSQTMGER

SEQ ID NO: 8249 - protein, 1082 aa, Artificial Sequence
  Description of Artificial Sequence: Synthetic coding sequence
MSAAPAYSEDKGGSAGPGEPEYGHDPASGGIFSSDYKRHDDLKEMLDTNKDSLKLEAMKRIVAMIARGKNASDLFPAVVKNVACKNIEVKKLVYVYLVRYAEEQQDLALLSISTFQRGLKDPNQLIRASALRVLSSIRVPIIVPIMMLAIKEAASDMSPYVRKTAAHAIPKLYSLDSDQKDQLIEVIEKLLADKTTLVAGSVVMAFEEVCPERIDLIHKNYRKLCNLLIDVEEWGQVVIISMLTRYARTQFLSPTQNESLLEENAEKAFYGSEEDEAKGAGSEETAAAAAPSRKPYVMDPDHRLLLRNTKPLLQSRSAAVVMAVAQLYFHLAPKAEVGVIAKALVRLLRSHSEVQYVVLQNVATMSIKRRGMFEPYLKSFYIRSTDPTQIKILKLEVLTNLANETNIPTVLREFQTYIRSMDKDFVAATIQAIGRCATNIGRVRDTCLNGLVQLLSNRDELVVAESVVVIKKLLQMQPAQHGEIIKHLAKLTDNIQVPMARASILWLIGEYCEHVPRIAPDVLRKMAKSFTAEEDIVKLQVINLAAKLYLTNSKQTKLLTQYVLSLAKYDQNYDIRDRARFTRQLIVPSEQGGALSRHAKKLFLAPKPAPVLESSFKDRDHFQLGSLSHLLNAKATGYQELPDWPEEAPDPSVRNVEVPEWTKCSNREKRKEKEKPFYSDSEGESGPTESADSDPESESESDSKSSSESGSGESSSESDNEDQDEDEEKGRGSESEQSEEDGKRKTKKKVPERKGEASSSDEGSDSSSSSSESEMTSESEEEQLEPASWSRKTPPSSKSAPATKEISLLDLEDFTPPSVQPVSPPAIVSTSLAADLEGLTLTDSTLVPSLLSPVSGVGRQELLHRVAGEGLAVDYTFSRQPFSGDPHMVSVHIHFSNSSDTPIKGLHVGTPKLPAGISIQEFPEIESLAPGESATAVMGINFCDSTQAANFQLCTQTRQFYVSIQPPVGELMAPVFMSENEFKKEQGKLMGMNEITEKLMLPDTCRSDHIVVQKVTATANLGRVPCGTSDEYRFAGRTLTGGSLVLLTLDARPAGAAQLTVNSEKMVIGTMLVKDVIQALTQ

SEQ ID NO: 8250 - protein, 1050 aa, Artificial Sequence
  Description of Artificial Sequence: Synthetic coding sequence
MSAAPAYSEDKGGSAGPGEPEYGHDPASGGIFSSDYKRHDDLKEMLDTNKDSLKLEAMKRIVAMIARGKNASDLFPAVVKNVACKNIEDPNQLIRASALRVLSSIRVPIIVPIMMLAIKEAASDMSPYVRKTAAHAIPKLYSLDSDQKDQLIEVIEKLLADKTTLVAGSVVMAFEEVCPERIDLIHKNYRKLCNLLIDVEEWGQVVIISMLTRYARTQFLSPTQNESLLEENAEKAFYGSEEDEAKGAGSEETAAAAAPSRKPYVMDPDHRLLLRNTKPLLQSRSAAVVMAVAQLYFHLAPKAEVGVIAKALVRLLRSHSEVQYVVLQNVATMSIKRRGMFEPYLKSFYIRSTDPTQIKILKLEVLTNLANETNIPTVLREFQTYIRSMDKDFVAATIQAIGRCATNIGRVRDTCLNGLVQLLSNRDELVVAESVVVIKKLLQMQPAQHGEIIKHLAKLTDNIQVPMARASILWLIGEYCEHVPRIAPDVLRKMAKSFTAEEDIVKLQVINLAAKLYLTNSKQTKLLTQYVLSLAKYDQNYDIRDRARFTRQLIVPSEQGGALSRHAKKLFLAPKPAPVLESSFKDRDHFQLGSLSHLLNAKATGYQELPDWPEEAPDPSVRNVEVPEWTKCSNREKRKEKEKPFYSDSEGESGPTESADSDPESESESDSKSSSESGSGESSSESDNEDQDEDEEKGRGSESEQSEEDGKRKTKKKVPERKGEASSSDEGSDSSSSSSESEMTSESEEEQLEPASWSRKTPPSSKSAPATKEISLLDLEDFTPPSVQPVSPPAIVSTSLAADLEGLTLTDSTLVPSLLSPVSGVGRQELLHRVAGEGLAVDYTFSRQPFSGDPHMVSVHIHFSNSSDTPIKGLHVGTPKLPAGISIQEFPEIESLAPGESATAVMGINFCDSTQAANFQLCTQTRQFYVSIQPPVGELMAPVFMSENEFKKEQGKLMGMNEITEKLMLPDTCRSDHIVVQKVTATANLGRVPCGTSDEYRFAGRTLTGGSLVLLTLDARPAGAAQLTVNSEKMVIGTMLVKDVIQALTQ

SEQ ID NO: 8251 - protein, 1101 aa, Artificial Sequence
  Description of Artificial Sequence: Synthetic coding sequence
MSAAPAYSEDKGGSAGPGEPEYGHDPASGGIFSSDYKRHDDLKEMLDTNKDSLKLEAMKRIVAMIARGKNASDLFPAVVKNVACKNIEVKKLVYVYLVRYAEEQQDLALLSISTFQRGLKDPNQLIRASALRVLSSIRVPIIVPIMMLAIKEAASDMSPYVRKTAAHAIPKLYSLDSDQKDQLIEVIEKLLADKTTLVAGSVVMAFEEVCPERIDLIHKNYRKLCNLLIDVEEWGQVVIISMLTRYARTQFLSPTQNESLLEENAEKAFYGSEEDEAKGAGSEETAAAAAPSRKPYVMDPDHRLLLRNTKPLLQSRSAAVVMAVAQLYFHLAPKAEVGVIAKALVRLLRSHSEVQYVVLQNVATMSIKRRGMFEPYLKSFYIRSTDPTQIKILKLEVLTNLANETNIPTVLREFQTYIRSMDKDFVAATIQAIGRCATNIGRVRDTCLNGLVQLLSNRDELVVAESVVVIKKLLQMQPAQHGEIIKHLAKLTDNIQVPMARASILWLIGEYCEHVPRIAPDVLRKMAKSFTAEEDIVKLQVINLAAKLYLTNSKQTKLLTQYVLSLAKYDQNYDIRDRARFTRQLIVPSEQGGALSRHAKKLFLAPKPAPVLESSFKDRDHFQLGSLSHLLNAKATGYQELPDWPEEAPDPSVRNVEEEDLSLIETHVGLLGEYTEVPEWTKCSNREKRKEKEKPFYSDSEGESGPTESADSDPESESESDSKSSSESGSGESSSESDNEDQDEDEEKGRGSESEQSEEDGKRKTKKKVPERKGEASSSDEGSDSSSSSSESEMTSESEEEQLEPASWSRKTPPSSKSAPATKEISLLDLEDFTPPSVQPVSPPAIVSTSLAADLEGLTLTDSTLVPSLLSPVSGVGRQELLHRVAGEGLAVDYTFSRQPFSGDPHMVSVHIHFSNSSDTPIKGLHVGTPKLPAGISIQEFPEIESLAPGESATAVMGINFCDSTQAANFQLCTQTRQFYVSIQPPVGELMAPVFMSENEFKKEQGKLMGMNEITEKLMLPDTCRSDHIVVQKVTATANLGRVPCGTSDEYRFAGRTLTGGSLVLLTLDARPAGAAQLTVNSEKMVIGTMLVKDVIQALTQ

SEQ ID NO: 8252 - protein, 1021 aa, Artificial Sequence
  Description of Artificial Sequence: Synthetic coding sequence
MALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKRRKKRKEKEERTKGKKKSKKQPPGSEEAAGEPVQNGAPEEEQLPPESSYSLLAENSYVKMTCDIRGSLQEDSQVTVAIVLENRSSSILKGMELSVLDSLNARMARPQGSSVHDGVPVPFQLPPGVSNEAQYVFTIQSIVMAQKLKGTLSFIAKNDEGATHEKLDFRLHFSCSSYLITTPCYSDAFAKLLESGDLSMSSIKVDGIRMSFQNLLAKICFHHHFSVVERVDSCASMYSRSIQGHHVCLLVKKGENSVSVDGKCSDSTLLSNLLEEMKATLAKC

SEQ ID NO: 8253 - protein, 1153 aa, Artificial Sequence
  Description of Artificial Sequence: Synthetic coding sequence
MALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKRRKKRKEKEKKGKRRHSSLPTESDEDIAPAQQVDIVTEEMPENALPSDEDDKDPNDPYRALDIDLDKPLADSEKLPIQKHRNTETSKSPEKDVPMVEKKSKKPKKKEKKHKEKERDKEKKKEKEKKKSPKPKKKKHRKEKEERTKGKKKSKKQPPGSEEAAGEPVQNGAPEEEQLPPESSYSLLAENSYVKMTCDIRGSLQEDSQVTVAIVLENRSSSILKGMELSVLDSLNARMARPQGSSVHDGVPVPFQLPPGVSNEAQYVFTIQSIVMAQKLKGTLSFIAKNDEGATHEKLDFRLHFSCSSYLITTPCYSDAFAKLLESGDLSMSSIKVDGIRMSFQNLLAKICFHHHFSVVERVDSCASMYSRSIQGHHVCLLVKKGENSVSVDGKCSDSTLLSNLLEEMKATLAKC

SEQ ID NO: 8254 - protein, 984 aa, Artificial Sequence
  Description of Artificial Sequence: Synthetic coding sequence
MALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQILLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKRRKKRKEKEKKGKRRHSSLPTESDEDIAPAQQVDIVTEEMPENALPSDEDDKDPNDPYRALDIDLDKPLADSEKLPIQKHRNTETSKSPEKDVPMVEKKSKKPKKKEKKHKEKERDKEKKKEKEKKKSPKPKKKKHRKEKEERTKGKKKSKKQPPGSEEAAGEPVQNGAPEEEQLPPESSYSLLAENSYVKMTCDIRGSLQEDSQVTVAIVLENRSSSILKGMELSVLDSLNARMARPQGSSVHDGVPVPFQLPPGVSNEAQYVFTIQSIVMAQKLKGTLSFIAKNDEGATHEKLDFRLHFSCSSYLITTPCYSDAFAKLLESGDLSMSSIKVDGIRMSFQNLLAKICFHHHFSVVERVDSCASMYSRSIQGHHVCLLVKKGENSVSVDGKCSDSTLLSNLLEEMKATLAKC

SEQ ID NO: 8255 - protein, 1215 aa, Artificial Sequence
  Description of Artificial Sequence: Synthetic coding sequence
MALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAVLIMYKVFLKYPESLRPAFPRLKEKLEDPDPGVQSAAVNVICELARRNPKNYLSLAPLFFKLMTSSTNNWVLIKIIKLFGALTPLEPRLGKKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKRRKKRKEKEKKGKRRHSSLPTESDEDIAPAQQVDIVTEEMPENALPSDEDDKDPNDPYRALDIDLDKPLADSEKLPIQKHRNTETSKSPEKDVPMVEKKSKKPKKKEKKHKEKERDKEKKKEKEKKAEDLDFWLSTTPPPAPAPAPAPVPSTGELSVNTVTTPKDECEDAKTEAQGEEDDAEGQDQDKKSPKPKKKKHRKEKEERTKGKKKSKKQPPGSEEAAGEPVQNGAPEEEQLPPESSYSLLAENSYVKMTCDIRGSLQEDSQVTVAIVLENRSSSILKGMELSVLDSLNARMARPQGSSVHDGVPVPFQLPPGVSNEAQYVFTIQSIVMAQKLKGTLSFIAKNDEGATHEKLDFRLHFSCSSYLITTPCYSDAFAKLLESGDLSMSSIKVDGIRMSFQNLLAKICFHHHFSVVERVDSCASMYSRSIQGHHVCLLVKKGENSVSVDGKCSDSTLLSNLLEEMKATLAKC

SEQ ID NO: 8256 - protein, 1112 aa, Artificial Sequence
  Description of Artificial Sequence: Synthetic coding sequence
MALKMVKGSIDRMFDKNLQDLVRGIRNHKEDEAKYISQCIDEIKQELKQDNIAVKANAVCKLTYLQMLGYDISWAAFNIIEVMSASKFTFKRIGYLAASQSFHEGTDVIMLTTNQIRKDLSSPSQYDTGVALTGLSCFVTPDLARDLANDIMTLMSHTKPYIRKKAKLIEPLTNLIHSTSAMSLLYECVNTVIAVLISLSSGMPNHSASIQLCVQKLRILIEDSDQNLKYLGLLAMSKILKTHPKSVQSHKDLILQCLDDKDESIRLRALDLLYGMVSKKNLMEIVKKLMTHVDKAEGTTYRDELLTKIIDICSQSNYQYITNFEWYISILVELTRLEGTRHGHLIAAQMLDVAIRVKAIRKFAVSQMSALLDSAHLLASSTQRNGICEVLYAAAWICGEFSEHLQEPHHTLEAMLRPRVTTLPGHIQAVYVQNVVKLYASILQQKEQAGEAEGAQAVTQLMVDRLPQFVQSADLEVQERASCILQLVKHIQKLQAKDVPVAEEVSALFAGELNPVAPKAQKKVPVPEGLDLDAWINEPLSDSESEDERPRAVFHEEEQRRPKHRPSEADEEELARRREARKQEQANNPFYIKSSPSPQKRYQDTPGVEHIPVVQIDLSVPLKVPGLPMSDQYVKLEEERRHRQKLEKDKRRKKRKEKEKKGKRRHSSLPTESDEDIAPAQQVDIVTEEMPENALPSDEDDKDPNDPYRALDIDLDKPLADSEKLPIQKHRNTETSKSPEKDVPMVEKKSKKPKKKEKKHKEKERDKEKKKEKEKKAEDLDFWLSTTPPPAPAPAPAPVPSTDECEDAKTEAQGEEDDAEGQDQDKKSPKPKKKKHRKEKEERTKGKKKSKKQPPGSEEAAGEPVQNGAPEEEQLPPESSYSLLAENSYVKMTCDIRGSLQEDSQVTVAIVLENRSSSILKGMELSVLDSLNARMARPQGSSVHDGVPVPFQLPPGVSNEAQYVFTIQSIVMAQKLKGTLSFIAKNDEGATHEKLDFRLHFSCSSYLITTPCYSDAFAKLLESGDLSMSSIKVDGIRMSFQNLLAKICFHHHFSVVERVDSCASMYSRSIQGHHVCLLVKKGENSVSVDGKCSDSTLLSNLLEEMKATLAKC

SEQ ID NO: 8257 - protein, 418 aa, Artificial Sequence
  Description of Artificial Sequence: Synthetic coding sequence
MIHSLFLINCSGDIFLEKHWKSVVSQSVCDYFFEAQEKAADVENVPPVISTPHHYLISIYRDKLFFVSVIQTEVPPLFVIEFLHRVADTFQDYFGECSEAAIKDNVVIVYELLEEMLDNGFPLATESNILKELIKPPTILRSVVNSITGSSNVGDTLPTGQLSNIPWRRAGVKYTNNEAYFDVVEEIDAIIDKSGSTVFAEIQGVIDACIKLSGMPDLSLSFMNPRLLDDVSFHPCIRFKRWESERVLSFIPPDGNFRLISYRVSSQNLVAIPVYVKHSISFKENSSCGRFDITIGPKQNMGKTIEGITVTVHMPKVVLNMNLTPTQGSYTFDPVTKVLTWDVGKITPQKLPSLKGLVNLQSGAPKPEENPSLNIQFKIQQLAISGLKVNRLDMYGEKYKPFKGVKYVTKAGKFQVRT

SEQ ID NO: 8258 - protein, 418 aa, Artificial Sequence; identical to SEQ ID NO: 8257
  Description of Artificial Sequence: Synthetic coding sequence

SEQ ID NO: 8259 - protein, 418 aa, Artificial Sequence
  Description of Artificial Sequence: Synthetic coding sequence
MIHSLFLINSSGDIFLEKHWKSVVSRSVCDYFFEAQERATEAENVPPVIPTPHHYLLSVYRHKIFFVAVIQTEVPPLFVIEFLHRVVDTFQDYFGVCSEPVIKDNVVVVYEVLEEMLDNGFPLATESNILKELIKPPTILRTVVNTITGSTNVGDQLPTGQLSVVPWRRTGVKYTNNEAYFDVIEEIDAIIDKSGSTITAEIQGVIDACVKLTGMPDLTLSFMNPRLLDDVSFHPCVRFKRWESERILSFIPPDGNFRLLSYHVSAQNLVAIPVYVKHNISFRDSSSLGRFEITVGPKQTMGKTIEGVTVTSQMPKGVLNMSLTPSQGTHTFDPVTKMLSWDVGKINPQKLPSLKGTMSLQAGASKPDENPTINLQFKIQQLAISGLKVNRLDMYGEKYKPFKGIKYMTKAGKFQVRT

SEQ ID NO: 8260 - protein, 418 aa, Artificial Sequence; identical to SEQ ID NO: 8259
  Description of Artificial Sequence: Synthetic coding sequence

SEQ ID NO: 8261 - protein, 10 aa, Artificial Sequence
  Description of Artificial Sequence: Synthetic coding sequence
MIHSLFLINS

SEQ ID NO: 8262 - protein, 418 aa, Artificial Sequence; identical to SEQ ID NO: 8259
  Description of Artificial Sequence: Synthetic coding sequence

SEQ ID NO: 8263 - protein, 139 aa, Artificial Sequence
  Description of Artificial Sequence: Synthetic coding sequence
MIHSLFLINSSGDIFLEKHWKSVVSRSVCDYFFEAQERATEAENVPPVIPTPHHYLLSVYRHKIFFVAVIQTEVPPLFVIEFLHRVVDTFQDYFGVCSEPVIKDNVVVVYEVLEEMLDNGFPLATESNILKELIKPPTI

SEQ ID NO: 8264 - protein, 273 aa, Artificial Sequence
  Description of Artificial Sequence: Synthetic coding sequence
MIHSLFLINSSGDIFLEKHWKSVVSRSVCDYFFEAQERATEAENVPPVIPTPHHYLLSVYRHKIFFVAVIQTEVPPLFVIEFLHRVVDTFQDYFGVCSEPVIKDNVVVVYEVLEEMLDNGFPLATESNILKELIKPPTILRTVVNTITGSTNVGDQLPTGQLSVVPWRRTGVKYTNNEAYFDVIEEIDAIIDKSGSTITAEIQGVIDACVKLTGMPDLTLSFMNPRLLDDVSFHPCVRFKRWESERILSFIPPDGNFRLLSYHVSAQKCCLGM

SEQ ID NO: 8265 - protein, 193 aa, Artificial Sequence
  Description of Artificial Sequence: Synthetic coding sequence
MIQAILVFNNHGKPRLVRFYQRFPEEIQQQIVRETFHLVLKRDDNICNFLEGGSLIGGSDYKLIYRHYATLYFVFCVDSSESELGILDLIQVFVETLDKCFENVCELDLIFHMDKVHYILQEVVMGGMVLETNMNEIVAQIEAQNRLEKSEGGLSAAPARAVSAVKNINLPEIPRNINIGDLNIKVPNLSQFV

SEQ ID NO: 8266 - protein, 124 aa, Artificial Sequence
  Description of Artificial Sequence: Synthetic coding sequence
MIQAILVFNNHGKPRLVRFYQRFPEEIQQQIVRETFHLVLKRDDNICNFLEGGSLIGGSDYKLIYRHYATLYFVFCVDSSESELGILDLIQLKKRERKKSQCNTLQTGTLALWEQGPDIRTRRL

SEQ ID NO: 8267 - protein, 124 aa, Artificial Sequence; identical to SEQ ID NO: 8266
  Description of Artificial Sequence: Synthetic coding sequence

SEQ ID NO: 8268 - protein, 501 aa, Artificial Sequence
  Description of Artificial Sequence: Synthetic coding sequence
MPAAMLPYACVLVLLGAHTAPAAGEAGGSCLRWEPHCQQPLPDRVPSTAILPPRLNGPWISTGCEVRPGPEFLTRAYTFYPSRLFRAHQFYYEDPFCGEPAHSLLVKGKVRLRRASWVTRGATEADYHLHKVGIVFHSRRALVDVTGRLNQTRAGRDCARRLPPARAWLPGALYELRSARAQGDCLEALGLTMHELSLVRVQRRLQPQPRASPRLVEELYLGDIHTDPAERRHYRPTGYQRPLQSALHHVQPCPACGLIARSDVHHPPVLPPPLALPLHLGGWWVSSGCEVRPAVLFLTRLFTFHGHSRSWEGYYHHFSDPACRQPTFTVYAAGRYTRGTPSTRVRGGTELVFEVTRAHVTPMDQVTTAMLNFSEPSSCGGAGAWSMGTERDVTATNGCLPLGIRLPHVEYELFKMEQDPLGQSLLFIGQRPTDGSSPDTPEKRPTSYQAPLVLCHGEAPDFSRPPQHRPSLQKHPSTGGLHIAPFPLLPLVLGLAFLHWL

SEQ ID NO: 8269 - protein, 512 aa, Artificial Sequence
  Description of Artificial Sequence: Synthetic coding sequence
MAENSGPGVRPPGWEAQINIISTRLALAHTAPAAGEAGGSCLRWEPHCQQPLPDRVPSTAILPPRLNGPWISTGCEVRPGPEFLTRAYTFYPSRLFRAHQFYYEDPFCGEPAHSLLVKGKVRLRRASWVTRGATEADYHLHKVGIVFHSRRALVDVTGRLNQTRAGRDCARRLPPARAWLPGALYELRSARAQGDCLEALGLTMHELSLVRVQRRLQPQPRASPRLVEELYLGDIHTDPAERRHYRPTGYQRPLQSALHHVQPCPACGLIARSDVHHPPVLPPPLALPLHLGGWWVSSGCEVRPAVLFLTRLFTFHGHSRSWEGYYHHFSDPACRQPTFTVYAAGRYTRGTPSTRVRGGTELVFEVTRAHVTPMDQVTTAMLNFSEPSSCGGAGAWSMGTERDVTATNGCLPLGIRLPHVEYELFKMEQDPLGQSLLFIGQRPTDGSSPDTPEKRPTSYQAPLVLCHGEAPDFSRPPQHRPSLQKHPSTGGLHIAPFPLLPLVLGLAFLHWL

SEQ ID NO: 8270 - protein, 483 aa, Artificial Sequence
  Description of Artificial Sequence: Synthetic coding sequence
MQEFTKFPTKTGRRSLSRSISQSSTDSYSSAASYTDSSDDEVSPREKQQTNSKGSSNFCVKNIKQAEFGRREIEIAEQDMSALISLRKRAQGEKPLAGAKIVGCTHITAQTAVLIETLCALGAQCRWSACNIYSTQNEVAAALAEAGVAVFAWKGESEDDFWWCIDRCVNMDGWQANMILDDGGDLTHWVYKKYPNVFKKIRGIVEESVTGVHRLYQLSKAGKLCVPAMNVNDSVTKQKFDNLYCCRESILDGLKRTTDVMFGGKQVVVCGYGEVGKGCCAALKALGAIVYITEIDPICALQACMDGFRVVKLNEVIRQVDVVITCTGNKNVVTREHLDRMKNSCIVCNMGHSNTEIDVTSLRTPELTWERVRSQVDHVIWPDGKRVVLLAEGRLLNLSCSTVPTFVLSITATTQALALIELYNAPEGRYKQDVYLLPKKMDEYVASLHLPSFDAHLTELTDDQAKYLGLNKNGPFKPNYYRY

SEQ ID NO: 8271 - protein, 530 aa, Artificial Sequence
  Description of Artificial Sequence: Synthetic coding sequence
MSMPDAMPLPGVGEELKQAKEIEDAEKYSFMATVTKAPKKQIQFADDMQEFTKFPTKTGRRSLSRSISQSSTDSYSSAASYTDSSDDEVSPREKQQTNSKGSSNFCVKNIKQAEFGRREIEIAEQDMSALISLRKRAQGEKPLAGAKIVGCTHITAQTAVLIETLCALGAQCRWSACNIYSTQNEVAAALAEAGVAVFAWKGESEDDFWWCIDRCVNMDGWQANMILDDGGDLTHWVYKKYPNVFKKIRGIVEESVTGVHRLYQLSKAGKLCVPAMNVNDSVTKQKFDNLYCCRESILDGLKRTTDVMFGGKQVVVCGYGEVGKGCCAALKALGAIVYITEIDPICALQACMDGFRVVKLNEVIRQVDVVITCTGNKNVVTREHLDRMKNSCIVCNMGHSNTEIDVTSLRTPELTWERVRSQVDHVIWPDGKRVVLLAEGRLLNLSCSTVPTFVLSITATTQALALIELYNAPEGRYKQDVYLLPKKMDEYVASLHLPSFDAHLTELTDDQAKYLGLNKNGPFKPNYYRY

SEQ ID NO: 8272 - protein, 483 aa, Artificial Sequence; identical to SEQ ID NO: 8270
  Description of Artificial Sequence: Synthetic coding sequence

SEQ ID NO: 8273 - protein, 372 aa, Artificial Sequence
  Description of Artificial Sequence: Synthetic coding sequence
FVFKAYMYLNEGQKLLKTLKKDKSWSQTFESATFYSLKGEVCFNMGQIVLAKKMLRKALKLLNRIFPYNLISLFLHIHVEKNRHFHYVNRQAQESPPPGKKRLAQLYRQTVCLSLLWRIYSYSYLFHCKYYAHLAVMMQMNTALETQNCFQIIKAYLDYSLYHHLAGYKGVWFKYEVMAMEHIFNLPLKGEGIEIVAYVAETLVFNKLIMGHLDLAIELGSRALQMWALLQNPNRHYQSLCRLSRCLLLNSRYPQLIQVLGRLWELSVTQEHIFSKAFFYFVCLDILLYSGFVYRTFEECLEFIHQYENNRILKFHSGLLLGLYSSVAIWECEAGVGRRLHTSRDPGMPDFRNGTTFTNFPIELKIFCQEEP

SEQ ID NO: 8274 - protein, 1518 aa, Artificial Sequence
  Description of Artificial Sequence: Synthetic coding sequence
MSLSEGDALLALWRVERKQLKNIITVVIKCSLEIHGLFETQEWEEGLDIRVKIGLAAGHISMLVFGDETHSHFLVIGQAVDDVRLAQNMAQMNDVILSPNCWQLCDRSMIEIESVPDQRAVKVNFLKPPPNFNFDEFFTKCTTFMHYYPSGEHKNLLRLACTLKPDPELEMSLQKYVMESILKQIDNKQLQGYLSELRPVTIVFVNLMFEDQDKAEEIGPAIQDAYMHITSVLKIFQGQINKVFMFDKGCSFLCVFGFPGEKVPDELTHALECAMDIFDFCSQVHKIQTVSIGVASGIVFCGIVGHTVRHEYTVIGQKVNLAARMMMYYPGIVTCDSVTYNGSNLPAYFFKELPKKVMKGVADSGPLYQYWGRTEKVMFGMACLICNRKEDYPLLGRNKEINYFMYTMKKFLISNSSQVLMYEGLPGYGKSQILMKIEYLAQGKNHRIIAISLNKISFHQTFYTIQMFMANVLGLDTCKHYKERQTNLRNKVMTLLDEKFYCLLNDIFHVQFPISREISRMSTLKKQKQLEILFMKILKLIVKEERIIFIIDEAQFVDSTSWRFMEKLIRTLPIFIIMSLCPFVNIPCAAARAVIKNRNTTYIVIGAVQPNDISNKICLDLNVSCISKELDSYLGEGSCGIPFYCEELLKNLEHHEVLVFQQTESEEKTNRTWNNLFKYSIKLTEKLNMVTLHSDKESEEVCHLTSGVRLKNLSPPTSLKEISLIQLDSMRLSHQMLVRCAAIIGLTFTTELLFEILPCWNMKMMIKTLATLVESNIFYCFRNGKELQKALKQNDPSFEVHYRSLSLKPSEGMDHGEEEQLRELENEVIECHRIRFCNPMMQKTAYELWLKDQRKAMHLKCARFLEEDAHRCDHCRGRDFIPYHHFTVNIRLNALDMDAIKKMAMSHGFKTEEKLILSNSEIPETSAFFPENRSPEEIREKILNFFDHVLTKMKTSDEDIIPLESCQCEEILEIVILPLAHHFLALGENDKALYYFLEIASAYLIFCDNYMAYMYLNEGQKLLKTLKKDKSWSQTFESATFYSLKGEVCFNMGQIVLAKKMLRKALKLLNRIFPYNLISLFLHIHVEKNRHFHYVNRQAQESPPPGKKRLAQLYRQTVCLSLLWRIYSYSYLFHCKYYAHLAVMMQMNTALETQNCFQIIKAYLDYSLYHHLAGYKGVWFKYEVMAMEHIFNLPLKGEGIEIVAYVAETLVFNKLIMGHLDLAIELGSRALQMWALLQNPNRHYQSLCRLSRCLLLNSRYPQLIQVLGRLWELSVTQEHIFSKAFFYFVCLDILLYSGFVYRTFEECLEFIHQYENNRILKFHSGLLLGLYSSVAIWYARLQEWDNFYKFSNRAKNLLPRRTMTLTYYDGISRYMEGQVLHLQKQIKEQSENAQASGEELLKNLENLVAQNTTGPVFCPRLYHLMAYVCILMGDGQKCGLFLNTALRLSETQGNILEKCWLNMNKESWYSTSELKEDQWLQTILSLPSWEKIVAGRVNIQDLQKNKFLMRANTVDNHF

SEQ ID NO: 8275 - protein, 1610 aa, Artificial Sequence
  Description of Artificial Sequence: Synthetic coding sequence
MNTPKEEFQDWPIVRIAAHLPDLIVYGHFSPERPFMDYFDGVLMFVDISGFTAMTEKFSSAMYMDRGAEQLVEILNYHISAIVEKVLIFGGDILKFAGDALLALWRVERKQLKNIITVVIKCSLEIHGLFETQEWEEGLDIRVKIGLAAGHISMLVFGDETHSHFLVIGQAVDDVRLAQNMAQMNDVILSPNCWQLCDRSMIEIESVPDQRAVKVNFLKPPPNFNFDEFFTKCTTFMHYYPSGEHKNLLRLACTLKPDPELEMSLQKYVMESILKQIDNKQLQGYLSELRPVTIVFVNLMFEDQDKAEEIGPAIQDAYMHITSVLKIFQGQINKVFMFDKGCSFLCVFGFPGEKVPDELTHALECAMDIFDFCSQVHKIQTVSIGVASGIVFCGIVGHTVRHEYTVIGQKVNLAARMMMYYPGIVTCDSVTYNGSNLPAYFFKELPKKVMKGVADSGPLYQYWGRTEKVMFGMACLICNRKEDYPLLGRNKEINYFMYTMKKFLISNSSQVLMYEGLPGYGKSQILMKIEYLAQGKNHRIIAISLNKISFHQTFYTIQMFMANVLGLDTCKHYKERQTNLRNKVMTLLDEKFYCLLNDIFHVQFPISREISRMSTLKKQKQLEILFMKILKLIVKEERIIFIIDEAQFVDSTSWRFMEKLIRTLPIFIIMSLCPFVNIPCAAARAVIKNRNTTYIVIGAVQPNDISNKICLDLNVSCISKELDSYLGEGSCGIPFYCEELLKNLEHHEVLVFQQTESEEKTNRTWNNLFKYSIKLTEKLNMVTLHSDKESEEVCHLTSGVRLKNLSPPTSLKEISLIQLDSMRLSHQMLVRCAAIIGLTFTTELLFEILPCWNMKMMIKTLATLVESNIFYCFRNGKELQKALKQNDPSFEVHYRSLSLKPSEGMDHGEEEQLRELENEVIECHRIRFCNPMMQKTAYELWLKDQRKAMHLKCARFLEEDAHRCDHCRGRDFIPYHHFTVNIRLNALDMDAIKKMAMSHGFKTEEKLILSNSEIPETSAFFPENRSPEEIREKILNFFDHVLTKMKTSDEDIIPLESCQCEEILEIVILPLAHHFLALGENDKALYYFLEIASAYLIFCDNYMAYMYLNEGQKLLKTLKKDKSWSQTFESATFYSLKGEVCFNMGQIVLAKKMLRKALKLLNRIFPYNLISLFLHIHVEKNRHFHYVNRQAQESPPPGKKRLAQLYRQTVCLSLLWRIYSYSYLFHCKYYAHLAVMMQMNTALETQNCFQIIKAYLDYSLYHHLAGYKGVWFKYEVMAMEHIFNLPLKGEGIEIVAYVAETLVFNKLIMGHLDLAIELGSRALQMWALLQNPNRHYQSLCRLSRCLLLNSRYPQLIQVLGRLWELSVTQEHIFSKAFFYFVCLDILLYSGFVYRTFEECLEFIHQYENNRILKFHSGLLLGLYSSVAIWYARLQEWDNFYKFSNRAKNLLPRRTMTLTYYDGISRYMEGQVLHLQKQIKEQSENAQASGEELLKNLENLVAQNTTGPVFCPRLYHLMAYVCILMGDGQKCGLFLNTALRLSETQGNILEKCWLNMNKESWYSTSELKEDQWLQTILSLPSWEKIVAGRVNIQDLQKNKFLMRANTVDNHF

SEQ ID NO: 8276 - protein, 1457 aa, Artificial Sequence
  Description of Artificial Sequence: Synthetic coding sequence
MLVFGDETHSHFLVIGQAVDDVRLAQNMAQMNDVILSPNCWQLCDRSMIEIESVPDQRAVKVNFLKPPPNFNFDEFFTKCTTFMHYYPSGEHKNLLRLACTLKPDPELEMSLQKYVMESILKQIDNKQLQGYLSELRPVTIVFVNLMFEDQDKAEEIGPAIQDAYMHITSVLKIFQGQINKVFMFDKGCSFLCVFGFPGEKVPDELTHALECAMDIFDFCSQVHKIQTVSIGVASGIVFCGIVGHTVRHEYTVIGQKVNLAARMMMYYPGIVTCDSVTYNGSNLPAYFFKELPKKVMKGVADSGPLYQYWGRTEKVMFGMACLICNRKEDYPLLGRNKEINYFMYTMKKFLISNSSQVLMYEGLPGYGKSQILMKIEYLAQGKNHRIIAISLNKISFHQTFYTIQMFMANVLGLDTCKHYKERQTNLRNKVMTLLDEKFYCLLNDIFHVQFPISREISRMSTLKKQKQLEILFMKILKLIVKEERIIFIIDEAQFVDSTSWRFMEKLIRTLPIFIIMSLCPFVNIPCAAARAVIKNRNTTYIVIGAVQPNDISNKICLDLNVSCISKELDSYLGEGSCGIPFYCEELLKNLEHHEVLVFQQTESEEKTNRTWNNLFKYSIKLTEKLNMVTLHSDKESEEVCHLTSGVRLKNLSPPTSLKEISLIQLDSMRLSHQMLVRCAAIIGLTFTTELLFEILPCWNMKMMIKTLATLVESNIFYCFRNGKELQKALKQNDPSFEVHYRSLSLKPSEGMDHGEEEQLRELENEVIECHRIRFCNPMMQKTAYELWLKDQRKAMHLKCARFLEEDAHRCDHCRGRDFIPYHHFTVNIRLNALDMDAIKKMAMSHGFKTEEKLILSNSEIPETSAFFPENRSPEEIREKILNFFDHVLTKMKTSDEDIIPLESCQCEEILEIVILPLAHHFLALGENDKALYYFLEIASAYLIFCDNYMAYMYLNEGQKLLKTLKKDKSWSQTFESATFYSLKGEVCFNMGQIVLAKKMLRKALKLLNRIFPYNLISLFLHIHVEKNRHFHYVNRQAQESPPPGKKRLAQLYRQTVCLSLLWRIYSYSYLFHCKYYAHLAVMMQMNTALETQNCFQIIKAYLDYSLYHHLAGYKGVWFKYEVMAMEHIFNLPLKGEGIEIVAYVAETLVFNKLIMGHLDLAIELGSRALQMWALLQNPNRHYQSLCRLSRCLLLNSRYPQLIQVLGRLWELSVTQEHIFSKAFFYFVCLDILLYSGFVYRTFEECLEFIHQYENNRILKFHSGLLLGLYSSVAIWYARLQEWDNFYKFSNRAKNLLPRRTMTLTYYDGISRYMEGQVLHLQKQIKEQSENAQASGEELLKNLENLVAQNTTGPVFCPRLYHLMAYVCILMGDGQKCGLFLNTALRLSETQGNILEKCWLNMNKESWYSTSELKEDQWLQTILSLPSWEKIVAGRVNIQDLQKNKFLMRANTVDNHF

SEQ ID NO: 8277 - protein, 223 aa, Artificial Sequence
  Description of Artificial Sequence: Synthetic coding sequence
MASKLLRAVILGPPGSGKGTVCQRIAQNFGLQHLSSGHFLRENIKASTEVGEMAKQYIEKSLLVPDHVITRLMMSELENRRGQHWLLDGFPRTLGQAEALDKICEVDLVISLNIPFETLKDRLSRRWIHPPSGRVYNLDFNPPHVHGIDDVTGEPLVQQEDDKPEAVAARLRQYKDVAKPVIELYKSRGVLHQFSGTETNKIWPYVYTLFSNKITPIQSKEAY

SEQ ID NO: 8278 - protein, 223 aa, Artificial Sequence; identical to SEQ ID NO: 8277
  Description of Artificial Sequence: Synthetic coding sequence

SEQ ID NO: 8279 - protein, 223 aa, Artificial Sequence; identical to SEQ ID NO: 8277
  Description of Artificial Sequence: Synthetic coding sequence

SEQ ID NO: 8280 - protein, 493 aa, Artificial Sequence
  Description of Artificial Sequence: Synthetic coding sequence
MHPHRDPRGLWLLLPSLSLLLFEVARAGRAVVSCPAACLCASNILSCSKQQLPNVPHSLPSYTALLDLSHNNLSRLRAEWTPTRLTQLHSLLLSHNHLNFISSEAFSPVPNLRYLDLSSNQLRTLDEFLFSDLQVLEVLLLYNNHIMAVDRCAFDDMAQLQKLYLSQNQISRFPLELVKEGAKLPKLTLLDLSSNKLKNLPLPDLQKLPAWIKNGLYLHNNPLNCDCELYQLFSHWQYRQLSSVMDFQEDLYCMNSKKLHNVFNLSFLNCGEYKERAWEAHLGDTLIIKCDTKQQGMTKVWVTPSNERVLDEVTNGTVSVSKDGSLLFQQVQVEDGGVYTCYAMGETFNETLSVELKVHNFTLHGHHDTLNTAYTTLVGCILSVVLVLIYLYLTPCRCWCRGVEKPSSHQGDSLSSSMLSTTPNHDPMAGGDKDDGFDRRVAFLEPAGPGQGQNGKLKPGNTLPVPEATGKGQRRMSDPESVSSVFSDTPIVV

SEQ ID NO: 8281 - protein, 493 aa, Artificial Sequence; identical to SEQ ID NO: 8280
  Description of Artificial Sequence: Synthetic coding sequence

SEQ ID NO: 8282 - protein, 522 aa, Artificial Sequence
  Description of Artificial Sequence: Synthetic coding sequence
MSLRVHTLPTLLGAVVRPGCRELLCLLMITVTVGPGASGVCPTACICATDIVSCTNKNLSKVPGNLFRLIKRLDLSYNRIGLLDSEWIPVSFAKLNTLILRHNNITSISTGSFSTTPNLKCLDLSSNKLKTVKNAVFQELKVLEVLLLYNNHISYLDPSAFGGLSQLQKLYLSGNFLTQFPMDLYVGRFKLAELMFLDVSYNRIPSMPMHHINLVPGKQLRGIYLHGNPFVCDCSLYSLLVFWYRRHFSSVMDFKNDYTCRLWSDSRHSRQVLLLQDSFMNCSDSIINGSFRALGFIHEAQVGERLMVHCDSKTGNANTDFIWVGPDNRLLEPDKEMENFYVFHNGSLVIESPRFEDAGVYSCIAMNKQRLLNETVDVTINVSNFTVSRSHAHEAFNTAFTTLAACVASIVLVLLYLYLTPCPCKCKTKRQKNMLHQSNAHSSILSPGPASDASADERKAGAGKRVVFLEPLKDTAAGQNGKVRLFPSEAVIAEGILKSTRGKSDSDSVNSVFSDTPFVAST

SEQ ID NO: 8283 - protein, 522 aa, Artificial Sequence; identical to SEQ ID NO: 8282
  Description of Artificial Sequence: Synthetic coding sequence

SEQ ID NO: 8284 - protein, 522 aa, Artificial Sequence; identical to SEQ ID NO: 8282
  Description of Artificial Sequence: Synthetic coding sequence

SEQ ID NO: 8285 - protein, 522 aa, Artificial Sequence; identical to SEQ ID NO: 8282
  Description of Artificial Sequence: Synthetic coding sequence

SEQ ID NO: 8286 - protein, 504 aa, Artificial Sequence
  Description of Artificial Sequence: Synthetic coding sequence
MTWLVLLGTLLCMLRVGLGTPDSEGFPPRALHNCPYKCICAADLLSCTGLGLQDVPAELPAATADLDLSHNALQRLRPGWLAPLFQLRALHLDHNELDALGRGVFVNASGLRLLDLSSNTLRALGRHDLDGLGALEKLLLFNNRLVHLDEHAFHGLRALSHLYLGCNELASFSFDHLHGLSATHLLTLDLSSNRLGHISVPELAALPAFLKNGLYLHNNPLPCDCRLYHLLQRWHQRGLSAVRDFAREYVCLAFKVPASRVRFFQHSRVFENCSSAPALGLERPEEHLYALVGRSLRLYCNTSVPAMRIAWVSPQQELLRAPGSRDGSIAVLADGSLAIGNVQEQHAGLFVCLATGPRLHHNQTHEYNVSVHFPRPEPEAFNTGFTTLLGCAVGLVLVLLYLFAPPCRCCRRACRCRRWPQTPSPLQELSAQSSVLSTTPPDAPSRKASVHKHVVFLEPGRRGLNGRVQLAVAEEFDLYNPGGLQLKAGSESASSIGSEGPMTT

SEQ ID NO: 8287 - protein, 504 aa, Artificial Sequence; identical to SEQ ID NO: 8286
  Description of Artificial Sequence: Synthetic coding sequence

SEQ ID NO: 8288 - protein, 407 aa, Artificial Sequence
  Description of Artificial Sequence: Synthetic coding sequence
MTTSGALFPSLVPGSRGASNKYLVEFRAGKMSLKGTTVTPDKRKGLVYIQQTDDSLIHFCWKDRTSGNVEDDLIIFPDDCEFKRVPQCPSGRVYVLKFKAGSKRLFFWMQEPKTDQDEEHCRKVNEYLNNPPMPGALGASGSSGHELSALGGEGGLQSLLGNMSHSQLMQLIGPAGLGGLGGLGALTGPGLASLLGSSGPPGSSSSSSSRSQSAAVTPSSTTSSTRATPAPSAPAAASATSPSPAPSSGNGASTAASPTQPIQLSDLQSILATMNVPAGPAGGQQVDLASVLTPEIMAPILANADVQERLLPYLPSGESLPQTADEIQNTLTSPQFQQALGMFSAALASGQLGPLMCQFGLPAEAVEAANKGDVEAFAKAMQNNAKPEQKEGDTKDKKDEEEDMSLD

SEQ ID NO: 8289 - protein, 317 aa, Artificial Sequence
  Description of Artificial Sequence: Synthetic coding sequence
MTTSGALFPSLVPGSRGASNKYLVEFRAGKMSLKGTTVTPDKRKGLVYIQQTDDSLIHFCWKDRTSGNVEDDLIIFPDDCEFKRVPQCPSGRVYVLKFKAGSKRLFFWMQEPKTDQDEEHCRKVNEYLNNPPMPGALGASGSSGHELSALGAGGLGALTGPGLASLLGSSGPPGSSSSSSGALSLRSSRSQSAAVTPSSTTSSTRATPAPSAPAAASATSPSPAPSSGNGASTAASPTQPIQLSDLQSILATMNVPAGPAGGQQVDLASVLTPEIMAPILANADVQERLLPYLPSGESLPQTADEIQNTLTSPQFQQ

SEQ ID NO: 8290 - protein, 80 aa, Artificial Sequence
  Description of Artificial Sequence: Synthetic coding sequence
MKYPLMPLVNDLTFSFLVFWFCLPVGLLLLLIIWLRFLLSQDSEENDSSVCLDWEPWSKGPAEFCWKGTLHGQEKERPCW

SEQ ID NO: 8291 - protein, 192 aa, Artificial Sequence
  Description of Artificial Sequence: Synthetic coding sequence
MPLVNDLTFSFLVFWFCLPVGLLLLLIIWLRFLLSQDSEENDSSVCLDWEPWSKGPAEFCWKGTLHGQEKERPCCLVFLESAGQWQWQKWMGETCQGGKRTLATVVPPWNPQLISSSDRHVKASRGPSPSPASQMTSSPAGSRSSLGGHGSSEQAHGEKLANLIQRGLKAGLGRRVWVHIKEARVFPYPGDP

SEQ ID NO: 8292 - protein, 341 aa, Artificial Sequence
  Description of Artificial Sequence: Synthetic coding sequence
MTDGILGKAATMEIPIHGNGEARQLPEDDGLEQDLQQVMVSGPNLNETSIVSGGYGGSGDGLIPTGSGRHPSHSTTPSGPGDEVARGIAGEKFDIVKKWGINTYKCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 8293 - protein, 341 aa, Artificial Sequence; identical to SEQ ID NO: 8292
  Description of Artificial Sequence: Synthetic coding sequence

SEQ ID NO: 8294 - protein, 303 aa, Artificial Sequence
  Description of Artificial Sequence: Synthetic coding sequence
MVSGPNLNETSIVSGGYGGSGDGLIPTGSGRHPSHSTTPSGPGDEVARGIAGEKFDIVKKWGINTYKCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 8295 - protein, 256 aa, Artificial Sequence
  Description of Artificial Sequence: Synthetic coding sequence
MKPALCLVAMGALVMDSSPQCTKQLLSERFGRGSRTVDLELELQIELLRETKRKYESVLQLGRALTAHLYSLLQTQHALGDAFADLSQKSPELQEEFGYNAETQKLLCKNGETLLGAVNFFVSSINTLVTKTMEDTLMTVKQYEAARLEYDAYRTDLEELSLGPRDAGTRGRLESAQATFQAHRDKYEKLRGDVAIKLKFLEENKIKVMHKQLLLFHNAVSAYFAGNQKQLEQTLQQFNIKLRPPGAEKPSWLEEQ

SEQ ID NO: 8296 - protein, 125 aa, Artificial Sequence
  Description of Artificial Sequence: Synthetic coding sequence
MGNIFEKLFKSLLGKKKMRILILSLDTAGKTTILYKLKLGETVPAVPTVGFCVETVEYKNNTFAVWDVGSHFKIRPLWQHFFQNTKELSASQFAQFIKKLCGVTGTNDEASPGSLTSYPSHLLDR

SEQ ID NO: 8297 - protein, 177 aa, Artificial Sequence
  Description of Artificial Sequence: Synthetic coding sequence
MGNIFEKLFKSLLGKKKMRILILSLDTAGKTTILYKLKLGETVPAVPTVGFCVETVEYKNNTFAVWDVGSHFKIRPLWQHFFQNTKGARSPGSTHQGSLASGVLPIKCSHVEFGMWKGGRSHPFLPHSSRCAGSGGQLDSILPHQSPAWGPWGCKDLSSGFPSFLTSSILWKSAVVK

SEQ ID NO: 8298 - protein, 203 aa, Artificial Sequence
  Description of Artificial Sequence: Synthetic coding sequence
MGNIFEKLFKSLLGKKKMRILILSLDTAGKTTILYKLKLGETVPAVPTVGFCVETVEYKNNTFAVWDVGSHFKIRPLWQHFFQNTKGARSPGSTHQGSLASGVLPIKCSHVEFGMWKGGRSHPFLPHSSRCAGSGGQLDSILPHQSPAWGPWGCKDLSSGFPSFLTSSILWKSAVSYQLPSLHNSSRNYAGSPAQMMRHLLEA

SEQ ID NO: 8299 - protein, 130 aa, Artificial Sequence
  Description of Artificial Sequence: Synthetic coding sequence
GARSPGSTHQGSLASGVLPIKCSHVEFGMWKGGRSHPFLPHSSRCAGSGGQLDSILPHQSPAWGPWGCKDLSSGFPSFLTSSILWKSAVVREPHISPHQAPPYKTSDCITAISFPVCTIHQEIMRGHRHK

SEQ ID NO: 8300 - protein, 125 aa, Artificial Sequence; identical to SEQ ID NO: 8296
  Description of Artificial Sequence: Synthetic coding sequence

SEQ ID NO: 8301 - protein, 125 aa, Artificial Sequence; identical to SEQ ID NO: 8296
  Description of Artificial Sequence: Synthetic coding sequence

SEQ ID NO: 8302 - protein, 130 aa, Artificial Sequence
  Description of Artificial Sequence: Synthetic coding sequence
GARSPGSTHQGSLASGVLPIKCSHVEFGMWKGGRSHPFLPHSSRCAGSGGQLDSILPHQSPAWGPWGCKDLSSGFPSFLTSSILWKSAVVREPHISPHQAPPYKTSDCITAISFPVCTIHQEIMRGHWHK

SEQ ID NO: 8303 - protein, 177 aa, Artificial Sequence; identical to SEQ ID NO: 8297
  Description of Artificial Sequence: Synthetic coding sequence

SEQ ID NO: 8304 - protein, 203 aa, Artificial Sequence
  Description of Artificial Sequence: Synthetic coding sequence
MGNIFEKLFKSLLGKKKMRILILSLDTAGKTTILYKLKLGETVPAVPTVGFCVETVEYKNNTFAVWDVGSHFKIRPLWQHFFQNTKGARSPGSTHQGSLASGVLPIKCSHVEFGMWKGGRSHPFLPHSSRCAGSGGQLDSILPHQSPAWGPWGCKDLSSGFPSFLTSSILWKSAVSYQLPSLHNSSRNYAGSLAQMMRHLLEA

SEQ ID NO: 8305 - protein, 125 aa, Artificial Sequence; identical to SEQ ID NO: 8296
  Description of Artificial Sequence: Synthetic coding sequence

SEQ ID NO: 8306 - protein, 177 aa, Artificial Sequence; identical to SEQ ID NO: 8297
  Description of Artificial Sequence: Synthetic coding sequence

SEQ ID NO: 8307 - protein, 109 aa, Artificial Sequence
  Description of Artificial Sequence: Synthetic coding sequence
ARSPGSTHQGSLASGVLPIKCSHVEFGMWKGGRSHPFLPHSSRCAGSGGQLDSILPHQSPAWGPWGCKDLSSGFPSFLTSSILWKSAVVREPHISPHQAPPYKTSDCIT

SEQ ID NO: 8308 - protein, 200 aa, Artificial Sequence
  Description of Artificial Sequence: Synthetic coding sequence
MGNGLSDQTSILSNLPSFQSFHIVILGLDCAGKTTVLYRLQFNEFVNTVPTKGFNTEKIKVTLGNSKTVTFHFWDVGGQEKLRPLWKSYTRCTDGIVFVVDSVDVERMEEAKTELHKITRISENQGVPVLIVANKQDLRNSLSLSEIEKLLAMGELSSSTPWHLQPTCAIIGDGLKEGLEKLHDMIIKRRKMLRQQKKKR

SEQ ID NO: 8309 - protein, 200 aa, Artificial Sequence; identical to SEQ ID NO: 8308
  Description of Artificial Sequence: Synthetic coding sequence

SEQ ID NO: 8310 - protein, 200 aa, Artificial Sequence; identical to SEQ ID NO: 8308
  Description of Artificial Sequence: Synthetic coding sequence

SEQ ID NO: 8311 - protein, 200 aa, Artificial Sequence; identical to SEQ ID NO: 8308
  Description of Artificial Sequence: Synthetic coding sequence

SEQ ID NO: 8312 - protein, 200 aa, Artificial Sequence; identical to SEQ ID NO: 8308
  Description of Artificial Sequence: Synthetic coding sequence

SEQ ID NO: 8313 - protein, 51 aa, Artificial Sequence
  Description of Artificial Sequence: Synthetic coding sequence
MGNGLSDQTSILSNLPSFQSFHIVILGLDCAGKTTVLYRLQFNEFVNTVPT

SEQ ID NO: 8314 - protein, 201 aa, Artificial Sequence
  Description of Artificial Sequence: Synthetic coding sequence
MGNISSNISAFQSLHIVMLGLDSAGKTTVLYRLKFNEFVNTVPTIGFNTEKIKLSNGTAKGISCHFWDVGGQEKLRPLWKSYSRCTDGIIYVVDSVDVDRLEEAKTELHKVTKFAENQGTPLLVIANKQDLPKSLPVAEIEKQLALHELIPATTYHVQPACAIIGEGLTEGMDKLYEMILKRRKSLKQKKKRTGDLRSCEV

SEQ ID NO: 8315 - protein, 192 aa, Artificial Sequence
  Description of Artificial Sequence: Synthetic coding sequence
MGNISSNISAFQSLHIVMLGLDSAGKTTVLYRLKFNEFVNTVPTIGFNTEKIKLSNGTAKGISCHFWDVGGQEKLRPLWKSYSRCTDGIIYVVDSVDVDRLEEAKTELHKVTKFAENQGTPLLVIANKQDLPKSLPVAEIEKQLALHELIPATTYHVQPACAIIGEGLTEGMDKLYEMILKRRKSLKQKKKR

SEQ ID NO: 8316 - protein, 203 aa, Artificial Sequence
  Description of Artificial Sequence: Synthetic coding sequence
MAEGDNRSTNLLAAETASLEEQLQGWGEVMLMADKVLRWERAWFPPAIMGVVSLVFLIIYYLDPSVLSGVSCFVMFLCLADYLVPILAPRIFGSNKWTTEQQQRFHEICSNLVKTRRRAVGWWKRLFTLKEEKPKMYFMTMIVSLAAVAWVGQQVHNLLLTYLIVTSLLLLPGLNQHGIILKYIGMAKREINKLLKQKEKKNE

SEQ ID NO: 8317 - protein, 155 aa, Artificial Sequence [sequence omitted]

SEQ ID NO: 8318 - protein, 174 aa, Artificial Sequence
  Description of Artificial Sequence: Synthetic coding sequence
MLMADKVLRWERAWFPPAIMGVVSLVFLIIYYLDPSVLSGVSCFVMFLCLADYLVPILAPRIFGSNKWTTEQQQRFHEICSNLVKTRRRAVGWWKRLFTLKEEKPKMYFMTMIVSLAAVAWVGQQVHNLLLTYLIVTSLLLLPGLNQHGIILKYIGMAKREINKLLKQKEKKNE

SEQ ID NO: 8319 - protein, 186 aa, Artificial Sequence
  Description of Artificial Sequence: Synthetic coding sequence
MIALFNKLLDWFKALFWKEEMELTLVGLQYSGKTTFVNVIASGQFNEDMIPTVGFNMRKITKGNVTIKLWDIGGQPRFRSMWERYCRGVSAIVYMVDAADQEKIEASKNELHNLLDKPQLQGIPVLVLGNKRDLPGALDEKELIEKMNLSAIQDREICCYSISCKEKDNIDITLQWLIQHSKSRRS

SEQ ID NO: 8320 - protein, 186 aa, Artificial Sequence
  Description of Artificial Sequence: Synthetic coding sequence
MLALISRLLDWFRSLFWKEEMELTLVGLQYSGKTTFVNVIASGQFSEDMIPTVGFNMRKVTKGNVTIKIWDIGGQPRFRSMWERYCRGVNAIVYMIDAADREKIEASRNELHNLLDKPQLQGIPVLVLGNKRDLPNALDEKQLIEKMNLSAIQDREICCYSISCKEKDNIDITLQWLIQHSKSRRS

SEQ ID NO: 8321 - protein, 163 aa, Artificial Sequence
  Description of Artificial Sequence: Synthetic coding sequence
MLALISRLLDWFRSLFWKEEMELTLVGLQYSGKTTFVNVIASGQFSEDMIPTVGFNMRKVTKGNVTIKIWDIGGQPRFRSMWERYCRGVNAIVYMIDAADREKIEASRNELHNLLDKPQLQGIPISHFSGLFSIQNLEEAEASPEVFQSFLAIILELLSVPLK

SEQ ID NO: 8322 - protein, 238 aa, Artificial Sequence
  Description of Artificial Sequence: Synthetic coding sequence
MIRSASWVWLLPPAGVRPCRAGAPRSRWRVRAEARSCGSRPSSRPFSLPAAIMLALISRLLDWFRSLFWKEEMELTLVGLQYSGKTTFVNVIASGQFSEDMIPTVGFNMRKVTKGNVTIKIWDIGGQPRFRSMWERYCRGVNAIVYMIDAADREKIEASRNELHNLLDKPQLQGIPVLVLGNKRDLPNALDEKQLIEKMNLSAIQDREICCYSISCKEKDNIDITLQWLIQHSKSRRS

SEQ ID NO: 8323 - protein, 226 aa, Artificial Sequence
  Description of Artificial Sequence: Synthetic coding sequence
MSFAESGWRSALRRRGPGTPGPVARPSYSSFTQGDSWGEGEVDEEEGCDQVARDLRAEFSAGAWSEPRKRSVLPPDGNGSPVLPDKRNGIFPAAAGSRAQPRRWPVQVLSILCSLLFAILLAFLLAIAYLIVKELHAENLKNEDDVDTGLLGFWTLLIISLTAGFSCCSFSWTVTYFDSFEPGMFPPTPLSPARFKKLTGHSFHMGYSMAILNGIVAALTVAWCLM

SEQ ID NO: 8324 - protein, 1163 aa, Artificial Sequence
  Description of Artificial Sequence: Synthetic coding sequence
MNREDRNVLRMKERERRNQEIQQGEDAFPPSSPLFAEPYKVTSKEDKLSSRIQSMLGNYDEMKDFIGDRSIPKLVAIPKPTVPPSADEKSNPNFFEQRHGGSHQSSKWTPVGPAPSTSQSQKRSSGLQSGHSSQRTSAGSSSGTNSSGQRHDRESYNNSGSSSRKKGQHGSEHSKSRSSSPGKPQAVSSLNSSHSRSHGNDHHSKEHQRSKSPRDPDANWDSPSRVPFSSGQHSTQSFPPSLMSKSNSMLQKPTAYVRPMDGQESMEPKLSSEHYSSQSHGNSMTELKPSSKAHLTKLKIPSQPLDASASGDVSCVDEILKEMTHSWPPPLTAIHTPCKTEPSKFPFPTKESQQSNFGTGEQKRYNPSKTSNGHQSKSMLKDDLKLSSSEDSDGEQDCDKTMPRSTPGSNSEPSHHNSEGADNSRDDSSSHSGSESSSGSDSESESSSSDSEANEPSQSASPEPEPPPTNKWQLDNWLNKVNPHKVSPASSVDSNIPSSQGYKKEGREQGTGNSYTDTSGPKETSSATPGRDSKTIQKGSESGRGRQKSPAQSDSTTQRRTVGKKQPKKAEKAAAEEPRGGLKIESETPVDLASSMPSSRHKAATKGSRKPNIKKESKSSPRPTAEKKKYKSTSKSSQKSREIIETDTSSSDSDESESLPPSSQTPKYPESNRTPVKPSSVEEEDSFFRQRMFSPMEEKELLSPLSEPDDRYPLIVKIDLNLLTRIPGKPYKETEPPKGEKKNVPEKHTREAQKQASEKVSNKGKRKHKNEDDNRASESKKPKTEDKNSAGHKPSSNRESSKQSAAKEKDLLPSPAGPVPSKDPKTEHGSRKRTISQSSSLKSSSNSNKETSGSSKNSSSTSKQKKTEGKTSSSSKEVKEKAPSSSSNCPPSAPTLDSSKPRRTKLVFDDRNYSADHYLQEAKKLKHNADALSDRFEKAVYYLDAVVSFIECGNALEKNAQESKSPFPMYSETVDLIKYTMKLKNYLAPDATAADKRLTVLCLRCESLLYLRLFKLKKENALKYSKTLTEHLKNSYNNSQAPSPGLGSKAVGMPSPVSPKLSPGNSGNYSSGASSASASGSSVTIPQKIHQMAASYVQVTSNFLYATEIWDQAEQLSKEQKEFFAELDKVMGPLIFNASIMTDLVRYTRQGLHWLRQDAKLIS

SEQ ID NO: 8325 - protein, 148 aa, Artificial Sequence
  Description of Artificial Sequence: Synthetic coding sequence
MNREDRNVLRMKERERRNQEIQQGEDAFPPSSPLFAEPYKVTSKEDKLSSRIQSMLGNYDEMKDFIGDRSIPKLVAIPKPTVPPSADEKSNPNFFEQRHGGSHQSSKWTPVGPAPSTSQSQKRSSGLQSGHSSQRTSAGSSSGTNSSG

SEQ ID NO: 8326 - protein, 352 aa, Artificial Sequence
  Description of Artificial Sequence: Synthetic coding sequence
MLRLLASGCARGPGPGVGARPAAGLFHPGRRQSRQASDAPRNQPPSPEFVARPVGVCSMMRLPVQTSPEGLDAAFIGVPLDTGTSNRPGARFGPRRIREESVMLGTVNPSTGALPFQSLMVADLGDVNVNLYNLQDSCRRIQEAYEKIVAAGCIPLTLGGDHTITYPILQAMAKKHGPVGLLHVDAHTDTTDKALGEKLYHGAPFRRCVDEGLLDCKRVVQIGIRGSSTTLDPYRYNRSQGFRVVLAEDCWMKSLVPLMGEVRQQMGGKPIYISFDIDALDPAYAPGTGTPEIAGLTPSQALEIIRGCQGLNVMGCDLVEVSPPYDLSGNTALLAANLLFEMLCALPKVTTV

SEQ ID NO: 8327 - protein, 538 aa, Artificial Sequence
  Description of Artificial Sequence: Synthetic coding sequence
MERLGEKASRLLEKFGRRKGESSRSGSDGTPGPGKGRLSGLGGPRKSGPRGATGGPGDEPLEPAREQGSLDAERNQRGSFEAPRYEGSFPAGPPPTRALPLPQSLPPDFRLEPTAPALSPRSSFASSSASDASKPSSPRGSLLLDGAGAGGAGGSRPCSNRTSGISMGYDQRHGSPLPAGPCLFGPPLAGAPAGYSPGGVPSAYPELHAALDRLYAQRPAGFGCQESRHSYPPALGSPGALAGAGVGAAGPLERRGAQPGRHSVTGYGDCAVGARYQDELTALLRLTVGTGGREAGARGEPSGIEPSGLEEPPGPFVPEAARARMREPEAREDYFGTCIKCNKGIYGQSNACQALDSLYHTQCFVCCSCGRTLRCKAFYSVNGSVYCEEDYLFSGFQEAAEKCCVCGHLILEKILQAMGKSYHPGCFRCIVCNKCLDGIPFTVDFSNQVYCVTDYHKNYAPKCAACGQPILPSEGCEDIVRVISMDRDYHFECYHCEDCRMQLSDEEGCCCFPLDGHLLCHGCHMQRLNARQPPANYI

SEQ ID NO: 8328 - protein, 538 aa, Artificial Sequence; identical to SEQ ID NO: 8327
  Description of Artificial Sequence: Synthetic coding sequence

SEQ ID NO: 8329 - protein, 121 aa, Artificial Sequence
  Description of Artificial Sequence: Synthetic coding sequence
MGKSYHPGCFRCIVCNKCLDGIPFTVDFSNQVYCVTDYHKNYAPKCAACGQPILPSEGCEDIVRVISMDRDYHFECYHCEDCRMQLSDEEGCCCFPLDGHLLCHGCHMQRLNARQPPANYI

SEQ ID NO: 8330 - protein, 80 aa, Artificial Sequence
  Description of Artificial Sequence: Synthetic coding sequence
MGKSYHPGCFRCIVCNKCLDGIPFTVDFSNQVYCVTDYHKNYAPKCAACGQPILPSEGCEDIVRVISMDRDYHFECYHCE

SEQ ID NO: 8331 - protein, 65 aa, Artificial Sequence
  Description of Artificial Sequence: Synthetic coding sequence
MGKSYHPGCFRCIVCNKCLDGIPFTVDFSNQVYCVTDYHKNYAPKCAACGQPILPSEGCEDIVRV

SEQ ID NO: 8332 - protein, 80 aa, Artificial Sequence; identical to SEQ ID NO: 8330
  Description of Artificial Sequence: Synthetic coding sequence

SEQ ID NO: 8333 - protein, 102 aa, Artificial Sequence
  Description of Artificial Sequence: Synthetic coding sequence
MANTQLDHLHYTTEFTRNDLLIICKKFNLMLMDEDIISLLAIFIKMCLWLWKQFLKRGSKCSETSELLEKVKLQLAFTAYKYVDICFPEQMAYSRYIRWYIH

SEQ ID NO: 8334 - protein, 499 aa, Artificial Sequence
  Description of Artificial Sequence: Synthetic coding sequence
MCELYSKRDTLGLRKKHIGPSCKVFFASDPIKIVRAQRQYMFDENGEQYLDCINNVAHVGHCHPGVVKAALKQMELLNTNSRFLHDNIVEYAKRLSATLPEKLSVCYFTNSGSEANDLALRLARQFRGHQDVITLDHAYHGHLSSLIEISPYKFQKGKDVKKEFVHVAPTPDTYRGKYREDHADSASAYADEVKKIIEDAHNSGRKIAAFIAESMQSCGGQIIPPAGYFQKVAEYVHGAGGVFIADEVQVGFGRVGKHFWSFQMYGEDFVPDIVTMGKPMGNGHPVACVVTTKEIAEAFSSSGMEYFNTYGGNPVSCAVGLAVLDIIENEDLQGNAKRVGNYLTELLKKQKAKHTLIGDIRGIGLFIGIDLVKDHLKRTPATAEAQHIIYKMKEKRVLLSADGPHRNVLKIKPPMCFTEEDAKFMVDQLDRILTVLEEAMGTKTESVTSENTPCKTKMLKEAHIELLRDSTTDSKENPSRKRNGMCTDTHSLLSKRLKT

SEQ ID NO: 8335 - protein, 493 aa, Artificial Sequence
  Description of Artificial Sequence: Synthetic coding sequence
MCELYSKRDTLGLRKKHIGPSCKVFFASDPIKIVRAQRQYMFDENGEQYLDCINNVAHGVVKAALKQMELLNTNSRFLHDNIVEYAKRLSATLPEKLSVCYFTNSGSEANDLALRLARQFRGHQDVITLDHAYHGHLSSLIEISPYKFQKGKDVKKEFVHVAPTPDTYRGKYREDHADSASAYADEVKKIIEDAHNSGRKIAAFIAESMQSCGGQIIPPAGYFQKVAEYVHGAGGVFIADEVQVGFGRVGKHFWSFQMYGEDFVPDIVTMGKPMGNGHPVACVVTTKEIAEAFSSSGMEYFNTYGGNPVSCAVGLAVLDIIENEDLQGNAKRVGNYLTELLKKQKAKHTLIGDIRGIGLFIGIDLVKDHLKRTPATAEAQHIIYKMKEKRVLLSADGPHRNVLKIKPPMCFTEEDAKFMVDQLDRILTVLEEAMGTKTESVTSENTPCKTKMLKEAHIELLRDSTTDSKENPSRKRNGMCTDTHSLLSKRLKT

SEQ ID NO: 8336 - protein, 441 aa, Artificial Sequence
  Description of Artificial Sequence: Synthetic coding sequence
MGHCHPGVVKAALKQMELLNTNSRFLHDNIVEYAKRLSATLPEKLSVCYFTNSGSEANDLALRLARQFRGHQDVITLDHAYHGHLSSLIEISPYKFQKGKDVKKEFVHVAPTPDTYRGKYREDHADSASAYADEVKKIIEDAHNSGRKIAAFIAESMQSCGGQIIPPAGYFQKVAEYVHGAGGVFIADEVQVGFGRVGKHFWSFQMYGEDFVPDIVTMGKPMGNGHPVACVVTTKEIAEAFSSSGMEYFNTYGGNPVSCAVGLAVLDIIENEDLQGNAKRVGNYLTELLKKQKAKHTLIGDIRGIGLFIGIDLVKDHLKRTPATAEAQHIIYKMKEKRVLLSADGPHRNVLKIKPPMCFTEEDAKFMVDQLDRILTVLEEAMGTKTESVTSENTPCKTKMLKEAHIELLRDSTTDSKENPSRKRNGMCTDTHSLLSKRLKT

SEQ ID NO: 8337 - protein, 450 aa, Artificial Sequence
  Description of Artificial Sequence: Synthetic coding sequence
MAADQRPKADTLALRQRLISSSCRLFFPEDPVKIVRAQGQYMYDEQGAEYIDCISNVAHVGHCHPLVVQAAHEQNQVLNTNSRYLHDNIVDYAQRLSETLPEQLCVFYFLNSGSEANDLALRLARHYTGHQDVVVLDHAYHGHLSSLIDISPYKFRNLDGQKEWVHVAPLPDTYRGPYREDHPNPAMAYANEVKRVVSSAQEKGRKIAAFFAESLPSVGGQIIPPAGYFSQVAEHIRKAGGVFVADEIQVGFGRVGKHFWAFQLQGKDFVPDIVTMGKSIGNGHPVACVAATQPVARAFEATGVEYFNTFGGSPVSCAVGLAVLNVLEKEQLQDHATSVGSFLMQLLGQQKIKHPIVGDVRGVGLFIGVDLIKDEATRTPATEEAAYLVSRLKENYVLLSTDGPGRNILKFKPPMCFSLDNARQVVAKLDAILTDMEEKVRSCETLRLQP

SEQ ID NO: 8338 - protein, 172 aa, Artificial Sequence
  Description of Artificial Sequence: Synthetic coding sequence
MIYSCCIFVYCMFECFKIKNSVNYHLLFTLVLFSLIVTTVYLKVKEPIFHQVMYGMLVFTLVLRSIYIVTWVYPWLRGLGYTSLGIFLLGFLFWNIDNIFCESLRNFRKKVPPIIGITTQFHAWWHILTGLGSYLHILFSLYTRTLYLRYRPKVKFLFGIWPVILFEPLRKH

SEQ ID NO: 8339 - protein, 267 aa, Artificial Sequence [sequence omitted]

SEQ ID NO: 8340 - protein, 230 aa, Artificial Sequence
  Description of Artificial Sequence: Synthetic coding sequence
MAPAADREGYWGPTTSTLDWCEENYSVTWYIAEFLVGMGSWCFHMTLKYEMQLLDELPMIYSCCIFVYCMFECFKIKNSVNYHLLFTLVLFSLIVTTVYLKVKEPIFHQVMYGMLVFTLVLRSIYIVTWVYPWLRGLGYTSLGIFLLGFLFWNIDNIFCESLRNFRKKVPPIIGITTQFHAWWHILTGLGSYLHILFSLYTRTLYLRYRPKVKFLFGIWPVILFEPLRKH

SEQ ID NO: 8341 - protein, 225 aa, Artificial Sequence
  Description of Artificial Sequence: Synthetic coding sequence
MIIPPMFGAVQSVRDGLEKRYIASYLALTVVGMGSWCFHMTLKYEMQLLDELPMIYSCCIFVYCMFECFKIKNSVNYHLLFTLVLFSLIVTTVYLKVKEPIFHQVMYGMLVFTLVLRSIYIVTWVYPWLRGLGYTSLGIFLLGFLFWNIDNIFCESLRNFRKKVPPIIGITTQFHAWWHILTGLGSYLHILFSLYTRTLYLRYRPKVKFLFGIWPVILFEPLRKH

SEQ ID NO: 8342 - protein, 134 aa, Artificial Sequence
  Description of Artificial Sequence: Synthetic coding sequence
MAQSRLIGTSTSQVMYGMLVFTLVLRSIYIVTWVYPWLRGLGYTSLGIFLLGFLFWNIDNIFCESLRNFRKKVPPIIGITTQFHAWWHILTGLGSYLHILFSLYTRTLYLRYRPKVKFLFGIWPVILFEPLRKH

SEQ ID NO: 8343 - protein, 150 aa, Artificial Sequence
  Description of Artificial Sequence: Synthetic coding sequence
MSGELSNRFQGGKAFGLLKARQERRLAEINREFLCDQKYSDEENLPEKLTAFKEKYMEFDLNNEGEIDLMSLKRMMEKLGVPKTHLEMKKMISEVTGGVSDTISYRDFVNMMLGKRSAVLKLVMMFEGKANESSPKPVGPPPERDIASLP

SEQ ID NO: 8344 - protein, 102 aa, Artificial Sequence
  Description of Artificial Sequence: Synthetic coding sequence
MSGELSNRFQGGKAFGLLKARQERRLAEINREFLCDQKYSDEENLPEKLTAFKEKYMEFDLNNEGEIDLMSLKRMMEKLGVPKTHLEMKKMISEVTGGSHDV

SEQ ID NO: 8345 - protein, 94 aa, Artificial Sequence
  Description of Artificial Sequence: Synthetic coding sequence
MEFDLNNEGEIDLMSLKRMMEKLGVPKTHLEMKKMISEVTGGVSDTISYRDFVNMMLGKRSAVLKLVMMFEGKANESSPKPVGPPPERDIASLP

SEQ ID NO: 8346 - protein, 142 aa, Artificial Sequence
  Description of Artificial Sequence: Synthetic coding sequence
MSGELSNRFQGGKAFGLLKARQERRLAEINREFLCDQKYSDEENLPEKLTAFKEKYMEFDLMSLKRMMEKLGVPKTHLEMKKMISEVTGGVSDTISYRDFVNMMLGKRSAVLKLVMMFEGKANESSPKPVGPPPERDIASLP

SEQ ID NO: 8347 - protein, 176 aa, Artificial Sequence
  Description of Artificial Sequence: Synthetic coding sequence
MSGELSNRFQGGKAFGLLKARQERRLAEINRYCAGREPQLQRISCSQHSCLLALLFQEFLCDQKYSDEENLPEKLTAFKEKYMEFDLNNEGEIDLMSLKRMMEKLGVPKTHLEMKKMISEVTGGVSDTISYRDFVNMMLGKRSAVLKLVMMFEGKANESSPKPVGPPPERDIASLP

SEQ ID NO: 8348 - protein, 155 aa, Artificial Sequence
  Description of Artificial Sequence: Synthetic coding sequence
MASKMVISAHPKILLQLIQKDKPGGPGARVRQKVLEEFLCDQKYSDEENLPEKLTAFKEKYMEFDLNNEGEIDLMSLKRMMEKLGVPKTHLEMKKMISEVTGGVSDTISYRDFVNMMLGKRSAVLKLVMMFEGKANESSPKPVGPPPERDIASLP

SEQ ID NO: 8349 - protein, 340 aa, Artificial Sequence
  Description of Artificial Sequence: Synthetic coding sequence
MRKELQLSLSVTLLLVCGFLYQFTLKSSCLFCLPSFKSHQGLEALLSHRRGIVFLETSERMEPPHLVSCSVESAAKIYPEWPVVFFMKGLTDSTPMPSNSTYPAFSFLSAIDNVFLFPLDMKRLLEDTPLFSWYNQINASAERNWLHISSDASRLAIIWKYGGIYMDTDVISIRPIPEENFLAAQASRYSSNGIFGFLPHHPFLWECMENFVEHYNSAIWGNQGPELMTRMLRVWCKLEDFQEVSDLRCLNISFLHPQRFYPISYREWRRYYEVWDTEPSFNVSYALHLWNHMNQEGRAVIRGSNTLVENLYRKHCPRTYRDLIKGPEGSVTGELGPGNK

SEQ ID NO: 8350 - protein, 505 aa, Artificial Sequence
  Description of Artificial Sequence: Synthetic coding sequence
MEQTEKSKVYAENGLLEKIKLCLSKKPLPSPTERKKFDHDFAISTSFHGIHNIVQNRSKIRRVLWLVVVLGSVSLVTWQIYIRLLNYFTWPTTTSIEVQYVEKMEFPAVTFCNLNRFQTDAVAKFGVIFFLWHIVSKVLHLQEITANSTGSREATDFAASHQNFSIVEFIRNKGFYLNNSTLLDCEFFGKPCSPKDFAHVFTEYGNCFTFNHGETLQAKRKVSVSGRGLSLLFNVNQEAFTDNPALGFVDAGIIFVIHSPKKVPQFDGLGLLSPVGMHARVTIRQVKTVHQEYPWGECNPNIKLQNFSSYSTSGCLKECKAQHIKKQCGCVPFLLPGYGIECDLQKYFSCVSPVLDHIEFKDLCTVGTHNSSCPVSCEEIEYPATISYSSFPSQKALKYLSKKLNQSRKYIRENLVKIEINYSDLNYKITQQQKAVSVSELLADLGGQLGLFCGASLITIIEIIEYLFTNFYWICIFFLLKISEMTQWTPPPQNHLGNKNRIEEC

SEQ ID NO: 8351 - protein, 990 aa, Artificial Sequence
  Description of Artificial Sequence: Synthetic coding sequence
MGPPSSSGFYVSRAVALLLAGLVAALLLALAVLAALYGHCERVPPSELPGLRDLEAESSPPLRQKPTPTPKPSSARELAVTTTPSNWRPPGPWDQLRLPPWLVPLHYDLELWPQLRPDELPAGSLPFTGRVNITVRCTVATSRLLLHSLFQDCERAEVRGPLSPGTGNATVGRVPVDDVWFALDTEYMVLELSEPLKPGSSYELQLSFSGLVKEDLREGLFLNVYTDQGERRALLASQLEPTFARYVFPCFDEPALKATFNITMIHHPSYVALSNMPKLGQSEKEDVNGSKWTVTTFSTTPHMPTYLVAFVICDYDHVNRTERGKEIRIWARKDAIANGSADFALNITGPIFSFLEDLFNISYSLPKTDIIALPSFDNHAMENWGLMIFDESGLLLEPKDQLTEKKTLISYVVSHEIGHQWFGNLVTMNWWNNIWLNEGFASYFEFEVINYFNPKLPRNEIFFSNILHNILREDHALVTRAVAMKVENFKTSEIQELFDIFTYSKGASMARMLSCFLNEHLFVSALKSYLKTFSYSNAEQDDLWRHFQMAIDDQSTVILPATIKNIMDSWTHQSGFPVITLNVSTGVMKQEPFYLENIKNRTLLTSNDTWIVPILWIKNGTTQPLVWLDQSSKVFPEMQVSDSDHDWVILNLNMTGYYRVNYDKLGWKKLNQQLEKDPKAIPVIHRLQLIDDAFSLSKNNYIEIETALELTKYLAEEDEIIVWHTVLVNLVTRDLVSEVNIYDIYSLLKRYLLKRLNLIWNIYSTIIRENVLALQDDYLALISLEKLFVTACWLGLEDCLQLSKELFAKWVDHPENEIPYPIKDVVLCYGIALGSDKEWDILLNTYTNTTNKEEKIQLAYAMSCSKDPWILNRYMEYAISTSPFTSNETNIIEVVASSEVGRYVAKDFLVNNWQAVSKRYGTQSLINLIYTIGRTVTTDLQIVELQQFFSNMLEEHQRIRVHANLQTIKNENLKNKKLSARIAAWLRRNT

SEQ ID NO: 8352 - protein, 979 aa, Artificial Sequence
  Description of Artificial Sequence: Synthetic coding sequence
MGPPSSSGFYVSRAVALLLAGLVAALLLALAVLAALYGHCERVPPSELPGLRDLEAESSPPLRQKPTPTPKPSSARELAVTTTPSNWRPPGPWDQLRLPPWLVPLHYDLELWPQLRPDELPAGSLPFTGRVNITVRCTVATSRLLLHSLFLSPGTGNATVGRVPVDDVWFALDTEYMVLELSEPLKPGSSYELQLSFSGLVKEDLREGLFLNVYTDQGERRALLASQLEPTFARYVFPCFDEPALKATFNITMIHHPSYVALSNMPKLGQSEKEDVNGSKWTVTTFSTTPHMPTYLVAFVICDYDHVNRTERGKEIRIWARKDAIANGSADFALNITGPIFSFLEDLFNISYSLPKTDIIALPSFDNHAMENWGLMIFDESGLLLEPKDQLTEKKTLISYVVSHEIGHQWFGNLVTMNWWNNIWLNEGFASYFEFEVINYFNPKLPRNEIFFSNILHNILREDHALVTRAVAMKVENFKTSEIQELFDIFTYSKGASMARMLSCFLNEHLFVSALKSYLKTFSYSNAEQDDLWRHFQMAIDDQSTVILPATIKNIMDSWTHQSGFPVITLNVSTGVMKQEPFYLENIKNRTLLTSNDTWIVPILWIKNGTTQPLVWLDQSSKVFPEMQVSDSDHDWVILNLNMTGYYRVNYDKLGWKKLNQQLEKDPKAIPVIHRLQLIDDAFSLSKNNYIEIETALELTKYLAEEDEIIVWHTVLVNLVTRDLVSEVNIYDIYSLLKRYLLKRLNLIWNIYSTIIRENVLALQDDYLALISLEKLFVTACWLGLEDCLQLSKELFAKWVDHPENEIPYPIKDVVLCYGIALGSDKEWDILLNTYTNTTNKEEKIQLAYAMSCSKDPWILNRYMEYAISTSPFTSNETNIIEVVASSEVGRYVAKDFLVNNWQAVSKRYGTQSLINLIYTIGRTVTTDLQIVELQQFFSNMLEEHQRIRVHANLQTIKNENLKNKKLSARIAAWLRRNT

SEQ ID NO: 8353 - protein, 226 aa, Artificial Sequence
  Description of Artificial Sequence: Synthetic coding sequence
MKVENFKTSEIQELFDIFTYSKGASMARMLSCFLNEHLFVSALKSYLKTFSYSNAEQDDLWRHFQMAIDDQSTVILPATIKNIMDSWTHQSGFPVITLNVSTGVMKQEPFYLENIKNRTLLTSNDTWIVPILWIKNGTTQPLVWLDQSSKVFPEMQVSDSDHDWVILNLNMTGYYRVNYDKLGWKKLNQQLEKDPKAIPVIHRLQLIDDAFSLSNLQDFGHLKVPN

SEQ ID NO: 8354 - protein, 172 aa, Artificial Sequence
  Description of Artificial Sequence: Synthetic coding sequence
MGESSEDIDQMFSTLLGEMDLLTQSLGVDTLPPPDPNPPRAEFNYSVGFKDLNESLNALEDQDLDALMADLVADISEAEQRTIQAQKESLQNQHHSASLQASIFSGAASLGYGTNVAATGISQYEDDLPPPPADPVLDLPLPPPPPEPLSQVSMWDQRWQDHQPLLPITDVP

SEQ ID NO: 8355 - protein, 666 aa, Artificial Sequence
  Description of Artificial Sequence: Synthetic coding sequence
MGESSEDIDQMFSTLLGEMDLLTQSLGVDTLPPPDPNPPRAEFNYSVGFKDLNESLNALEDQDLDALMADLVADISEAEQRTIQAQKESLQNQHHSASLQASIFSGAASLGYGTNVAATGISQYEDDLPPPPADPVLDLPLPPPPPEPLSQEEEEAQAKADKIKLALEKLKEAKVKKLVVKVHMNDNSTKSLMVDERQLARDVLDNLFEKTHCDCNVDWCLYEIYPELQIERFFEDHENVVEVLSDWTRDTENKILFLEKEEKYAVFKNPQNFYLDNRGKKESKETNEKMNAKNKESLLEESFCGTSIIVPELEGALYLKEDGKKSWKRRYFLLRASGIYYVPKGKTKTSRDLACFIQFENVNIYYGTQHKMKYKAPTDYCFVLKHPQIQKESQYIKYLCCDDTRTLNQWVMGIRIAKYGKTLYDNYQRAVAKAGLASRWTNLGTVNAAAPAQPSTGPKTGTTQPNGQIPQATHSVSAVLQEAQRHAETSKDKKPALGNHHDPAVPRAPHAPKSSLPPPPPVRRSSDTSGSPATPLKAKGTGGGGLPAPPDDFLPPPPPPPPLDDPELPPPPPDFMEPPPDFVPPPPPSYAGIAGSELPPPPPPPPAPAPAPVPDSARPPPAVAKRPPVPPKRQENPGHPGGAGGGEQDFMSDLMKALQKKRGNVS

SEQ ID NO: 8356 - protein, 635 aa, Artificial Sequence
  Description of Artificial Sequence: Synthetic coding sequence
MGESSEDIDQMFSTLLGEMDLLTQSLGVDTLPPPDPNPPRAEFNYSVGFKDLNESLNALEDQDLDALMADLVADISEAEQRTIQAQKESLQNQHHSASLQASIFSGAASLGYGTNVAATGISQYEDDLPPPPADPVLDLPLPPPPPEPLSQEEEEAQAKADKIKLALEKLKEAKVKKLVVKVHMNDNSTKSLMVDERQLARDVLDNLFEKTHCDCNVDWCLYEIYPELQIERFFEDHENVVEVLSDWTRDTENKILFLEKEEKYAVFKNPQNFYLDNRGKKESKETNEKMNAKNKESLLEESFCGTSIIVPELEGALYLKEDGKKSWKRRYFLLRASGIYYVPKGKTKTSRDLACFIQFENVNIYYGTQHKMKYKAPTDYCFVLKHPQIQKESQYIKYLCCDDTRTLNQWVMGIRIAKYGKTLYDNYQRAVAKAGLASRWTNLGTVNAAAPAQPSTGPKTGTTQPNGQIPQATHSVSAVLQEAQRHAETSKDKKPALGNHHDPAVPRAPHAPKSSLPPPPPVRRSSDTSGSPATPLKAKGTGGGGLPAARARARPRPRLRQAAPRGGQEASCAPQEAREPRAPRRSRRRGARFHVRPHESFAKEERQRVLGTGMMSVPEGEASLTPSAGFASRLP

SEQ ID NO: 8357 - protein, 245 aa, Artificial Sequence
  Description of Artificial Sequence: Synthetic coding sequence
MALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKKPPSWQDMKIKFMYLGPSS

SEQ ID NO: 8358 - protein, 186 aa, Artificial Sequence
  Description of Artificial Sequence: Synthetic coding sequence
MALVPCQVLRMAILLSYCSILCNYKAIEMPSHQTYGGSWKFLTFIDLFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKSMEEEKEKPKLE

SEQ ID NO: 8359 - protein, 238 aa, Artificial Sequence
  Description of Artificial Sequence: Synthetic coding sequence
MALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKSMEEEKEKPKLE

SEQ ID NO: 8360 - protein, 47 aa, Artificial Sequence
  Description of Artificial Sequence: Synthetic coding sequence
MALVPCQVLRMAILLSYCSILCNYKAIEMPSHQTYGGSWKFLTFIDL

SEQ ID NO: 8361 - protein, 134 aa, Artificial Sequence
  Description of Artificial Sequence: Synthetic coding sequence
MALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGML

SEQ ID NO: 8362 - protein, 192 aa, Artificial Sequence
  Description of Artificial Sequence: Synthetic coding sequence
MTKVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGAR

SEQ ID NO: 8363 - protein, 234 aa, Artificial Sequence
  Description of Artificial Sequence: Synthetic coding sequence
MTKVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKSMEEEKEKPKLE

SEQ ID NO: 8364 - protein, 124 aa, Artificial Sequence
  Description of Artificial Sequence: Synthetic coding sequence
MALVPCQVLRMAILLSYCSILCNYKAIEMPSHQTYGGSWKFLTFIDLFVVAVFWIIYAYDREMIYPKLLDNFIPGWLNHGMHTTVLPFILIEMRTSHHQYPSRSSGLTAICTFSVGYILWVCWV

SEQ ID NO: 8365 - protein, 138 aa, Artificial Sequence
  Description of Artificial Sequence: Synthetic coding sequence
MLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQK

SEQ ID NO: 8366 - protein, 434 aa, Artificial Sequence
  Description of Artificial Sequence: Synthetic coding sequence
MESESESGAAADTPPLETLSFHGDEEIIEVVELDPGPPDPDDLAQEMEDVDFEEEEEEEGNEEGWVLEPQEGVVGSMEGPDDSEVTFALHSASVFCVSLDPKTNTLAVTGGEDDKAFVWRLSDGELLFECAGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGKRAVVGYEDGTIRIWDLKQGSPIHVLKGTEGHQGPLTCVAANQDGSLILTGSVDCQAKLVSATTGKVVGVFRPETVASQPSLGEGEESESNSVESLGFCSVMPLAAVGYLDGTLAIYDLATQTLRHQCQHQSGIVQLLWEAGTAVVYTCSLDGIVRLWDARTGRLLTDYRGHTAEILDFALSKDASLVVTTSGDHKAKVFCVQRPDR

SEQ ID NO: 8367 - protein, 906 aa, Artificial Sequence
  Description of Artificial Sequence: Synthetic coding sequence
MWRAKLRRGTCEPAVKVEDPLCNFHSPNFLRISEVEMRGSEDAAAGTVLQRLIQEQLRYGTPTENMNLLAIQHQATGSAGPAHPTNNFSSTENLTQEDPQMVYQSARQEPQGQEHQVDNTVMEKQVRSTQPQQNNEELPTYEEAKAQSQFFRGQQQQQQQQGAVGHGYYMAGGTSQKSRTEGRPTVNRANSGQAHKDEALKELKQGHVRSLSERIMQLSLERNGAKQHLPGSGNGKGFKVGGGPSPAQPAGKVLDPRGPPPEYPFKTKQMMSPVSKTQEHGLFYGDQHPGMLHEMVKPYPAPQPVRTDVAVLRYQPPPEYGVTSRPCQLPFPSTMQQHSPMSSQTSSASGPLHSVSLPLPLPMALGAPQPPPAASPSQQLGPDAFAIVERAQQMVEILTEENRVLHQELQGYYDNADKLHKFEKELQRISEAYESLVKSTTKRESLDKAMRNKLEGEIRRLHDFNRDLRDRLETANRQLSSREYEGHEDKAAEGHYASQNKEFLKEKEKLEMELAAVRTASEDHRRHIEILDQALSNAQARVIKLEEELREKQAYVEKVEKLQQALTQLQSACEKREQMERRLRTWLERELDALRTQQKHGNGQPANMPEYNAPALLELVREKEERILALEADMTKWEQKYLEESTIRHFAMNAAATAAAERDTTIINHSRNGSYGESSLEAHIWQEEEEVVQANRRCQDMEYTIKNLHAKIIEKDAMIKVLQQRSRKDAGKTDSSSLRPARSVPSIAAATGTHSRQTSLTSSQLAEEKKEEKTWKGSIGLLLGKEHHEHASAPLLPPPPTSALSSIASTTAASSAHAKTGSKDSSTQTDKSAELFWPSMASLPSRGRLSTTPAHSPVLKHPAAKGTAEKLENSPGHGKSPDHRGRVSSLLHKPEFPDGEMMEVLI

SEQ ID NO: 8368 - protein, 543 aa, Artificial Sequence
  Description of Artificial Sequence: Synthetic coding sequence
MWRAKLRRGTCEPAVKGSPSACYSPSSPVQVLEDSTYFSPDFQLYSGRHETSALTVEATSSIREKVVEDPLCNFHSPNFLRISEVEMRGSEDAAAGTVLQRLIQEQLRYGTPTENMNLLAIQHQATGSAGPAHPTNNFSSTENLTQEDPQMVYQSARQEPQGQEHQVDNTVMEKQVRSTQPQQNNEELPTYEEAKAQSQFFRGQQQQQQQQGAVGHGYYMAGGTSQKSRTEGRPTVNRANSGQAHKDEALKELKQGHVRSLSERIMQLSLERNGAKQHLPGSGNGKGFKVGGGPSPAQPAGKVLDPRGPPPEYPFKTKQMMSPVSKTQEHGLFYGDQHPGMLHEMVKPYPAPQPVRTDVAVLRYQPPPEYGVTSRPCQLPFPSTMQQHSPMNFRTSLTSSQLAEEKKEEKTWKGSIGLLLGKEHHEHASAPLLPPPPTSALSSIASTTAASSAHAKTGSKDSSTQTDKSAELFWPSMASLPSRGRLSTTPAHSPVLKHPAAKGTAEKLENSPGHGKSPDHRGRVSSLLHKPEFPDGEMMEVLI

SEQ ID NO: 8369 - protein, 956 aa, Artificial Sequence
  Description of Artificial Sequence: Synthetic coding sequence
MWRAKLRRGTCEPAVKGSPSACYSPSSPVQVLEDSTYFSPDFQLYSGRHETSALTVEATSSIREKVVEDPLCNFHSPNFLRISEVEMRGSEDAAAGTVLQRLIQEQLRYGTPTENMNLLAIQHQATGSAGPAHPTNNFSSTENLTQEDPQMVYQSARQEPQGQEHQVDNTVMEKQVRSTQPQQNNEELPTYEEAKAQSQFFRGQQQQQQQQGAVGHGYYMAGGTSQKSRTEGRPTVNRANSGQAHKDEALKELKQGHVRSLSERIMQLSLERNGAKQHLPGSGNGKGFKVGGGPSPAQPAGKVLDPRGPPPEYPFKTKQMMSPVSKTQEHGLFYGDQHPGMLHEMVKPYPAPQPVRTDVAVLRYQPPPEYGVTSRPCQLPFPSTMQQHSPMSSQTSSASGPLHSVSLPLPLPMALGAPQPPPAASPSQQLGPDAFAIVERAQQMVEILTEENRVLHQELQGYYDNADKLHKFEKELQRISEAYESLVKSTTKRESLDKAMRNKLEGEIRRLHDFNRDLRDRLETANRQLSSREYEGHEDKAAEGHYASQNKEFLKEKEKLEMELAAVRTASEDHRRHIEILDQALSNAQARVIKLEEELREKQAYVEKVEKLQQALTQLQSACEKREQMERRLRTWLERELDALRTQQKHGNGQPANMPEYNAPALLELVREKEERILALEADMTKWEQKYLEESTIRHFAMNAAATAAAERDTTIINHSRNGSYGESSLEAHIWQEEEEVVQANRRCQDMEYTIKNLHAKIIEKDAMIKVLQQRSRKDAGKTDSSSLRPARSVPSIAAATGTHSRQTSLTSSQLAEEKKEEKTWKGSIGLLLGKEHHEHASAPLLPPPPTSALSSIASTTAASSAHAKTGSKDSSTQTDKSAELFWPSMASLPSRGRLSTTPAHSPVLKHPAAKGTAEKLENSPGHGKSPDHRGRVSSLLHKPEFPDGEMMEVLI

SEQ ID NO: 8370 - protein, 611 aa, Artificial Sequence
  Description of Artificial Sequence: Synthetic coding sequence
TSHDRLMWRAKLRRGTCEPAVKGSPSACYSPSSPVQVLEDSTYFSPDFQLYSGRHETSALTVEATSSIREKVVEDPLCNFHSPNFLRISEVEMRGSEDAAAGTVLQRLIQEQLRYGTPTENMNLLAIQHQATGSAGPAHPTNNFSSTENLTQEDPQMVYQSARQEPQGQEHQVDNTVMEKQVRSTQPQQNNEELPTYEEAKAQSQFFRGQQQQQQQQGAVGHGYYMAGGTSQKSRTEGRPTVNRANSGQAHKDEALKELKQGHVRSLSERIMQLSLERNGAKQHLPGSGNGKGFKVGGGPSPAQPAGKVLDPRGPPPEYPFKTKQMMSPVSKTQEHGLFYGDQHPGMLHEMVKPYPAPQPVRTDVAVLRYQPPPEYGVTSRPCQLPFPSTMQQHSPMSSQTSSASGPLHSVSLPLPLPMALGAPQPPPAASPSQQLGPDAFAIVERAQQMVEILTEENRVLHQELQGYYDNADKLHKFEKELQRISEAYESLVKSTTKRESLDKAMRNKLEGEIRRLHDFNRDLRDRLETANRQLSSREYEGHEDKAAEGHYASQNKEFLKEKEKLEMELAAVRTASEDHRRHIEILDQALSNAQARHQAGRGVTREASIC

SEQ ID NO: 8371 - protein, 780 aa, Artificial Sequence
  Description of Artificial Sequence: Synthetic coding sequence
MRTLEDSSGTVLHRLIQEQLRYGNLTETRTLLAIQQQALRGGAGTGGTGSPQASLEILAPEDSQVLQQATRQEPQGQEHQGGENHLAENTLYRLCPQPSKGEELPTYEEAKAHSQYYAAQQAGTRPHAGDRDPRGAPGGSRRQDEALRELRHGHVRSLSERLLQLSLERNGARAPSHMSSSHSFPQLARNQQGPPLRGPPAEGPESRGPPPQYPHVVLAHETTTAVTDPRYRARGSPHFQHAEVRILQAQVPPVFLQQQQQYQYLQQSQEHPPPPHPAALGHGPLSSLSPPAVEGPVSAQASSATSGSAHLAQMEAVLRENARLQRDNERLQRELESSAEKAGRIEKLESEIQRLSEAHESLTRASSKREALEKTMRNKMDSEMRRLQDFNRDLRERLESANRRLASKTQEAQAGSQDMVAKLLAQSYEQQQEQEKLEREMALLRGAIEDQRRRAELLEQALGNAQGRAARAEEELRKKQAYVEKVERLQQALGQLQAACEKREQLELRLRTRLEQELKALRAQQRQAGAPGGSSGSGGSPELSALRLSEQLREKEEQILALEADMTKWEQKYLEERAMRQFAMDAAATAAAQRDTTLIRHSPQPSPSSSFNEGLLTGGHRHQEMESRLKVLHAQILEKDAVIKVLQQRSRRDPGKAIQGSLRPAKSVPSVFAAAAAGTQGWQGLSSSERQTADAPARLTTADRAPTEEPVVTAPPAAHAKHGSRDGSTQTEGPPDSTSTCLPPEPDSLLGCSSSQRAASLDSVATSRVQDLSDMVEILI

SEQ ID NO: 8372 - protein, 779 aa, Artificial Sequence
  Description of Artificial Sequence: Synthetic coding sequence
MRTLEDSSGTVLHRLIQEQLRYGNLTETRTLLAIQQQALRGGAGTGGTGSPQASLEILAPEDSQVLQQATRQEPQGQEHQGGENHLAENTLYRLCPQPSKGEELPTYEEAKAHSQYYAAQQAGTRPHAGDRDPRGAPGGSRRQDEALRELRHGHVRSLSERLLQLSLERNGARAPSHMSSSHSFPQLARNQQGPPLRGPPAEGPESRGPPPQYPHVVLAHETTTAVTDPRYRARGSPHFQHAEVRILQAQVPPVFLQQQQQYQYLQQSQEHPPPPHPAALGHGPLSSLSPPAVEGPVSAQASSATSGSAHLAQMEAVLRENARLQRDNERLQRELESSAEKAGRIEKLESEIQRLSEAHESLTRASSKREALEKTMRNKMDSEMRRLQDFNRDLRERLESANRRLASKTQEAQAGSQDMVAKLLAQSYEQQQEQEKLEREMALLRGAIEDQRRRAELLEQALGNAQGRAARAEEELRKKQAYVEKVERLQQALGQLQAACEKREQLELRLRTRLEQELKALRAQQRQAGAPGGSSGSGGSPELSALRLSEQLREKEEQILALEADMTKWEQKYLEERAMRQFAMDAAATAAAQRDTTLIRHSPQPSPSSSFNEGLLTGGHRHQEMESRLKVLHAQILEKDAVIKVLQQRSRRDPGKAIQGSLRPAKSVPSVFAAAAAGTQGWQGLSSSERQTADAPARLTTDRAPTEEPVVTAPPAAHAKHGSRDGSTQTEGPPDSTSTCLPPEPDSLLGCSSSQRAASLDSVATSRVQDLSDMVEILI

SEQ ID NO: 8373 - protein, 33 aa, Artificial Sequence
  Description of Artificial Sequence: Synthetic coding sequence
MRTLEDSSGTVLHRLIQEQLRYGNLTETRTLLA

SEQ ID NO: 8374 - protein, 151 aa, Artificial Sequence
  Description of Artificial Sequence: Synthetic coding sequence
MRTLEDSSGTVLHRLIQEQLRYGNLTETRTLLAIQQQALRGGAGTGGTGSPQASLEILAPEDSQVLQQATRQEPQGQEHQGGENHLAENTLYRLCPQPSKGEELPTYEEAKAHSQYYAAQQAGTRPHAGDRDPRGAPGGSRRQDEALRELR

SEQ ID NO: 8375 - protein, 144 aa, Artificial Sequence
  Description of Artificial Sequence: Synthetic coding sequence
MRTLEDSSGTVLHRLIQEQLRYGNLTETRTLLAIQQQALRGGAGTGGTGSPQASLEILAPEDSQVLQQATRQEPQGQEHQGGENHLAENTLYRLCPQPSKGEELPTYEEAKAHSQYYAAQQAGTRPHAGDRDPRGAPGGSRRQD

SEQ ID NO: 8376 - protein, 127 aa, Artificial Sequence
  Description of Artificial Sequence: Synthetic coding sequence
MRTLEDSSGTVLHRLIQEQLRYGNLTETRTLLAIQQQALRGGAGTGGTGSPQASLEILAPEDSQVLQQATRQEPQGQEHQGGENHLAENTLYRLCPQPSKGEELPTYEEAKAHSQYYAAQQAGTRPH

SEQ ID NO: 8377 - protein, 198 aa, Artificial Sequence
  Description of Artificial Sequence: Synthetic coding sequence
MRTLEDSSGTVLHRLIQEQLRYGNLTETRTLLAIQQQALRGGAGTGGTGSPQASLEILAPEDSQVLQQATRQEPQGQEHQGGENHLAENTLYRLCPQPSKGEELPTYEEAKAHSQYYAAQQAGTRPHAGDRDPRGAPGGSRRQDEALRELRHGHVRSLSERLLQLSLERNGARAPSHMSSSHSFPQLARNQQGPPLRG

SEQ ID NO: 8378 - protein, 777 aa, Artificial Sequence
  Description of Artificial Sequence: Synthetic coding sequence
MRTLEDSSGTVLHRLIQEQLRYGNLTETRTLLAIQQQALRGGAGTGGTGSPQASLEILAPEDSQVLQQATRQEPQGQEHQGGENHLAENTLYRLCPQPSKGEELPTYEEAKAHSQYYAAQQAGTRPHAGDRDPRGAPGGSRRQDEALRELRHGHVRSLSERLLQLSLERNGARAPSHMSSSHSFPQLARNQQGPPLRGPPAEGPESRGPPPQYPHVVLAHETTTAVTDPRYRARGSPHFQHAEVRILQAQVPPVFLQQQQQYQYLQQSQEHPPPPHPAALGHGPLSSLSPPAVEGPVSAQASSATSGSAHLAQMEAVLRENARLQRDNERLQRELESSAEKAGRIEKLESEIQRLSEAHESLTRASSKREALEKTMRNKMDSEMRRLQDFNRDLRERLESANRRLASKTQEAQAGSQDMVAKLLAQSYEQQQEQEKLEREMALLRGAIEDQRRRAELLEQALGNAQGRAARAEEELRKKQAYVEKVERLQQALGQLQAACEKREQLELRLRTRLEQELKALRAQQAGAPGGSSGSGGSPELSALRLSEQLREKEEQILALEADMTKWEQKYLEERAMRQFAMDAAATAAAQRDTTLIRHSPQPSPSSSFNEGLLTGGHRHQEMESRLKVLHAQILEKDAVIKVLQQRSRRDPGKAIQGSLRPAKSVPSVFAAAAAGTQGWQGLSSSERQTADAPARLTTDRAPTEEPVVTAPPAAHAKHGSRDGSTQTEGPPDSTSTCLPPEPDSLLGCSSSQRAASLDSVATSRVQDLSDMVEILI

SEQ ID NO: 8379 - protein, 837 aa, Artificial Sequence
  Description of Artificial Sequence: Synthetic coding sequence
MTGRKASGGTPCTLRKGAPIITLGKNWTERLAAGDSVGCSGARCHRPLSRQLCASQRSMRTLEDSSGTVLHRLIQEQLRYGNLTETRTLLAIQQQALRGGAGTGGTGSPQASLEILAPEDSQVLQQATRQEPQGQEHQGGENHLAENTLYRLCPQPSKGEELPTYEEAKAHSQYYAAQQAGTRPHAGDRDPRGAPGGSRRQDEALRELRHGHVRSLSERLLQLSLERNGARAPSHMSSSHSFPQLARNQQGPPLRGPPAEGPESRGPPPQYPHVVLAHETTTAVTDPRYRARGSPHFQHAEVRILQAQVPPVFLQQQQQYQYLQQSQEHPPPPHPAALGHGPLSSLSPPAVEGPVSAQASSATSGSAHLAQMEAVLRENARLQRDNERLQRELESSAEKAGRIEKLESEIQRLSEAHESLTRASSKREALEKTMRNKMDSEMRRLQDFNRDLRERLESANRRLASKTQEAQAGSQDMVAKLLAQSYEQQQEQEKLEREMALLRGAIEDQRRRAELLEQALGNAQGRAARAEEELRKKQAYVEKVERLQQALGQLQAACEKREQLELRLRTRLEQELKALRAQQRQAGAPGGSSGSGGSPELSALRLSEQLREKEEQILALEADMTKWEQKYLEERAMRQFAMDAAATAAAQRDTTLIRHSPQPSPSSSFNEGLLTGGHRHQEMESRLKVLHAQILEKDAVIKVLQQRSRRDPGKAIQGSLRPAKSVPSVFAAAAAGTQGWQGLSSSERQTADAPARLTTDRAPTEEPVVTAPPAAHAKHGSRDGSTQTEGPPDSTSTCLPPEPDSLLGCSSSQRAASLDSVATSRVQDLSDMVEILI

SEQ ID NO: 8380 - protein, 123 aa, Artificial Sequence
  Description of Artificial Sequence: Synthetic coding sequence
MRTLEDSSGTVLHRLIQEQLRYGNLTETRTLLAIQQQALRGGAGTGGTGSPQASLEILAPEDSQVLQQATRQEPQGQEHQGGENHLAENTLYRLCPQPSKGEELPTYEEAKAHSQYYAAQQAG

SEQ ID NO: 8381 - protein, 159 aa, Artificial Sequence
  Description of Artificial Sequence: Synthetic coding sequence
MELPAVNLKVILLGHWLLTTWGCIVFSGSYAWANFTILALGVWAVAQRDSIDAISMFLGGLLATIFLDIVHISIFYPRVSLTDTGRFGVGMAILSLLLKPLSCCFVYHMYRERGGELLVHTGFLGSSQDRSAYQTIDSAEAPADPFAVPEGRSQDARGY

SEQ ID NO: 8382 - protein, 152 aa, Artificial Sequence
  Description of Artificial Sequence: Synthetic coding sequence
MELPAVNLKVILLGHWLLTTWGCIVFSGSYAWANFTILALGVWAVAQRDSIDAISMFLGGLLATIFLDIVHISIFYPRVSLTDTGRFGVGMAILSLLLKPLSCCFVYHMYRERGGFLGSSQDRSAYQTIDSAEAPADPFAVPEGRSQDARGY

SEQ ID NO: 8383 - protein, 111 aa, Artificial Sequence
  Description of Artificial Sequence: Synthetic coding sequence
MELPAVNLKGLHCILRLLCLGQLHHPGLGRVGCGSAGLHRRHKHVSGWLAGHHLPGHRAHQHLLPAGQPHGHGPLWRGHGHPQLAAQAALLLLRLPHVPGARGFPWVFSGP

SEQ ID NO: 8384 - protein, 147 aa, Artificial Sequence
  Description of Artificial Sequence: Synthetic coding sequence
MELPAVNLKVILLGHWLLTTCFWRHFSAKPRLETIELTCALCKLRSAAHRATAGLHCILRLLCLGQLHHPGLGRVGCGSAGLHRRHKHVSGWLAGHHLPGHRAHQHLLPAGQPHGHGPLWRGHGHPQLAAQAALLLLRLPHVPGARG

SEQ ID NO: 8385 - protein, 155 aa, Artificial Sequence
  Description of Artificial Sequence: Synthetic coding sequence
MELPAVNLKVILLGHWLLTTCFWRHFSAKPRLETIELTCALCKLRSAAHRATAGLHCILRLLCLGQLHHPGLGRVGCGSAGLHRRHKHVSGWLAGHHLPGHRAHQHLLPAGQPHGHGPLWRGHGHPQLAAQAALLLLRLPHVPGARGFPWVFSGP

SEQ ID NO: 8386 - protein, 801 aa, Artificial Sequence
  Description of Artificial Sequence: Synthetic coding sequence
MKYAENIMLKLTFSTTQIQQYENVFIFETGYWLTNAIKYNQDYLDICTYQRLQQRLYLQKKIIQKHFEKKKDIRRGIGYLKLICFLIPFLLSLKKKMKVPYLSSLLQPFSDDKVKTERELPPFIYGRDFKCQNFHYKENQYFHVHGGIEFDISTPSIENALEDFQKNLEKIRDCAANTFIEDSGYKEYYSIPVMEFHGKSYYVIYFELETFYQQLYKTQWWGAINEIVNNLRLKRLPLTDAQLHEQFKKKLGFKRAMKCKSIPFGMKSAVERGLSAVFHTFSRKTSSSTINVSDEAGYTIFHHAALHNRVSIICQLCNANFKVNQRRFVTFSQGPTPLHLAAQACSLETTVCLLCSKADYTLSEKRGWMPIHFAAFYDNVCIIIALCRKDPSLLEAEATAENQCTPLLLAATSGALDTIQYLFSIGANWRKTDIKGNNIIHLSVLTFHTEVLKYIIKLNIPELPVWKTLVEMLQCESYKRRMMAVMSLEVICLANDQYWRCILDAGTIPALINLLKSSKIKLQCKTVGLLSNISTHKSAVHALVEAGGIPSLINLLVCDEPEVHSRCAVILYDIAQCENKDVIAKYNGIPSLINLLNLNIENVLVNVMNCIRVLCIGNENNQRAVREHKGLPYLIRFLSSDSGLFNLFLNSFEDVLKAVSSAAIAEVGRDNKEIQDAIAMEGAIPPLVALFKGKQISVQMKGAMAVESLASHNALIQKAFLEKSLTKYLLKLLKAFQIDVKEQGAVALWALAGQTLKQQKYMAEQIGYSFIINMLLSPSAKMQYVGYLLKSRLCINTFCLQ

SEQ ID NO: 8387 - protein, 1434 aa, Artificial Sequence
  Description of Artificial Sequence: Synthetic coding sequence
MLRLPKKGLPRFEQVQDEDTYLENLAIQRNASAFFEKYDRSEIQELLTTALVSWLSAKEDVRSQVDLPCGIMSQMNNVGFSTAILLTPVDPTALLDYREVHQMIRELAIGIYCLNQIPSISLEANYDQSSSCQLPPAYYDTRIGQILINIDYMLKALWHGIYMPKEKRARFSELWRAIMDIDPDGKPQTNKDIFSEFSSAGLTDITKDPDFNEIYDEDVNEDPTYDPNSPEETAVFMKYAENIMLKLTFSTTQIQQYENVFIFETGYWLTNAIKYNQDYLDICTYQRLQQRLYLQKKIIQKHFEKKKDIRRGIGYLKLICFLIPFLLSLKKKMKVPYLSSLLQPFSDDKVKTERELPPFIYGRDFKCQNFHYKENQYFHVHGGIEFDISTPSIENALEDFQKNLEKIRDCAANTFIEDSGYKEYYSIPVMEFHGKSYYVIYFELETFYQQLYKTQWWGAINEIVNNLRLKRLPLTDAQLHEQFKKKLGFKRAMKCKSIPFGMKSAVERGLSAVFHTFSRKTSSSTINVSDEAGYTIFHHAALHNRVSIICQLCNANFKVNQRRFVTFSQGPTPLHLAAQACSLETTVCLLCSKADYTLSEKRGWMPIHFAAFYDNVCIIIALCRKDPSLLEAEATAENQCTPLLLAATSGALDTIQYLFSIGANWRKTDIKGNNIIHLSVLTFHTEVLKYIIKLNIPELPVWKTLVEMLQCESYKRRMMAVMSLEVICLANDQYWRCILDAGTIPALINLLKSSKIKLQCKTVGLLSNISTHKSAVHALVEAGGIPSLINLLVCDEPEVHSRCAVILYDIAQCENKDVIAKYNGIPSLINLLNLNIENVLVNVMNCIRVLCIGNENNQRAVREHKGLPYLIRFLSSDSDVLKAVSSAAIAEVGRDNKEIQDAIAMEGAIPPLVALFKGKQISVQMKGAMAVESLASHNALIQKAFLEKSLTKYLLKLLKAFQIDVKEQGAVALWALAGQTLKQQKYMAEQIGYSFIINMLLSPSAKMQYVGGEAVIALSKDSRMHQNQICEGNGIAPLVRLLRISTIAEGTLLSVIRAVGSICIGVAHTSNPVSQQLVVDENAFPVLIQLLRNHPSPNIKVEVAFSLACIVLGNDVLQKDLHENEGFEYADVLYLLHSTEKDICLRAGYALTLFAFNNRFQQYLILESGIMTISIFERFLESTVETEKAMAAFQIVVLAKVIRDMDHITLSARGVTILVDSLYSVQTSTIVLTGNLIASLAHSRAGIPEAFTTLGTIQRLCYHLYSGIEEVRAACSSALGYLTYNANAFRILLKECRNKPNQFIRIKNNISRDASINPAFLKEFQMQQTLVGLPSLSLEKNGGPSIIPIFKRGKEHRRKLKPKIQPKDSLTLLPPVTNFMGLFKATKKTKDSHNIFSFSSTITSDITNVSRPRIVCLNQLGKHVQKANPEPAEG

SEQ ID NO: 8388 - protein, 359 aa, Artificial Sequence
  Description of Artificial Sequence: Synthetic coding sequence
MKGAMAVESLASHNALIQKAFLEKSLTKYLLKLLKAFQIDVKEQGAVALWALAGQTLKQQKYMAEQIGYSFIINMLLSPSAKMQYVGGEAVIALSKDSRMHQNQICEGNGIAPLVRLLRISTIAEGTLLSVIRAVGSICIGVAHTSNPVSQQLVVDENAFPVLIQLLRNHPSPNIKVEVAFSLACIVLGNDVLQKDLHENEGFEYADVLYLLHSTEKDICLRAGYALTLFAFNNRFQQYLILESGIMTISIFERFLESTVETEKAMAAFQIVVLAKVIRDMDHITLSARGVTILVDSLYSVQTSTIVLTGNLIASLAHSRAGIPEAFTTLGTIQRLCYHLYSGIEESGEEWRTIHNSYL

SEQ ID NO: 8389 - protein, 1363 aa, Artificial Sequence
  Description of Artificial Sequence: Synthetic coding sequence
MSQMNNVGFSTAILLTPVDPTALLDYREVHQMIRELAIGIYCLNQIPSISLEANYDQSSSCQLPPAYYDTRIGQILINIDYMLKALWHGIYMPKEKRARFSELWRAIMDIDPDGKPQTNKDIFSEFSSAGLTDITKDPDFNEIYDEDVNEDPTYDPNSPEETAVFMKYAENIMLKLTFSTTQIQQYENVFIFETGYWLTNAIKYNQDYLDICTYQRLQQRLYLQKKIIQKHFEKKKDIRRGIGYLKLICFLIPFLLSLKKKMKVPYLSSLLQPFSDDKVKTERELPPFIYGRDFKCQNFHYKENQYFHVHGGIEFDISTPSIENALEDFQKNLEKIRDCAANTFIEDSGYKEYYSIPVMEFHGKSYYVIYFELETFYQQLYKTQWWGAINEIVNNLRLKRLPLTDAQLHEQFKKKLGFKRAMKCKSIPFGMKSAVERGLSAVFHTFSRKTSSSTINVSDEAGYTIFHHAALHNRVSIICQLCNANFKVNQRRFVTFSQGPTPLHLAAQACSLETTVCLLCSKADYTLSEKRGWMPIHFAAFYDNVCIIIALCRKDPSLLEAEATAENQCTPLLLAATSGALDTIQYLFSIGANWRKTDIKGNNIIHLSVLTFHTEVLKYIIKLNIPELPVWKTLVEMLQCESYKRRMMAVMSLEVICLANDQYWRCILDAGTIPALINLLKSSKIKLQCKTVGLLSNISTHKSAVHALVEAGGIPSLINLLVCDEPEVHSRCAVILYDIAQCENKDVIAKYNGIPSLINLLNLNIENVLVNVMNCIRVLCIGNENNQRAVREHKGLPYLIRFLSSDSDVLKAVSSAAIAEVGRDNKEIQDAIAMEGAIPPLVALFKGKQISVQMKGAMAVESLASHNALIQKAFLEKSLTKYLLKLLKAFQIDVKEQGAVALWALAGQTLKQQKYMAEQIGYSFIINMLLSPSAKMQYVGGEAVIALSKDSRMHQNQICEGNGIAPLVRLLRISTIAEGTLLSVIRAVGSICIGVAHTSNPVSQQLVVDENAFPVLIQLLRNHPSPNIKVEVAFSLACIVLGNDVLQKDLHENEGFEYADVLYLLHSTEKDICLRAGYALTLFAFNNRFQQYLILESGIMTISIFERFLESTVETEKAMAAFQIVVLAKVIRDMDHITLSARGVTILVDSLYSVQTSTIVLTGNLIASLAHSRAGIPEAFTTLGTIQRLCYHLYSGIEEVRAACSSALGYLTYNANAFRILLKECRNKPNQFIRIKNNISRDASINPAFLKEFQMQQTLVGLPSLSLEKNGGPSIIPIFKRGKEHRRKLKPKIQPKDSLTLLPPVTNFMGLFKATKKTKDSHNIFSFSSTITSDITNVSRPRIVCLNQLGKHVQKANPEPAEG

SEQ ID NO: 8390 - protein, 1080 aa, Artificial Sequence
  Description of Artificial Sequence: Synthetic coding sequence
MLRLPKKGLPRFEQVQDEDTYLENLAIQRNASAFFEKYDRSEIQELLTTALVSWLSAKEDVRSQVDLPCGIMSQMNNVGFSTAILLTPVDPTALLDYREVHQMIRELAIGIYCLNQIPSISLEANYDQSSSCQLPPAYYDTRIGQILINIDYMLKALWHGIYMPKEKRARFSELWRAIMDIDPDGKPQTNKDIFSEFSSAGLTDITKDPDFNEIYDEDVNEDPTYDPNSPEETAVFMKYAENIMLKLTFSTTQIQQYENVFIFETGYWLTNAIKYNQDYLDICTYQRLQQRLYLQKKIIQKHFEKKKDIRRGIGYLKLICFLIPFLLSLKKKMKVPYLSSLLQPFSDDKVKTERELPPFIYGRDFKCQNFHYKENQYFHVHGGIEFDISTPSIENALEDFQKNLEKIRDCAANTFIEDSGYKEYYSIPVMEFHGKSYYVIYFELETFYQQLYKTQWWGAINEIVNNLRLKRLPLTDAQLHEQFKKKLGFKRAMKCKSIPFGMKSAVERGLSAVFHTFSRKTSSSTINVSDEAGYTIFHHAALHNRVSIICQLCNANFKVNQRRFVTFSQGPTPLHLAAQACSLETTVCLLCSKADYTLSEKRGWMPIHFAAFYDNVCIIIALCRKDPSLLEAEATAENQCTPLLLAATSGALDTIQYLFSIGANWRKTDIKGNNIIHLSVLTFHTEVLKYIIKLNIPELPVWKTLVEMLQCESYKRRMMAVMSLEVICLANDQYWRCILDAGTIPALINLLKSSKIKLQCKTVGLLSNISTHKSAVHALVEAGGIPSLINLLVCDEPEVHSRCAVILYDIAQCENKDVIAKYNGIPSLINLLNLNIENVLVNVMNCIRVLCIGNENNQRAVREHKGLPYLIRFLSSDSDVLKAVSSAAIAEVGRDNKEIQDAIAMEGAIPPLVALFKGKQISVQMKGAMAVESLASHNALIQKAFLEKSLTKYLLKLLKAFQIDVKEQGAVALWALAGQTLKQQKYMAEQIGYSFIINMLLSPSAKMQYVGGEAVIALSKDSRMHQNQICEGNGIAPLVRLLRISTIAEGTLLSVIRAVGSICIGYLLKSRLCINTFCLQ

SEQ ID NO: 8391 - protein, 1434 aa, Artificial Sequence; identical to SEQ ID NO: 8387
  Description of Artificial Sequence: Synthetic coding sequence

SEQ ID NO: 8392 - protein, 1170 aa, Artificial Sequence
  Description of Artificial Sequence: Synthetic coding sequence
MAEEEVAKLEKHLMLLRQEYVKLQKKLAETEKRCALLAAQANKESSSESFISRLLAIVADLYEQEQYSDLKIKVGDRHISAHKFVLAARSDSWSLANLSSTKELDLSDANPEVTMTMLRWIYTDELEFREDDVFLTELMKLANRFQLQLLRERCEKGVMSLVNVRNCIRFYQTAEELNASTLMNYCAEIIASHWDDLRKEDFSSMSAQLLYKMIKSKTEYPLHKAIKVEREDVVFLYLIEMDSQLPGKLNEADHNGDLALDLALSRRLESIATTLVSHKADVDMVDKSGWSLLHKGIQRGDLFAATFLIKNGAFVNAATLGAQETPLHLVALYSSKKHSADVMSEMAQIAEALLQAGANPNMQDSKGRTPLHVSIMAGNEYVFSQLLQCKQLDLELKDHEGSTALWLAVQHITVSSDQSVNPFEDVPVVNGTSFDENSFAARLIQRGSHTDAPDTATGNCLLQRAAGAGNEAAALFLATNGAHVNHRNKWGETPLHTACRHGLANLTAELLQQGANPNLQTEEALPLPKEAASLTSLADSVHLQTPLHMAIAYNHPDVVSVILEQKANALHATNNLQIIPDFSLKDSRDQTVLGLALWTGMHTIAAQLLGSGAAINDTMSDGQTLLHMAIQRQDSKSALFLLEHQADINVSRTQDGETALQLAIRNQLPLVVDAICTRGADMSVPDEKGNPPLWLALANNLEDIASTLVRHGCDATCWGPGPGGCLQTLLHRAIDENNEPTACFLIRSGCDVNSPRQPGANGEGEEEARDGQTPLHLAASWGLEETVQCLLEFGANVNAQDAEGRTPIHVAISSQHGVIIQLLVSHPDIHLNVRDRQGLTPFACAMTFKNNKSAEAILKRESGAAEQVDNKGRNFLHVAVQNSDIESVLFLISVHANVNSRVQDASKLTPLHLAVQAGSEIIVRNLLLAGAKVNELTKHRQTALHLAAQQDLPTICSVLLENGVDFAAVDENGNNALHLAVMHGRLNNIRVLLTECTVDAEAFNLRGQSPLHILGQYGKENAAAIFDLFLECMPGYPLDKPDADGSTVLLLAYMKGNANLCRAIVRSGARLGVNNNQGVNIFNYQVATKQLLFRLLDMLSKEPPWCDGSYCYECTARFGVTTRKHHCRHCGRLLCHKCSTKEIPIIKFDLNKPVRVCNICFDVLTLGGVS

SEQ ID NO: 8393 - protein, 487 aa, Artificial Sequence
  Description of Artificial Sequence: Synthetic coding sequence
MAEEEVAKLEKHLMLLRQEYVKLQKKLAETEKRCALLAAQANKESSSESFISRLLAIVADLYEQEQYSDLKIKVGDRHISAHKFVLAARSDSWSLANLSSTKELDLSDANPEVTMTMLRWIYTDELEFREDDVFLTELMKLANRFQLQLLRERCEKGVMSLVNVRNCIRFYQTAEELNASTLMNYCAEIIASHWDDLRKEDFSSMSAQLLYKMIKSKTEYPLHKAIKVEREDVVFLYLIEMDSQLPGKLNEADHNGDLALDLALSRRLESIATTLVSHKADVDMVDKSGWSLLHKGIQRGDLFAATFLIKNGAFVNAATLGAQETPLHLVALYSSKKHSADVMSEMAQIAEALLQAGANPNMQDSKGRTPLHVSIMAGNEYVFSQLLQCKQLDLELKDHEGSTALWLAVQHITVSSDQSVNPFEDVPVVNGTSFDENSFAARLIQRGSHTDAPDTATGKARASRRGDAGVCRRQEMACKCLHPKFRN

SEQ ID NO: 8394 - protein, 1111 aa, Artificial Sequence
  Description of Artificial Sequence: Synthetic coding sequence
MSSCRRSWRRQRSAALSWLRRQTRRAAASPSSAVCWPSWQTSTSRSSTDANPEVTMTMLRWIYTDELEFREDDVFLTELMKLANRFQLQLLRERCEKGVMSLVNVRNCIRFYQTAEELNASTLMNYCAEIIASHWDDLRKEDFSSMSAQLLYKMIKSKTEYPLHKAIKVEREDVVFLYLIEMDSQLPGKLNEADHNGDLALDLALSRRLESIATTLVSHKADVDMVDKSGWSLLHKGIQRGDLFAATFLIKNGAFVNAATLGAQETPLHLVALYSSKKHSADVMSEMAQIAEALLQAGANPNMQDSKGRTPLHVSIMAGNEYVFSQLLQCKQLDLELKDHEGSTALWLAVQHITVSSDQSVNPFEDVPVVNGTSFDENSFAARLIQRGSHTDAPDTATGNCLLQRAAGAGNEAAALFLATNGAHVNHRNKWGETPLHTACRHGLANLTAELLQQGANPNLQTEEALPLPKEAASLTSLADSVHLQTPLHMAIAYNHPDVVSVILEQKANALHATNNLQIIPDFSLKDSRDQTVLGLALWTGMHTIAAQLLGSGAAINDTMSDGQTLLHMAIQRQDSKSALFLLEHQADINVSRTQDGETALQLAIRNQLPLVVDAICTRGADMSVPDEKGNPPLWLALANNLEDIASTLVRHGCDATCWGPGPGGCLQTLLHRAIDENNEPTACFLIRSGCDVNSPRQPGANGEGEEEARDGQTPLHLAASWGLEETVQCLLEFGANVNAQDAEGRTPIHVAISSQHGVIIQLLVSHPDIHLNVRDRQGLTPFACAMTFKNNKSAEAILKRESGAAEQVDNKGRNFLHVAVQNSDIESVLFLISVHANVNSRVQDASKLTPLHLAVQAGSEIIVRNLLLAGAKVNELTKHRQTALHLAAQQDLPTICSVLLENGVDFAAVDENGNNALHLAVMHGRLNNIRVLLTECTVDAEAFNLRGQSPLHILGQYGKENAAAIFDLFLECMPGYPLDKPDADGSTVLLLAYMKGNANLCRAIVRSGARLGVNNNQGVNIFNYQVATKQLLFRLLDMLSKEPPWCDGSYCYECTARFGVTTRKHHCRHCGRLLCHKCSTKEIPIIKFDLNKPVRVCNICFDVLTLGGVS

SEQ ID NO: 8395 - protein, 1170 aa, Artificial Sequence; identical to SEQ ID NO: 8392
  Description of Artificial Sequence: Synthetic coding sequence

SEQ ID NO: 8396 - protein, 823 aa, Artificial Sequence
  Description of Artificial Sequence: Synthetic coding sequence
MKLFGFGSRRGQTAQGSIDHVYTGSGYRIRDSELQKIHRAAVKGDAAEVERCLARRSGDLDALDKQHRTALHLACTSGHVQVVTLLVNRKCQIDVCDKENRTPLIQAVHCQEEACAVILLEHGANPNLKDIYGNTALHYAVYSESTSLAEKLLSHGAHIEALDKDNNTPLLFAIICKKEKMVEFLLKKKASSHAVDRLRRSALMLAVYYDSPGIVNILLKQNIDVFAQDMCGRDAEDYAISHHLTKIQQQILEHKKKILKKEKSDVGSSDESAVSIFHELRVDSLPASDDKDLNVATKQCVPEKVSEPLPGSSHEKGNRIVNGQGEGPPAKHPSLKPSTEVEDPAVKGAVQRKNVQTLRAEQALPVASEEEQERHERSEKKQPQVKEGNNTNKSEKIQLSENICDSTSSAAAGRLTQQRKIGKTYPQQFPKKLKEEHDRCTLKQENEEKTNVNMLYKKNREELERKEKQYKKEVEAKQLEPTVQSLEMKSKTARNTPNWDFHNHEEMKGLMDENCILKADIAILRQEICTMKNDNLEKENKYLKDIKIVKETNAALEKYIKLNEEMITETAFRYQQELNDLKAENTRLNAELLKEKESKKRLEADIESYQSRLAAAISKHSESVKTERNLKLALERTRDVSVQVEMSSAISKVKAENEFLTEQLSETQIKFNALKDKFRKTRDSLRKKSLALETVQNDLSQTQQQTQEMKEMYQNAEAKVNNSTGKWNCVEERICHLQRENAWLVQQLDDVHQKEDHKEIVTNIQRGFIESGKKDLVLEEKSKKLMNECDHLKESLFQYEREKTEGVVSIKEDKYFQTSRKTI

SEQ ID NO: 8397 - protein, 452 aa, Artificial Sequence
  Description of Artificial Sequence: Synthetic coding sequence
MKVQPSVTCVASWGGIVHLEAFGDPVIVLRGAWAVPRVDCLIDTLRTPNASCMRKGTHLLVPCLEEEELALHRRRLDMSEALPCPGKETPTPGCRLGALYWACVHNDPTQLQAILDGGVSPEEATQVDSNGRTGLMVACYHGFQSVVALLSHCPFLDVNQQDKGGDTALMLAAQAGHVPLVSLLLNYYVGLDLERRDQRGLTALMKAAMRNRCADLTAVDPVRGKTALEWAVLTDSFDTVWRIRQLLRRPQVEQLSQHYKPEWPALSGLVAQAQAQAQVAPSLLERLQATLSLPFAPSPQEGGVLDHLVTATTSLASPFVTTACHTLCPDHPPSLGTRSKSVPELLGTAPPPPLVPQSPPGSPQRSPWVFVPYQSPQGILSKCLQWLQPRDSTSPRPQVPKILLSKASSSSHQCQPKPSPSGHQSLALPLWRYQELRIEKRKQEEEARMAQK

SEQ ID NO: 8398 - protein, 228 aa, Artificial Sequence
  Description of Artificial Sequence: Synthetic coding sequence
MSYVFVNDSSQTNVPLLQACIDGDFNYSKRLLESGFDPNIRDSRGRTGLHLAAARGNVDICQLLHKFGADLLATDYQGNTALHLCGHVDTIQFLVSNGLKIDICNHQGATPLVLAKRRGVNKDVIRLLESLEEQEVKGFNRGTHSKLETMQTAESESAMESHSLLNPNLQQGEGVLSSFRTTWQEFVEDLGFWRVLLLIFVIALLSLGIAYYVSGVLPFVENQPELVH

SEQ ID NO: 8399 - protein, 195 aa, Artificial Sequence
  Description of Artificial Sequence: Synthetic coding sequence
MSYVFVNDSSQTNVPLLQACIDGDFNYSKRLLESGFDPNIRDSRGRTGLHLAAARGNVDICQLLHKFGADLLATDYQGNTALHLCGHVDTIQFLVSNGLKIDICNHQGATPLVLAKRRGVNKDVIRLLESLEEQEVKGFNRGTHSKLETMQTAESESAMESHSLLNPNLQQGEGVLSSFRTTWQEFVEDLGFWRV

SEQ ID NO: 8400 - protein, 228 aa, Artificial Sequence; identical to SEQ ID NO: 8398
  Description of Artificial Sequence: Synthetic coding sequence

SEQ ID NO: 8401 - protein, 228 aa, Artificial Sequence; identical to SEQ ID NO: 8398
  Description of Artificial Sequence: Synthetic coding sequence

SEQ ID NO: 8402 - protein, 232 aa, Artificial Sequence
  Description of Artificial Sequence: Synthetic coding sequence
MSYVFVNDSSQTNVPLLQACIDGDFNYSKRLLESGFDPNIRDSRGRTGLHLAAARGNVDICQLLHKFGADLLATDYQGNTALHLCGHVDTIQFLVSNGLKIDICNHQGATPLVLAKRRGVNKDVIRLLESLEEQEVKGFNRGTHSKLETMQTAESESAMESHSLLNPNLQQGEGVLSSFRTTWQEFVEDLGFWRVLLLIFVIALLSLGIAYYRRTLRLGSFARQDRSRIQAI

SEQ ID NO: 8403 - protein, 82 aa, Artificial Sequence
  Description of Artificial Sequence: Synthetic coding sequence
MSYVFVNDSSQTNVPLLQACIDGDFNYSKRLLESGFDPNIRDSRGRTGLHLAAARGNVDICQLLHKFGADLLATDYQGNTAL

SEQ ID NO: 8404 - protein, 86 aa, Artificial Sequence
  Description of Artificial Sequence: Synthetic coding sequence
MSYVFVNDSSQTNVPLLQACIDGDFNYSKRLLESGFDPNIRDSRGRTGLHLAAARGNVDICQLLHKFGADLLATDYQGNTALHLCG

SEQ ID NO: 8405 - protein, 103 aa, Artificial Sequence
  Description of Artificial Sequence: Synthetic coding sequence
MSYVFVNDSSQTNVPLLQACIDGDFNYSKRLLESGFDPNIRDSRGRTGLHLAAARGNVDICQLLHKFGADLLATDYQGNTALHLCGHVDTIQFLVSNGLKIDI

SEQ ID NO: 8406 - protein, 357 aa, Artificial Sequence
  Description of Artificial Sequence: Synthetic coding sequence
MGNRHSQSYTLSEGSQQLPKGDSQPSTVVQPLSHPSRNGEPEAPQPAKASSPQGFDVDRDAKKLNKACKGMGTNEAAIIEILSGRTSDERQQIKQKYKATYGKELEEVLKSELSGNFEKTALALLDRPSEYAARQLQKAMKGLGTDESVLIEVLCTRTNKEIIAIKEAYQRLFDRSLESDVKGDTSGNLKKILVSLLQANRNEGDDVDKDLAGQDAKDLYDAGEGRWGTDELAFNEVLAKRSYKQLRATFQAYQILIGKDIEEAIEEETSGDLQKAYLTLVRCAQDCEDYFAERLYKSMKGAGTDEETLIRIVVTRAEVDLQGIKAKFQEKYQKSLSDMVRSDTSGDFRKLLVALLH

SEQ ID NO: 8407 - protein, 316 aa, Artificial Sequence
  Description of Artificial Sequence: Synthetic coding sequence
MGNRHAKASSPQGFDVDRDAKKLNKACKGMGTNEAAIIEILSGRTSDERQQIKQKYKATYGKELEEVLKSELSGNFEKTALALLDRPSEYAARQLQKAMKGLGTDESVLIEVLCTRTNKEIIAIKEAYQRLFDRSLESDVKGDTSGNLKKILVSLLQANRNEGDDVDKDLAGQDAKDLYDAGEGRWGTDELAFNEVLAKRSYKQLRATFQAYQILIGKDIEEAIEEETSGDLQKAYLTLVRCAQDCEDYFAERLYKSMKGAGTDEETLIRIVVTRAEVDLQGIKAKFQEKYQKSLSDMVRSDTSGDFRKLLVALLH

SEQ ID NO: 8408 - protein, 981 aa, Artificial Sequence
  Description of Artificial Sequence: Synthetic coding sequence
MVHHSGSIQSFKQQKGMNISKSEITKETSLKPSRRSLPCLAQSYAYSKSLSQSTSLFQSTESESQAPTSITLISTDKAEQVNTEENKNDSVLRCSFADLSDFCLALGKDKDYTDESEHATYDRSRLINDFVIKDKSEFKTKLSKNDMNYIASSGPLFKDGKKRIDYILVYRKTNIQYDKRNTFEKNLRAEGLMLEKEPAIASPDIMFIKIHIPWDTLCKYAERLNIRMPFRKKCYYTDGRSKSMGRMQTYFRRIKNWMAQNPMVLDKSAFPDLEESDCYTGPFSRARIHHFIINNKDTFFSNATRSRIVYHMLERTKYENGISKVGIRKLINNGSYIAAFPPHEGAYKSSQPIKTHGPQNNRHLLYERWARWGMWYKHQPLDLIRLYFGEKIGLYFAWLGWYTGMLIPAAIVGLCVFFYGLFTMNNSQVSQEICKATEVFMCPLCDKNCSLQRLNDSCIYAKVTYLFDNGGTVFFAIFMAIWATVFLEFWKRRRSILTYTWDLIEWEEEEETLRPQFEAKYYKMEIVNPITGKPEPHQPSSDKVTRLLVSVSGIFFMISLVITAVFGVVVYRLVVMEQFASFKWNFIKQYWQFATSAAAVCINFIIIMLLNLAYEKIAYLLTNLEYPRTESEWENSFALKMFLFQFVNLNSSIFYIAFFLGRFVGHPGKYNKLFDRWRLEECHPSGCLIDLCLQMGVIMFLKQIWNNFMELGYPLIQNWWSRHKIKRGIHDASIPQWENDWNLQPMNLHGLMDEYLEMVLQFGFTTIFVAAFPLAPLLALLNNIIEIRLDAYKFVTQWRRPLPARATDIGIWLGILEGIGILAVITNAFVIAITSDYIPRFVYEYKYGPCANHVEPSENCLKGYVNNSLSFFDLSELGMGKSGYCRYRDYRGPPWSSKPYEFTLQYWHILAARLAFIIVFEHLVFGIKSFIAYLIPDVPKGLHDRIRREKYLVQEMMYEAELEHLQQQRRKSGQPVHHEWP

SEQ ID NO: 8409 - protein, 965 aa, Artificial Sequence
  Description of Artificial Sequence: Synthetic coding sequence
MNISKSEITKETSLKPSRRSLPCLAQSYAYSKSLSQSTSLFQSTESESQAPTSITLISTDKAEQVNTEENKNDSVLRCSFADLSDFCLALGKDKDYTDESEHATYDRSRLINDFVIKDKSEFKTKLSKNDMNYIASSGPLFKDGKKRIDYILVYRKTNIQYDKRNTFEKNLRAEGLMLEKEPAIASPDIMFIKIHIPWDTLCKYAERLNIRMPFRKKCYYTDGRSKSMGRMQTYFRRIKNWMAQNPMVLDKSAFPDLEESDCYTGPFSRARIHHFIINNKDTFFSNATRSRIVYHMLERTKYENGISKVGIRKLINNGSYIAAFPPHEGAYKSSQPIKTHGPQNNRHLLYERWARWGMWYKHQPLDLIRLYFGEKIGLYFAWLGWYTGMLIPAAIVGLCVFFYGLFTMNNSQVSQEICKATEVFMCPLCDKNCSLQRLNDSCIYAKVTYLFDNGGTVFFAIFMAIWATVFLEFWKRRRSILTYTWDLIEWEEEEETLRPQFEAKYYKMEIVNPITGKPEPHQPSSDKVTRLLVSVSGIFFMISLVITAVFGVVVYRLVVMEQFASFKWNFIKQYWQFATSAAAVCINFIIIMLLNLAYEKIAYLLTNLEYPRTESEWENSFALKMFLFQFVNLNSSIFYIAFFLGRFVGHPGKYNKLFDRWRLEECHPSGCLIDLCLQMGVIMFLKQIWNNFMELGYPLIQNWWSRHKIKRGIHDASIPQWENDWNLQPMNLHGLMDEYLEMVLQFGFTTIFVAAFPLAPLLALLNNIIEIRLDAYKFVTQWRRPLPARATDIGIWLGILEGIGILAVITNAFVIAITSDYIPRFVYEYKYGPCANHVEPSENCLKGYVNNSLSFFDLSELGMGKSGYCRYRDYRGPPWSSKPYEFTLQYWHILAARLAFIIVFEHLVFGIKSFIAYLIPDVPKGLHDRIRREKYLVQEMMYEAELEHLQQQRRKSGQPVHHEWP

SEQ ID NO: 8410 - protein, 835 aa, Artificial Sequence
  Description of Artificial Sequence: Synthetic coding sequence
MNYIASSGPLFKDGKKRIDYILVYRKTNIQYDKRNTFEKNLRAEGLMLEKEPAIASPDIMFIKIHIPWDTLCKYAERLNIRMPFRKKCYYTDGRSKSMGRMQTYFRRIKNWMAQNPMVLDKSAFPDLEESDCYTGPFSRARIHHFIINNKDTFFSNATRSRIVYHMLERTKYENGISKVGIRKLINNGSYIAAFPPHEGAYKSSQPIKTHGPQNNRHLLYERWARWGMWYKHQPLDLIRLYFGEKIGLYFAWLGWYTGMLIPAAIVGLCVFFYGLFTMNNSQVSQEICKATEVFMCPLCDKNCSLQRLNDSCIYAKVTYLFDNGGTVFFAIFMAIWATVFLEFWKRRRSILTYTWDLIEWEEEEETLRPQFEAKYYKMEIVNPITGKPEPHQPSSDKVTRLLVSVSGIFFMISLVITAVFGVVVYRLVVMEQFASFKWNFIKQYWQFATSAAAVCINFIIIMLLNLAYEKIAYLLTNLEYPRTESEWENSFALKMFLFQFVNLNSSIFYIAFFLGRFVGHPGKYNKLFDRWRLEECHPSGCLIDLCLQMGVIMFLKQIWNNFMELGYPLIQNWWSRHKIKRGIHDASIPQWENDWNLQPMNLHGLMDEYLEMVLQFGFTTIFVAAFPLAPLLALLNNIIEIRLDAYKFVTQWRRPLPARATDIGIWLGILEGIGILAVITNAFVIAITSDYIPRFVYEYKYGPCANHVEPSENCLKGYVNNSLSFFDLSELGMGKSGYCRYRDYRGPPWSSKPYEFTLQYWHILAARLAFIIVFEHLVFGIKSFIAYLIPDVPKGLHDRIRREKYLVQEMMYEAELEHLQQQRRKSGQPVHHEWP

SEQ ID NO: 8411 - protein, 965 aa, Artificial Sequence; identical to SEQ ID NO: 8409
  Description of Artificial Sequence: Synthetic coding sequence

SEQ ID NO: 8412 - protein, 883 aa, Artificial Sequence
  Description of Artificial Sequence: Synthetic coding sequence
MRPGPNKPYPSHSNIFAYHSSALGKDKDYTDESEHATYDRSRLINDFVIKDKSEFKTKLSKNDMNYIASSGPLFKDGKKRIDYILVYRKTNIQYDKRNTFEKNLRAEGLMLEKEPAIASPDIMFIKIHIPWDTLCKYAERLNIRMPFRMQTYFRRIKNWMAQNPMVLDKSAFPDLEESDCYTGPFSRARIHHFIINNKDTFFSNATRSRIVYHMLERTKYENGISKVGIRKLINNGSYIAAFPPHEGAYKSSQPIKTHGPQNNRHLLYERWARWGMWYKHQPLDLIRLYFGEKIGLYFAWLGWYTGMLIPAAIVGLCVFFYGLFTMNNSQVSQEICKATEVFMCPLCDKNCSLQRLNDSCIYAKVTYLFDNGGTVFFAIFMAIWATVFLEFWKRRRSILTYTWDLIEWEEEEETLRPQFEAKYYKMEIVNPITGKPEPHQPSSDKVTRLLVSVSGIFFMISLVITAVFGVVVYRLVVMEQFASFKWNFIKQYWQFATSAAAVCINFIIIMLLNLAYEKIAYLLTNLEYPRTESEWENSFALKMFLFQFVNLNSSIFYIAFFLGRFVGHPGKYNKLFDRWRLEECHPSGCLIDLCLQMGVIMFLKQIWNNFMELGYPLIQNWWSRHKIKRGIHDASIPQWENDWNLQPMNLHGLMDEYLEMVLQFGFTTIFVAAFPLAPLLALLNNIIEIRLDAYKFVTQWRRPLPARATDIGIWLGILEGIGILAVITNAFVIAITSDYIPRFVYEYKYGPCANHVEPSENCLKGYVNNSLSFFDLSELGMGKSGYCRYRDYRGPPWSSKPYEFTLQYWHILAARLAFIIVFEHLVFGIKSFIAYLIPDVPKGLHDRIRREKYLVQEMMYEAELEHLQQQRRKSGQPVHHEWP

SEQ ID NO: 8413 - protein, 475 aa, Artificial Sequence
  Description of Artificial Sequence: Synthetic coding sequence
MAVWATVFLEFWKRRRAVIAYDWDLIDWEEEEICVVIAAVFGIVIYRVVTVSTFAAFKWALIRNNSQVATTGTAVCINFCIIMLLNVLYEKVALLLTNLEQPRTESEWENSFTLKMFLFQFVNLNSSTFYIAFFLGRFTGHPGAYLRLINRWRLEECHPSGCLIDLCMQMGIIMVLKQTWNNFMELGYPLIQNWWTRRKVRQEHGPERKISFPQWEKDYNLQPMNAYGLFDEYLEMILQFGFTTIFVAAFPLAPLLALLNNIIEIRLDAYKFVTQWRRPLASRAKDIGIWYGILEGIGILSVITNAFVIAITSDFIPRLVYAYKYGPCAGQGEAGQKCMVGYVNASLSVFRISDFENRSEPESDGSEFSGTPLKYCRYRDYRDPPHSLVPYGYTLQFWHVLAARLAFIIVFEHLVFCIKHLISYLIPDLPKDLRDRMRREKYLIQEMMYEAELERLQKERKERKKNGKAHHNEWP

SEQ ID NO: 8414 - protein, 955 aa, Artificial Sequence
  Description of Artificial Sequence: Synthetic coding sequence
MEASSSGITNGKTKVFHPEGGVDLQGYQLDMQILPDGPKSDVDFSEILNAIQEMAKDVNILFDELEAVSSPCKDDDSLLHPGNLTSTSDDASRLEAGGETVPERNKSNGLYFRDGKCRIDYILVYRKSNPQTEKREVFERNIRAEGLQMEKESSLINSDIIFVKLHAPWEVLGRYAEQMNVRMPFRRKIYYLPRRYKFMSRIDKQISRFRRWLPKKPMRLDKETLPDLEENDCYTAPFSQQRIHHFIIHNKETFFNNATRSRIVHHILQRIKYEEGKNKIGLNRLLTNGSYEAAFPLHEGSYRSKNSIRTHGAENHRHLLYECWASWGVWYKYQPLDLVRRYFGEKIGLYFAWLGWYTGMLFPAAFIGLFVFLYGVTTLDHSQVSKEVCQATDIIMCPVCDKYCPFMRLSDSCVYAKVTHLFDNGATVFFAVFMAVWATVFLEFWKRRRAVIAYDWDLIDWEEEEEEIRPQFEAKYSKKERMNPISGKPEPYQAFTDKCSRLIVSASGIFFMICVVIAAVFGIVIYRVVTVSTFAAFKWALIRNNSQVATTGTAVCINFCIIMLLNVLYEKVALLLTNLEQPRTESEWENSFTLKMFLFQFVNLNSSTFYIAFFLGRFTGHPGAYLRLINRWRLEECHPSGCLIDLCMQMGIIMVLKQTWNNFMELGYPLIQNWWTRRKVRQEHGPERKISFPQWEKDYNLQPMNAYGLFDEYLEMILQFGFTTIFVAAFPLAPLLALLNNIIEIRLDAYKFVTQWRRPLASRAKDIGIWYGILEGIGILSVITNAFVIAITSDFIPRLVYAYKYGPCAGQGEAGQKCMVGYVNASLSVFRISDFENRSEPESDGSEFSGTPLKYCRYRDYRDPPHSLVPYGYTLQFWHVLAARLAFIIVFEHLVFCIKHLISYLIPDLPKDLRDRMRREKYLIQEMMYEAELERLQKERKERKKNGKAHHNEWP

SEQ ID NO: 8415 - protein, 920 aa, Artificial Sequence
  Description of Artificial Sequence: Synthetic coding sequence
MEASSSGITNGKTKVFHPVAKDVNILFDELEAVSSPCKDDDSLLHPGNLTSTSDDASRLEAGGETVPERNKSNGLYFRDGKCRIDYILVYRKSNPQTEKREVFERNIRAEGLQMEKESSLINSDIIFVKLHAPWEVLGRYAEQMNVRMPFRRKIYYLPRRYKFMSRIDKQISRFRRWLPKKPMRLDKETLPDLEENDCYTAPFSQQRIHHFIIHNKETFFNNATRSRIVHHILQRIKYEEGKNKIGLNRLLTNGSYEAAFPLHEGSYRSKNSIRTHGAENHRHLLYECWASWGVWYKYQPLDLVRRYFGEKIGLYFAWLGWYTGMLFPAAFIGLFVFLYGVTTLDHSQVSKEVCQATDIIMCPVCDKYCPFMRLSDSCVYAKVTHLFDNGATVFFAVFMAVWATVFLEFWKRRRAVIAYDWDLIDWEEEEEEIRPQFEAKYSKKERMNPISGKPEPYQAFTDKCSRLIVSASGIFFMICVVIAAVFGIVIYRVVTVSTFAAFKWALIRNNSQVATTGTAVCINFCIIMLLNVLYEKVALLLTNLEQPRTESEWENSFTLKMFLFQFVNLNSSTFYIAFFLGRFTGHPGAYLRLINRWRLEECHPSGCLIDLCMQMGIIMVLKQTWNNFMELGYPLIQNWWTRRKVRQEHGPERKISFPQWEKDYNLQPMNAYGLFDEYLEMILQFGFTTIFVAAFPLAPLLALLNNIIEIRLDAYKFVTQWRRPLASRAKDIGIWYGILEGIGILSVITNAFVIAITSDFIPRLVYAYKYGPCAGQGEAGQKCMVGYVNASLSVFRISDFENRSEPESDGSEFSGTPLKYCRYRDYRDPPHSLVPYGYTLQFWHVLAARLAFIIVFEHLVFCIKHLISYLIPDLPKDLRDRMRREKYLIQEMMYEAELERLQKERKERKKNGKAHHNEWP

SEQ ID NO: 8416 - protein, 356 aa, Artificial Sequence
  Description of Artificial Sequence: Synthetic coding sequence
MASLTAYDKDVSSGSYNLSSATTGSYYSCVSQITIGYDVAGPVAIGLTHWKNPYVQGRPTLPSDLPLFVSKDAGIPVYHRSFTRKTDQATPLSCPASLSITPVPSYSSSSQETLSQDTTGLSLSIHGAEKRLQIHQRRSVASRPASRRRLPVVRHSSLPPGRRSIKMEASSSGITNGKTKVFHPEGGVDLQGYQLDMQILPDGPKSDVDFSEILNAIQEMAKDVNILFDELEAVSSPCKDDDSLLHPGNLTSTSDDASRLEAGGETVPERNKSNGLYFRDGKCRIDYILVYRKSNPQTEKREVFERNIRAEGLQMEKESSLINSDIIFVKLHAPWEVLGRYAEQMNVRMPFSSNCN

SEQ ID NO: 8417 - protein, 11 aa, Artificial Sequence
  Description of Artificial Sequence: Synthetic coding sequence
MEASSSGITNG

SEQ ID NO: 8418 - protein, 475 aa, Artificial Sequence; identical to SEQ ID NO: 8413
  Description of Artificial Sequence: Synthetic coding sequence

SEQ ID NO: 8419 - protein, 933 aa, Artificial Sequence
  Description of Artificial Sequence: Synthetic coding sequence
MRMAATAWAGLQGPPLPTLCPAVRTGLYCRDQAHAERWAMTSETSSGSHCARSRMLRRRAQEEDSTVLIDVSPPEAEKRGSYGSTAHASEPGGQQAAACRAGSPAKPRIADFVLVWEEDLKLDRQQDSAARDRTDMHRTWRETFLDNLRAAGLCVDQQDVQDGNTTVHYALLSASWAVLCYYAEDLRLKLPLQELPNQASNWSAGLLAWLGIPNVLLEVVPDVPPEYYSCRFRVNKLPRFLGSDNQDTFFTSTKRHQILFEILAKTPYGHEKKNLLGIHQLLAEGVLSAAFPLHDGPFKTPPEGPQAPRLNQRQVLFQHWARWGKWNKYQPLDHVRRYFGEKVALYFAWLGFYTGWLLPAAVVGTLVFLVGCFLVFSDIPTQELCGSKDSFEMCPLCLDCPFWLLSSACALAQAGRLFDHGGTVFFSLFMALWAVLLLEYWKRKSATLAYRWDCSDYEDTEERPRPQFAASAPMTAPNPITGEDEPYFPERSRARRMLAGSVVIVVMVAVVVMCLVSIILYRAIMAIVVSRSGNTLLAAWASRIASLTGSVVNLVFILILSKIYVSLAHVLTRWEMHRTQTKFEDAFTLKVFIFQFVNFYSSPVYIAFFKGRFVGYPGNYHTLFGVRNEECAAGGCLIELAQELLVIMVGKQVINNMQEVLIPKLKGWWQKFRLRSKKRKAGASAGASQGPWEDDYELVPCEGLFDEYLEMVLQFGFVTIFVAACPLAPLFALLNNWVEIRLDARKFVCEYRRPVAERAQDIGIWFHILAGLTHLAVISNAFLLAFSSDFLPRAYYRWTRAHDLRGFLNFTLARAPSSFAAAHNRTCRYRAFRDDDGHYSQTYWNLLAIRLAFVIVFEHVVFSVGRLLDLLVPDIPESVEIKVKREYYLAKQALAENEVLFGTNGTKDEQPEGSELSSHWTPFTVPKASQLQQ

SEQ ID NO: 8420 - protein, 883 aa, Artificial Sequence
  Description of Artificial Sequence: Synthetic coding sequence
MRMAATAWAGLQGPPLPTLCPAVRTGLYCRDQAHAERWAMTSETSSGSHCARSRMLRRRAQEEDSTVLIDVSPPEAEKRGSYGSTAHASEPGGQQAAACRAGSPAKPRIDFVLVWEEDLKLDRQQDSAARDRTDMHRTWRETFLDNLRAAGLCVDQQDVQDGNTTVHYALLSASWAVLCYYAEDLRLKLPLQELPNQASNWSAGLLAWLGIPNVLLEVVPDVPPEYYSCRFRVNKLPRFLGSDNQDTFFTSTKRHQILFEILAKTPYGHEKKNLLGIHQLLAEGVLSAAFPLHDGPFKTPPEGPQAPRLNQRQVLFQHWARWGKWNKYQPLDHVRRYFGEKVALYFAWLGFYTGWLLPAAVVGTLVFLVGCFLVFSDIPTQELCGSKDSFEMCPLCLDCPFWLLSSACALAQAGRLFDHGGTVFFSLFMALWAVLLLEYWKRKSATLAYRWDCSDYEDTEERPRPQFAASAPMTAPNPITGEDEPYFPERSRARRMLAGSVVIVVMVAVVVMCLVSIILYRAIMAIVVSRSGNTLLAAWASRIASLTGSVVNLVFILILSKIYVSLAHVLTRWEMHRTQTKFEDAFTLKVFIFQFVNFYSSPVYIAFFKGRFVGYPGNYHTLFGVRNEECAAGGCLIELAQELLVIMVGKQVINNMQEVLIPKLKGWWQKFRLRSKKRKAGASAGASQGPWEDDYELVPCEGLFDEYLEMVLQFGFVTIFVAACPLAPLFALLNNWVEIRLDARKFVCEYRRPVAERAQDIGIWFHILAGLTHLAVISNAFLLAFSSDFLPRAYYRWTRAHDLRGFLNFTLARAPSSFAAAHNRTCRYRAFRDDDGHYSQTYWNLLAIRLAFVIVFEVAEAPAGSPIHGMRPRPCALPNSSTW

SEQ ID NO: 8421 - protein, 179 aa, Artificial Sequence
  Description of Artificial Sequence: Synthetic coding sequence
MRMAATAWAGLQGPPLPTLCPAVRTGLYCRDQAHAERWAMTSETSSGSHCARSRMLRRRAQEEDSTVLIDVSPPEAEKRGSYGSTAHASEPGGQQAAACRAGSPAKPRIDFVLVWEEDLKLDRQQDSAARDRTDMHRTWRETFLDNLRAAGLCVDQVRGGCHGQGPRPCIHSVTHDLAA

SEQ ID NO: 8422 - protein, 1232 aa, Artificial Sequence
  Description of Artificial Sequence: Synthetic coding sequence
MAEAASGAGGTSLEGERGKRPPPEGEPAAPASGVLDKLFGKRLLQAGRYLVSHKAWMKTVPTENCDVLMTFPDTTDDHTLLWLLNHIRVGIPELIVQVRHHRHTRAYAFFVTATYESLLRGADELGLRKAVKAEFGGGTRGFSCEEDFIYENVESELRFFTSQERQSIIRFWLQNLRAKQGEALHNVRFLEDQPIIPELAARGIIQQVFPVHEQRILNRLMKSWVQAVCENQPLDDICDYFGVKIAMYFAWLGFYTSAMVYPAVFGSVLYTFTEADQTSRDVSCVVFALFNVIWSTLFLEEWKRRGAELAYKWGTLDSPGEAVEEPRPQFRGVRRISPITRAEEFYYPPWKRLLFQLLVSLPLCLACLVCVFLLMLGCFQLQELVLSVKGLPRLARFLPKVMLALLVSVSAEGYKKLAIWLNDMENYRLESAYEKHLIIKVVLFQFVNSYLSLFYIGFYLKDMERLKEMLATLLITRQFLQNVREVLQPHLYRRLGRGELGLRAVWELARALLGLLSLRRPAPRRLEPQADEGGGGGSGGGGRRCLSGGCGAPEEEEEAALVERRRAGEGGEEGDGPPGGKEEDEDDEEEEDEEEEEDEEEGEEGGLLDCGLRLKKVSFAERGAGRRRPGPSPEALLEEGSPTMVEKGLEPGVFTLAEEDDEAEGAPGSPEREPPAILFRRAGGEGRDQGPDGGPDPEPGSNSDSTRRQRRQNRSSWIDPPEEEHSPQLTQAELESCMKKYEDTFQDYQEMFVQFGYVVLFSSAFPLAALCALVNNLIEIRSDAFKLCTGLQRPFGQRVESIGQWQKVMEAMGVLAIVVNCYLIGQCGQLQRLFPWLSPEAAIVSVVVLEHFALLLKYLIHVAIPDIPGWVAEEMAKLEYQRREAFKRHERQAQHRYQQQQRRRREEEERQRHAEHHARREHDSGGREEARAEGSGLDPATSSEKASAKAKGSTAGGHGPERPKRPGSLLAPNNVMKLKQIIPLQGKFLSSGATSSLAAAGAGATTRPPPAQSPTGSDTRLPAFLSFKFLKSPETRRDSERSHSPPKAFHAGKLFPFGGTRAEPGSNGAGGQARPDGTPSSGSSRVQRSGPVDEALAEELEAPRPEEEGSGTALAPVGAPALRTRRSRSPAPPPPMPLPRPPTPPAGCWQWDGPWGCGGEGAAPRQALAAAECPPCAMAGPPPAPQPLPGDASFYSLPPPPLPPTSDPLETPAPSPSPSPSPQAVCWPSGWH

SEQ ID NO: 8423 - protein, 782 aa, Artificial Sequence
  Description of Artificial Sequence: Synthetic coding sequence
MQGEESLRILVEPEGDSFPLMEISTCETEASEQWDYVLVAQRHTQRDPRQARQQQFLEELRRKGFHIKVIRDQKQVFFGIRADNSVFGLYRTFLLEPEGPAPHAELAAPTTIPVTTSLRIRIVNFVVMNNKTSAGETFEDLMKDGVFEARFPLHKGEGRLKKTWARWRHMFREQPVDEIRNYFGEKVALYFVWLGWYTYMLVPAALTGLLVFLSGFSLFEASQISKEICEAHDILMCPLGDHSRRYQRLSETCTFAKLTHLFDNDGTVVFAIFMALWATVFLEIWKRQRARVVLHWDLYVWDEEQEEMALQLINCPDYKLRPYQHSYLRSTVILVLTLLMICLMIGMAHVLVVYRVLASALFSSSAVPFLEEQVTTAVVVTGALVHYVTIIIMTKINRCVALKLCDFEMPRTFSERESRFTIRFFTLQFFTHFSSLIYIAFILGRINGHPGKSTRLAGLWKLEECHASGCMMDLFVQMAIIMGLKQTLSNCVEYLVPWVTHKCRSLRASESGHLPRDPELRDWRRNYLLNPVNTFSLFDEFMEMMIQYGFTTIFVAAFPLAPLLALFSNLVEIRLDAIKMVWLQRRLVPRKAKDIGTWLQVLETIGVLAVIANGMVIAFTSEFIPRVVYKYRYSPCLKEGNSTVDCLKGYVNHSLSVFHTKDFQDPDGIEGSENVTLCRYRDYRNPPDYNFSEQFWFLLAIRLAFVILFEHVALCIKLIAAWFVPDIPQSVKNKVLEVKYQRLREKMWHGRQRLGGVGAGSRPPMPAHPTPASIFSARSTDV

SEQ ID NO: 8424 - protein, 863 aa, Artificial Sequence
  Description of Artificial Sequence: Synthetic coding sequence
MKKFFDSRREQGGSGLGSGSSGGGGSTSGLGSGYIGRVFGIGRQQVTVDEVLAEGGFAIVFLVRTSNGMKCALKRMFVNNEHDLQVCKREIQIMRDLSGHKNIVGYIDSSINNVSSGDVWEVLILMDFCRGGQVVNLMNQRLQTGFTENEVLQIFCDTCEAVARLHQCKTPIIHRDLKVENILLHDRGHYVLCDFGSATNKFQNPQTEGVNAVEDEIKKYTTLSYRAPEMVNLYSGKIITTKADIWALGCLLYKLCYFTLPFGESQVAICDGNFTIPDNSRYSQDMHCLIRYMLEPDPDKRPDIYQVSYFSFKLLKKECPIPNVQNSPIPAKLPEPVKASEAAAKKTQPKARLTDPIPTTETSIAPRQRPKAGQTQPNPGILPIQPALTPRKRATVQPPPQAAGSSNQPGLLASVPQPKPQAPPSQPLPQTQAKQPQAPPTPQQTPSTQAQGLPAQAQATPQHQQQLFLKQQQQQQQPPPAQQQPAGTFYQQQQAQTQQFQAVHPATQKPAIAQFPVVSQGGSQQQLMQNFYQQQQQQQQQQQQQQLATALHQQQLMTQQAALQQKPTMAAGQQPQPQPAAAPQPAPAQEPAIQAPVRQQPKVQTTPPPAVQGQKVGSLTPPSSPKTQRAGHRRILSDVTHSAVFGVPASKSTQLLQAAAAEASLNKSKSATTTPSGSPRTSQQNVYNPSEGSTWNPFDDDNFSKLTAEELLNKDFAKLGEGKHPEKLGGSAESLIPGFQSTQGDAFATTSFSAGTAEKRKGGQTVDSGLPLLSVSDPFIPLQVPDAPEKLIEGLKSPDTSLLLPDLLPMTDPFGSTSDAVIGKVIISVSSVMHDMCACFKNDKYLVNQSLGNSPATPEAKAI

SEQ ID NO: 8425 - protein, 961 aa, Artificial Sequence
  Description of Artificial Sequence: Synthetic coding sequence
MKKFFDSRREQGGSGLGSGSSGGGGSTSGLGSGYIGRVFGIGRQQVTVDEVLAEGGFAIVFLVRTSNGMKCALKRMFVNNEHDLQVCKREIQIMRDLSGHKNIVGYIDSSINNVSSGDVWEVLILMDFCRGGQVVNLMNQRLQTGFTENEVLQIFCDTCEAVARLHQCKTPIIHRDLKVENILLHDRGHYVLCDFGSATNKFQNPQTEGVNAVEDEIKKYTTLSYRAPEMVNLYSGKIITTKADIWALGCLLYKLCYFTLPFGESQVAICDGNFTIPDNSRYSQDMHCLIRYMLEPDPDKRPDIYQVSYFSFKLLKKECPIPNVQNSPIPAKLPEPVKASEAAAKKTQPKARLTDPIPTTETSIAPRQRPKAGQTQPNPGILPIQPALTPRKRATVQPPPQAAGSSNQPGLLASVPQPKPQAPPSQPLPQTQAKQPQAPPTPQQTPSTQAQGLPAQAQATPQHQQQLFLKQQQQQQQPPPAQQQPAGTFYQQQQAQTQQFQAVHPATQKPAIAQFPVVSQGGSQQQLMQNFYQQQQQQQQQQQQQQLATALHQQQLMTQQAALQQKPTMAAGQQPQPQPAAAPQPAPAQEPAIQAPVRQQPKVQTTPPPAVQGQKVGSLTPPSSPKTQRAGHRRILSDVTHSAVFGVPASKSTQLLQAAAAEASLNKSKSATTTPSGSPRTSQQNVYNPSEGSTWNPFDDDNFSKLTAEELLNKDFAKLGEGKHPEKLGGSAESLIPGFQSTQGDAFATTSFSAGTAEKRKGGQTVDSGLPLLSVSDPFIPLQVPDAPEKLIEGLKSPDTSLLLPDLLPMTDPFGSTSDAVIEKADVAVESLIPGLEPPVPQRLPSQTESVTSNRTDSLTGEDSLLDCSLLSNPTTDLLEEFAPTAISAPVHKAAEDSNLISGFDVPEGSDKVAEDEFDPIPVLITKNPQGGHSRNSSGSSESSLPNLARSLLLVDQLIDL

SEQ ID NO: 8426 - protein, 380 aa, Artificial Sequence
  Description of Artificial Sequence: Synthetic coding sequence
MEEGGDFDNYYGADNQSECEYTDWKSSGALIPAIYMLVFLLGTTGNGLVLWTVFRSSREKRRSADIFIASLAVADLTFVVTLPLWATYTYRDYDWPFGTFFCKLSSYLIFVNMYASVFCLTGLSFDRYLAIVRPVANARLRLRVSGAVATAVLWVLAALLAMPVMVLRTTGDLENTTKVQCYMDYSMVATVSSEWAWEVGLGVSSTTVGFVVPFTIMLTCYFFIAQTIAGHFRKERIEGLRKRRRLLSIIVVLVVTFALCWMPYHLVKTLYMLGSLLHWPCDFDLFLMNIFPYCTCISYVNSCLNPFLYAFFDPRFRQACTSMLCCGQSRCAGTSHSSSGEKSASYSSGHSQGPGPNMGKGGEQMHEKSIPYSQETLVVD

SEQ ID NO: 8427 - protein, 261 aa, Artificial Sequence
  Description of Artificial Sequence: Synthetic coding sequence
MEEGGDFDNYYGADNQSECEYTDWKSSGALIPAIYMLVFLLAMPVMVLRTTGDLENTTKVQCYMDYSMVATVSSEWAWEVGLGVSSTTVGFVVPFTIMLTCYFFIAQTIAGHFRKERIEGLRKRRRLLSIIVVLVVTFALCWMPYHLVKTLYMLGSLLHWPCDFDLFLMNIFPYCTCISYVNSCLNPFLYAFFDPRFRQACTSMLCCGQSRCAGTSHSSSGEKSASYSSGHSQGPGPNMGKGGEQMHEKSIPYSQETLVVD

SEQ ID NO: 8428 - protein, 299 aa, Artificial Sequence
  Description of Artificial Sequence: Synthetic coding sequence
MLVFLLGTTGNGLVLWTVFRSSREKRRSADIFIASLAVADLTFVVTLPLWATYTYRDYDWPFGTFFCKLSSYLIFVNMYAMPVMVLRTTGDLENTTKVQCYMDYSMVATVSSEWAWEVGLGVSSTTVGFVVPFTIMLTCYFFIAQTIAGHFRKERIEGLRKRRRLLSIIVVLVVTFALCWMPYHLVKTLYMLGSLLHWPCDFDLFLMNIFPYCTCISYVNSCLNPFLYAFFDPRFRQACTSMLCCGQSRCAGTSHSSSGEKSASYSSGHSQGPGPNMGKGGEQMHEKSIPYSQETLVVD

SEQ ID NO: 8429 - protein, 206 aa, Artificial Sequence
  Description of Artificial Sequence: Synthetic coding sequence
MLPCAAGARGRGAMVVLRAGKKTFLPPLCRAFACRGCQLAPERGAERRDTAPSGVSRFCPPRKSCHDWIGPPDKYSNLRPVHFYIPENESPLEQKLRKLRQETQEWNQQFWANQNLTFSKEKEEFIHSRLKTKGLGLRTESGQKATLNAEEMADFYKEFLSKNFQKHMYYNRDWYKRNFAITFFMGKVALERIWNKLKQKQKKRSN

SEQ ID NO: 8430 - protein, 373 aa, Artificial Sequence
  Description of Artificial Sequence: Synthetic coding sequence
MGSQVSVESGALHVVIVGGGFGGIAAASQLQALNVPFMLVDMKDSFHHNVAALRASVETGFAKKTFISYSVTFKDNFRQGLVVGIDLKNQMVLLQGGEALPFSHLILATGSTGPFPGKFNEVSSQQAAIQAYEDMVRQVQRSRFIVVVGGGSAGVEMAAEIKTEYPEKEVTLIHSQVALADKELLPSVRQEVKEILLRKGVQLLLSERVSNLEELPLNEYREYIKVQTDKGTEVATNLVILCTGIKINSSAYRKAFESRLASSGALRVNEHLQVEGHSNVYAIGDCADVRTPKMAYLAGLHANIAVANIVNSVKQRPLQAYKPGALTFLLSMGRNDGVGQISGFYVGRLMVRLTKSRDLFVSTSWKTMRQSPP

SEQ ID NO: 8431 - protein, 373 aa, Artificial Sequence; identical to SEQ ID NO: 8430
  Description of Artificial Sequence: Synthetic coding sequence

SEQ ID NO: 8432 - protein, 336 aa, Artificial Sequence
  Description of Artificial Sequence: Synthetic coding sequence
MGSQVSVESGALHVVIVGGGFGGIAAASQLQALNVPFMLVDMKDSFHHNVAALRASVETGFAKKTFISYSVTFKDNFRQGLVVGIDLKNQMVLLQGGEVQRSRFIVVVGGGSAGVEMAAEIKTEYPEKEVTLIHSQVALADKELLPSVRQEVKEILLRKGVQLLLTLLGERVSNLEELPLNEYREYIKVQTDKGTEVATNLVILCTGIKINSSAYRKAFESRLASSGALRVNEHLQVEGHSNVYAIGDCADVRTPKMAYLAGLHANIAVANIVNSVKQRPLQAYKPGALTFLLSMGRNDGVGQISGFYVGRLMVRLTKSRDLFVSTSWKTMRQSPP

SEQ ID NO: 8433 - protein, 301 aa, Artificial Sequence
  Description of Artificial Sequence: Synthetic coding sequence
MVFTQAPAEIMGHLRIRSLLARQCLAEFLGVFVLMLLTQGAVAQAVTSGETKGNFFTMFLAGSLAVTIAIYVGGNVSGAHLNPAFSLAMCIVGRLPWVKLPIYILVQLLSAFCASGATYVLYHDALQNYTGGNLTVTGPKETASIFATYPAPYLSLNNGFLDQVLGTGMLIVGLLAILDRRNKGVPAGLEPVVVGMLILALGLSMGANCGIPLNPARDLGPRLFTYVAGWGPEVFSAGNGWWWVPVVAPLVGATVGTATYQLLVALHHPEGPEPAQDLVSAQHKASELETPASAQMLECKL

SEQ ID NO: 8434 - protein, 264 aa, Artificial Sequence
  Description of Artificial Sequence: Synthetic coding sequence
MVFTQAPAEIMGHLRIRSLLARQCLAEFLGVFVLMLLTQGAVAQAVTSGETKGNFFTMFLAGSLAVTIAIYVGGNVSGAHLNPAFSLAMCIVGRLPWVKLPIYILVQLLSAFCASGATYVLYHDALQNYTGGNLTVTGPKETASIFATYPAPYLSLNNGFLDQVLGTGMLIVGLLAILDRRNKGVPAGLEPVVVGMLILALGLSMGANCGIPLNPARDLGPRLFTYVAGWGPEVFRWETDSPGAGLHSPSSAKGSVPGSTALCL

SEQ ID NO: 8435 - protein, 374 aa, Artificial Sequence
  Description of Artificial Sequence: Synthetic coding sequence
MAKERRRAVLELLQRPGNARCADCGAPDPDWASYTLGVFICLSCSGIHRNIPQVSKVKSVRLDAWEEAQVEFMASHGNDAARARFESKVPSFYYRPTPSDCQLLREQWIRAKYERQEFIYPEKQEPYSAGYREGFLWKRGRDNGQFLSRKFVLTEREGALKYFNRNDAKEPKAVMKIEHLNATFQPAKIGHPHGLQVTYLKDNSTRNIFIYHEDGKEIVDWFNALRAARFHYLQVAFPGAGDADLVPKLSRNYLKEGYMEKTGPKQTEGFRKRWFTMDDRRLMYFKDPLDAFARGEVFIGSKESGYTVLHGFPPSTQGHHWPHGITIVTPDRKFLFACETESDQREWVAAFQKAVDRPMLPQEYAVEAHFKHKP

SEQ ID NO: 8436 - protein, 302 aa, Artificial Sequence
  Description of Artificial Sequence: Synthetic coding sequence
MASHGNDAARARFESKVPSFYYRPTPSDCQLLREQWIRAKYERQEFIYPEKQEPYSAGYREGFLWKRGRDNGQFLSRKFVLTEREGALKYFNRNDAKEPKAVMKIEHLNATFQPAKIGHPHGLQVTYLKDNSTRNIFIYHEDGKEIVDWFNALRAARFHYLQVAFPGAGDADLVPKLSRNYLKEGYMEKTGPKQTEGFRKRWFTMDDRRLMYFKDPLDAFARGEVFIGSKESGYTVLHGFPPSTQGHHWPHGITIVTPDRKFLFACETESDQREWVAAFQKAVDRPMLPQEYAVEAHFKHKP

SEQ ID NO: 8437 - protein, 200 aa, Artificial Sequence
  Description of Artificial Sequence: Synthetic coding sequence
MKIEHLNATFQPAKIGHPHGLQVTYLKDNSTRNIFIYHEDGKEIVDWFNALRAARFHYLQVAFPGAGDADLVPKLSRNYLKEGYMEKTGPKQTEGFRKRWFTMDDRRLMYFKDPLDAFARGEVFIGSKESGYTVLHGFPPSTQGHHWPHGITIVTPDRKFLFACETESDQREWVAAFQKAVDRPMLPQEYAVEAHFKHKP

SEQ ID NO: 8438 - protein, 260 aa, Artificial Sequence
  Description of Artificial Sequence: Synthetic coding sequence
MVLASLELLREQWIRAKYERQEFIYPEKQEPYSAGYREGFLWKRGRDNGQFLSRKFVLTEREGALKYFNRNDAKIGHPHGLQVTYLKDNSTRNIFIYHEDGKEIVDWFNALRAARFHYLQVAFPGAGDADLVPKLSRNYLKEGYMEKTGPKQTEGFRKRWFTMDDRRLMYFKDPLDAFARGEVFIGSKESGYTVLHGFPPSTQGHHWPHGITIVTPDRKFLFACETESDQREWVAAFQKAVDRPMLPQEYAVEAHFKHKP

SEQ ID NO: 8439 - protein, 385 aa, Artificial Sequence
  Description of Artificial Sequence: Synthetic coding sequence
MFQFVFSRVYCINPARRKWKEFEKMLGCAEEGHASLGRDPDWASYTLGVFICLSCSGIHRNIPQVSKVKSVRLDAWEEAQVEFMASHGNDAARARFESKVPSFYYRPTPSDCQLLREQWIRAKYERQEFIYPEKQEPYSAGYREGFLWKRGRDNGQFLSRKFVLTEREGALKYFNRNDAKEPKAVMKIEHLNATFQPAKIGHPHGLQVTYLKDNSTRNIFIYHEDGKEIVDWFNALRAARFHYLQVAFPGAGDADLVPKLSRNYLKEGYMEKTGPKQTEGFRKRWFTMDDRRLMYFKDPLDAFARGEVFIGSKESGYTVLHGFPPSTQGHHWPHGITIVTPDRKFLFACETESDQREWVAAFQKAVDRPMLPQEYAVEAHFKHKP

SEQ ID NO: 8440 - protein, 381 aa, Artificial Sequence
  Description of Artificial Sequence: Synthetic coding sequence
MGDRERNKKRLLELLRAPDTGNAHCADCGAADPDWASYKLGIFICLNCCGVHRNFPDISRVKSVRLDFWDDSIVEFMIHNGNLRVKAKFEARVPAFYYIPQANDCLVLKEQWIRAKYERREFMADGETISLPGNREGFLWKRGRDNSQFLRRKFVLLAREGLLKYFTKEQGKSPKAVISIKDLNATFQTEKIGHPHGLQITYRRDGHTRNLFVYHESGKEIVDWFNALRAARLQYLKMAFPELPESELVPFLTRNYLKQGFMEKTGPKQKEPFKKRWFALDCHERRLLYYKNPLDAFEQGQVFLGNKEQGYEAYEDLPKGIRGNRWKAGLTIVTPERRFVLTCPSEKEQQEWLESLRGVLSSPLTPLNRLTASTESGRSSR

SEQ ID NO: 8441 - protein, 1006 aa, Artificial Sequence
  Description of Artificial Sequence: Synthetic coding sequence
MPDQISVSEFVAETHEDYKAPTASSFTTRTAQCRNTVAAIEEALDVDRMVLYKMKKSVKAINSSGLAHVENEEQYTQALEKFGGNCVCRDDPDLGSAFLKFSVFTKELTALFKNLIQNMNNIISFPLDSLLKGDLKGVKGDLKKPFDKAWKDYETKITKIEKEKKEHAKLHGMIRTEISGAEIAEEMEKERRFFQLQMCEYLLKVNEIKIKKGVDLLQNLIKYFHAQCNFFQDGLKAVESLKPSIETLSTDLHTIKQAQDEERRQLIQLRDILKSALQVEQKEDSQIRQSTAYSLHQPQGNKEHGTERNGSLYKKSDGIRKVWQKRKCSVKNGFLTISHGTANRPPAKLNLLTCQVKTNPEEKKCFDLISHDRTYHFQAEDEQECQIWMSVLQNSKEEALNNAFKGDDNTGENNIVQELTKEIISEVQRMTGNDVCCDCGAPDPTWLSTNLGILTCIECSGIHRELGVHYSRMQSLTLDVLGTSELLLAKNIGNAGFNEIMECCLPAEDSVKPNPGSDMNARKDYITAKYIERRYARKKHADNAAKLHSLCEAVKTRDIFGLLQAYADGVDLTEKIPLANGHEPDETALHLAVRSVDRTSLHIVDFLVQNSGNLDKQTGKGSTALHYCCLTDNAECLKLLLRGKASIEIANESGETPLDIAKRLKHEHCEELLTQALSGRFNSHVHVEYEWRLLHEDLDESDDDMDEKLQPSPNRREDRPISFYQLGSNQLQSNAVSLARDAANLAKEKQRAFMPSILQNETYGALLSGSPPPAQPAAPSTTSAPPLPPRNVGKVQTASSANTLWKTNSVSVDGGSRQRSSSDPPAVHPPLPPLRVTSTNPLTPTPPPPVAKTPSVMEALSQPSKPAPPGISQIRPPPLPPQPPSRLPQKKPAPGADKSTPLTNKGQPRGPVDLSATEALGPLSNAMVLQPPAPMPRKSQATKLKPKRVKALYNCVADNPDELTFSEGDVIIVDGEEDQEWWIGHIDGDPGRKGAFPVSFVHFIAD

SEQ ID NO: 8442 - protein, 961 aa, Artificial Sequence
  Description of Artificial Sequence: Synthetic coding sequence
MPDQISVSEFVAETHEDYKAPTASSFTTRTAQCRNTVAAIEEALDVDRMVLYKMKKSVKAINSSGLAHVENEEQYTQALEKFGGNCVCRDDPDLGSAFLKFSVFTKELTALFKNLIQNMNNIISFPLDSLLKGDLKGVKGDLKKPFDKAWKDYETKITKIEKEKKEHAKLHGMIRTEISGAEIAEEMEKERRFFQLQMCEYLLKVNEIKIKKGVDLLQNLIKYFHAQCNFFQDGLKAVESLKPSIETLSTDLHTIKQAQDEERRQLIQLRDILKSALQVEQKEDSQIRQSTAYSLHQPQGNKEHGTERNGSLYKKSDGIRKVWQKRKCSVKNGFLTISHGTANRPPAKLNLLTCQVKTNPEEKKCFDLISHDRTYHFQAEDEQECQIWMSVLQNSKEEALNNAFKGDDNTGENNIVQELTKEIISEVQRMTGNDVCCDCGAPDPTWLSTNLGILTCIECSGIHRELGVHYSRMQSLTLDVLGTSELLLAKNIGNAGFNEIMECCLPAEDSVKPNPGSDMNARKDYITAKYIERRYARKKHADNAAKLHSLCEAVKTRDIFGLLQAYADGVDLTEKIPLANGHEPDETALHLAVRSVDRTSLHIVDFLVQNSGNLDKQTGKGSTALHYCCLTDNAECLKLLLRGKASIEIANESGETPLDIAKRLKHEHCEELLTQALSGRFNSHVHVEYEWRLLHEDLDESDDDMDEKLQPSPNRREDRPISFYQLGSNQLQSNAVSLARDAANLAKEKQRAFMPSILQNETYGALLSGSPPPAQPAAPSTTSAPPLPPRNVGKDPLTPTPPPPVAKTPSVMEALSQPSKPAPPGISQIRPPPLPPQPPSRLPQKKPAPGADKSTPLTNKGQPRGPVDLSATEALGPLSNAMVLQPPAPMPRKSQATKLKPKRVKALYNCVADNPDELTFSEGDVIIVDGEEDQEWWIGHIDGDPGRKGAFPVSFVHFIAD

SEQ ID NO: 8443 - protein, 282 aa, Artificial Sequence
  Description of Artificial Sequence: Synthetic coding sequence
MNSSTSTMSEEPDALSVVNQLRDLAADPLNRRAIVQDQGCLPGLILFMDHPNPPVVHSALLALRYLAECRANREKMKGELGMMLSLQNVIQKTTTPGETKLLASEIYDILQSSNMADGDSFNEMNSRRRKAQFFLGTTNKRAKTVVLHIDGLDDTSRRNLCEEALLKIKGVISFTFQMAVQRCVVRIRSDLKAEALASAIASTKVMKAQQVVKSESGEEMLVPFQDTPVEVEQNTELPDYLPEDESPTKEQDKAVSRVGSHPEGGASWLSTAANFLSRSFYW

SEQ ID NO: 8444 - protein, 180 aa, Artificial Sequence
  Description of Artificial Sequence: Synthetic coding sequence
MSAWPYFIYGPSQPSSRPLRFACSSILGRMPCKQRKDERRTGYDVELTKCYTESRRNLCEEALLKIKGVISFTFQMAVQRCVVRIRSDLKAEALASAIASTKVMKAQQVVKSESGEEMLVPFQDTPVEVEQNTELPDYLPEDESPTKEQDKAVSRVGSHPEGGASWLSTAANFLSRSFYW

SEQ ID NO: 8445 - protein, 2290 aa, Artificial Sequence
  Description of Artificial Sequence: Synthetic coding sequence
MGRIQEVGWVTAGLVIWAGTCYYIYKFTKGRAQSVRTLARNGSTVKMETVVGVQSQTLAINEAEIKTKPQVEIGAETGARSGPRAEVETKATAIAIHRANSQAKAMVGAEPETQSESKVVAGTLVMTEAVTLTEVKAKAREVAMKEAVTQTDAEAGKIVKKEAVTQTKAKAWALVAKTEAKREAMTQTKAETHILAEKETEINRVMVTQSETLAVPREVAKMGATNKTGIVDETKTRALEETVSVAKTQSEARPGATVDARGNPNGMSREVAGVDMKSCAQSQAVTKIQGDDMPGTGVEDMGNCKTMSRAESGADTRASAQPQIFAKTQTEAIPGAKIDAGGNTNAMCKVGAGADVRACIQPQTVAKKQAEVTSGARVDGRGNTNVISKAITGADMRAAAQPQAVASTHAEAMSDAKVKNRGNPNAMTKAGAKANLRANSQVEALPDARDKSRGNPNVMAKVGDGTDMLSCTQPQLVASVQADTLSDGKIKVRGNVNTMPKEGAGVDMKAQGMAQSQGEALPNTRGKARGKAKAKCKTGPGMDMKTCTQPQAGVKTPAEALLDSRVDGRGNPNATSKAGTKADQRVCGQPLVVANPQGEALPGAKNKVKGNPHTVLKVGAGEGTTDSAQPEAVVSFQGEALLGTKNKVKGNPNVVLKAEVGEGAMGTAQLQIMASSKGEALLDSKNKVKGNSNAVSKAGAGTDTTGSVQPQIVANSQGEVLPGAKNKIRGNPTTVPNSGVGPYTTDSARLQAVANSQGEVLPGAKNKVKANLNAVSKAEAGMGATGSVQPQAVANSHCETLPGAKNKVRGNWNAVSKAGAGMDTRGSAQPQAVANSQGEVLPGAKNKVKGNPNVVSKAGAREDTVGSTQPQVLASSQRETLPGARNKVKGNSNVVSKAGAREDTMGSAQPQVVANSQRETLPGARNKVKGNSNAISKAEAGAGIMGSVQVQVVASFQGEVLPGAKNKVRGNSNAVPKAEAGADTVGSAQPQAVANSQSETLLGARNKVKGNTIAVPKAGTGAGTRHSAQPQIVAGSQGETLPGARDKSMSTSEAEATAEDEAYAKPEAEAMPTSESEGGSGTQACRKTQPNIHDYYWNGIGVEDWIAAERWIKFRFQTMDGDWENSVSWADDENEASIGSWSGASDKAGIIRSWAVACDETSVKSWAGARAENVVGIGTWARAGEQASGGLWAGGQTSEGTWAGDKASGGAWTGAENQASGGSWALAGNQAIGELWAAGQASDGSWPGGQASGVSWVGEEAIGGSWTGAENQASEGSWAGAGAGNMSSVSYWAGVVDQAGGGSWAGTSDQSGGGSKPRFEDQASGEGSWAGAGGQASGGSMLGPEDQSSGRSWADTADQASGGSRLGHVDQSSGGAWAGTLDQSGGGSKPRFENQTTEEGSWAGAGGQAGGGSKVGPEDQSSGRSWANSGDQISGGFLVGIVDQANGGSWTGAGHPASVGPKPIFEDQVSGRGSWADAREQVVGDSRLGLRDQSSGDSWADTGDQASGWFCVCPGSQTNGGSWGGASGQDVGGSRPGPTNQSSAGSWDSPGSQVSGSCWTGAGAVDQAGGCSKPGFEDQAIGGGFWPGAGDQTGGGSRPGSEDQSSGIGSWGVAGGQVLGGARPGPADQSSGGSWAGTGNQSSGRSWIGPGDQAVDCSKPEFEDQACGGGSWAGAGSQASGESWAGSRPGNEAIGGSRMGSEDQATGGSWARSEDQASGRFQVSFEVEANEGFWFGPGAEAVIGSWCWTEEKADIVSRPDDKDEATTASRSGAGEEAMICSRIEAENKASSGSWIRSEEVAYMGSCVGAEAGAGAEAGAGAEAGAGAGAEAGAEAGAGAGAGPGTESGAGIWSWDGDATTVESRLGAGEEAGVESWTLARNVGEDELSRESSPDIEEISLRSLFWAESENSNTFRSKSGKDASFESGAGDNTSIKDKFEAAGGVDIGSWFCAGNENTSEDKSAPKAKAKKSSESRGIYPYMVPGAGMGSWDGAMIWSETKFAHQSEASFPVEDESRKQTRTGEKTRPWSCRCKHEANMDPRDLEKLICMIEMTEDPSVHEIANNALYNSADYSYSHEVVRNVGGISVIESLLNNPYPSVRQKALNALNNISVAAENHRKVKTYLNQVCEDTVTYPLNSNVQLAGLRLIRHLTITSEYQHMVTNYISEFLRLLTVGSGETKDHVLGMLLNFSKNPSMTKDLLIANAPTSLINIFSKKETKENILNALSLFENINYHFKRRAKAFTQDKFSKNSLYFLFQRPKACAKKLRALAAECNDPEVKERVELLISKL

SEQ ID NO: 8446 - protein, 360 aa, Artificial Sequence
  Description of Artificial Sequence: Synthetic coding sequence
MSAAGLKITGSKETKRRLLLISIDWSRDLMNLCIYFRVYCQEKQEERRELPRIITGPPPEAAVVAFEWLKTSTLTGLHPQLPLSLPQPECALPYLVRAFSRGDYMGRIQEVGWVTAGLVIWAGTCYYIYKFTKGRAQSVRTLARNGSTVKMETVVGVQSQTLAINEAEIKTKPQVEIGAETGARSGPRAEVETKATAIAIHRANSQAKAMVGAEPETQSESKVVAGTLVMTEAVTLTEVKAKAREVAMKEAVTQTDAEAGKIVKKEAVTQTKAKAWALVAKTEAKREAMTQTKAETHILAEKETEINRVMVTQSETLAVPREVAKMGATNKTGIVDETKTRALEETVLIPRAFPSKNASC

SEQ ID NO: 8447 - protein, 360 aa, Artificial Sequence; identical to SEQ ID NO: 8446
  Description of Artificial Sequence: Synthetic coding sequence

SEQ ID NO: 8448 - protein, 300 aa, Artificial Sequence
  Description of Artificial Sequence: Synthetic coding sequence
MGRAREVGWMAAGLMIGAGACYCVYKLTIGRDDSEKLEEEGEEEWDDDQELDEEEPDIWFDFETMARPWTEDGDWTEPGAPGGTEDRPSGGGKANRAHPIKQRPFPYEHKNTWSAQNCKNGSCVLDLSKCLFIQGKLLFAEPKDAGFPFSQDINSHLASLSMARNTSPTPDPTVREALCAPDNLNASIESQGQIKMYINEVCRETVSRCCNSFLQQAGLNLLISMTVINNMLAKSASDLKFPLISEGSGCAKVQVLKPLMGLSEKPVLAGELVGAQMLFSFMSLFIRNGNREILLETPAP

SEQ ID NO: 8449 - protein, 300 aa, Artificial Sequence; identical to SEQ ID NO: 8448
  Description of Artificial Sequence: Synthetic coding sequence

SEQ ID NO: 8450 - protein, 300 aa, Artificial Sequence; identical to SEQ ID NO: 8448
  Description of Artificial Sequence: Synthetic coding sequence

SEQ ID NO: 8451 - protein, 433 aa, Artificial Sequence
  Description of Artificial Sequence: Synthetic coding sequence
MGRVQLFEISLSHGRVVYSPGEPLAGTVRVRLGAPLPFRAIRVTCIGSCGVSNKANDTAWVVEEGYFNSSLSLADKGSLPAGEHSFPFQFLLPATAPTSFEGPFGKIVHQVRAAIHTPRFSKDHKCSLVFYILSPLNLNSIPDIEQPNVASATKKFSYKLVKTGSVVLTASTDLRGYVVGQALQLHADVENQSGKDTSPVVASLLQKVSYKAKRWIHDVRTIAEVEGAGVKAWRRAQWHEQILVPALPQSALPGCSLIHIDYYLQVSLKAPEATVTLPVFIGNIAVNHAPVSPRPGLGLPPGAPPLVVPSAPPQEEAEAEAAAGGPHFLDPVFLSTKSHSQRQPLLATLSSVPGAPEPCPQDGSPASHPLHPPLCISTGATVPYFAEGSGGPVPTTSTLILPPEYSSWGYPYEAPPSYEQSCGGVEPSLTPES

SEQ ID NO: 8452 - protein, 271 aa, Artificial Sequence
  Description of Artificial Sequence: Synthetic coding sequence
MGRVQLFEISLSHGRVVYSPGEPLAGTVRVRLGAPLPFRAIRVTCIGSCGVSNKANDTAWVVEEGYFNSSLSLADKGSLPAGEHSFPFQFLLPATAPTSFEGPFGKIVHQVRAAIHTPRFSKDHKCSLVFYILSPLNLNSIPDIEALQLHADVENQSGKDTSPVVASLLQKVSYKAKRWIHDVRTIAEVEGAGVKAWRRAQWHEQILVPALPQSALPGCSLIHIDYYLQVSLKAPEATVTLPVFIGNIAVNHAPVSPRPGLGLPPGAPPLV

SEQ ID NO: 8453 - protein, 177 aa, Artificial Sequence
  Description of Artificial Sequence: Synthetic coding sequence
MGRVQLFEISLSHGRVVYSPGEPLAGTVRVRLGAPLPFRAIRVTCIGSCGVSNKANDTAWVVEEGYFNSSLSLADKGSLPAGEHSFPFQFLLPATAPTSFEGPFGKIVHQVRAAIHTPRFSKDHKCSLVFYILSPLNLNSIPDIEGSSLRTPAKPLPGPPPKQPNVASATKKFSYKL

SEQ ID NO: 8454 - protein, 407 aa, Artificial Sequence
  Description of Artificial Sequence: Synthetic coding sequence
MAVPWLVLLLALPIFFLGVFVWAVFEHFLTTDIPATLQHPAKLRFLHCIFLYLVTLGNIFEKLGICSMPKFIRFLHDSVRIKKDPELVVTDLRFGTIPVRLFQPKAASSRPRRGIIFYHGGATVFGSLDCYHGLCNYLARETESVLLMIGYRKLPDHHSPALFQDCMNASIHFLKALETYGVDPSRVVVCGESVGGAAVAAITQALVGRSDLPRIRAQVLIYPVVQAFCLQLPSFQQNQNVPLLSRKFMVTSLCNYLAIDLSWRDAILNGTCVPPDVWRKYEKWLSPDNIPKKFKNRGYQPWSPGPFNEAAYLEAKHMLDVENSPLIADDEVIAQLPEAFLVSCENDILRDDSLLYKKRLEDQGVRVTWYHLYDGFHGSIIFFDKKALSFPCSLKIVNAVVSYIKGI

SEQ ID NO: 8455 - protein, 2969 aa, Artificial Sequence
  Description of Artificial Sequence: Synthetic coding sequence
MDPRNTAMLGLGSDSEGFSRKSPSAISTGTLVSKREVELEKNTKEEEDLRKRNRERNIEAGKDDGLTDAQQQFSVKETNFSEGNLKLKIGLQAKRTKKPPKNLENYVCRPAIKTTIKHPRKALKSGKMTDEKNEHCPSKRDPSKLYKKADDVAAIECQSEEVIRLHSQGENNPLSKKLSPVHSEMADYINATPSTLLGSRDPDLKDRALLNGGTSVTEKLAQLIATCPPSKSSKTKPKKLGTGTTAGLVSKDLIRKAGVGSVAGIIHKDLIKKPTISTAVGLVTKDPGKKPVFNAAVGLVNKDSVKKLGTGTTAVFINKNLGKKPGTITTVGLLSKDSGKKLGIGIVPGLVHKESGKKLGLGTVVGLVNKDLGKKLGSTVGLVAKDCAKKIVASSAMGLVNKDIGKKLMSCPLAGLISKDAINLKAEALLPTQEPLKASCSTNINNQESQELSESLKDSATSKTFEKNVVRQNKESILEKFSVRKEIINLEKEMFNEGTCIQQDSFSSSEKGSYETSKHEKQPPVYCTSPDFKMGGASDVSTAKSPFSAVGESNLPSPSPTVSVNPLTRSPPETSSQLAPNPLLLSSTTELIEEISESVGKNQFTSESTHLNVGHRSVGHSISIECKGIDKEVNDSKTTHIDIPRISSSLGKKPSLTSESSIHTITPSVVNFTSLFSNKPFLKLGAVSASDKHCQVAESLSTSLQSKPLKKRKGRKPRWTKVVARSTCRSPKGLELERSELFKNVSCSSLSNSNSEPAKFMKNIGPPSFVDHDFLKRRLPKLSKSTAPSLALLADSEKPSHKSFATHKLSSSMCVSSDLLSDIYKPKRGRPKSKEMPQLEGPPKRTLKIPASKVFSLQSKEEQEPPILQPEIEIPSFKQGLSVSPFPKKRGRPKRQMRSPVKMKPPVLSVAPFVATESPSKLESESDNHRSSSDFFESEDQLQDPDDLDDSHRPSVCSMSDLEMEPDKKITKRNNGQLMKTIIRKINKMKTLKRKKLLNQILSSSVESSNKGKVQSKLHNTVSSLAATFGSKLGQQINVSKKGTIYIGKRRGRKPKTVLNGILSGSPTSLAVLEQTAQQAAGSALGQILPPLLPSSASSSEILPSPICSQSSGTSGGQSPVSSDAGFVEPSSVPYLHLHSRQGSMIQTLAMKKASKGRRRLSPPTLLPNSPSHLSELTSLKEATPSPISESHSDETIPSDSGIGTDNNSTSDRAEKFCGQKKRRHSFEHVSLIPPETSTVLSSLKEKHKHKCKRRNHDYLSYDKMKRQKRKRKKKYPQLRNRQDPDFIAELEELISRLSEIRITHRSHHFIPRDLLPTIFRINFNSFYTHPSFPLDPLHYIRKPDLKKKRGRPPKMREAMAEMPFMHSLSFPLSSTGFYPSYGMPYSPSPLTAAPIGLGYYGRYPPTLYPPPPSPSFTTPLPPPSYMHAGHLLLNPAKYHKKKHKLLRQEAFLTTSRTPLLSMSTYPSVPPEMAYGWMVEHKHRHRHKHREHRSSEQPQVSMDTGSSRSVLESLKRYRFGKDAVGERYKHKEKHRCHMSCPHLSPSKSLINREEQWVHREPSESSPLALGLQTPLQIDCSESSPSLSLGGFTPNSEPASSDEHTNLFTSAIGSCRVSNPNSSGRKKLTDSPGLFSAQDTSLNRLHRKESLPSNERAVQTLAGSQPTSDKPSQRPSESTNCSPTRKRSSSESTSSTVNGVPSRSPRLVASGDDSVDSLLQRMVQNEDQEPMEKSIDAVIATASAPPSSSPGRSHSKDRTLGKPDSLLVPAVTSDSCNNSISLLSEKLTSSCSPHHIKRSVVEAMQRQARKMCNYDKILATKKNLDHVNKILKAKKLQRQARTGNNFVKRRPGRPRKCPLQAVVSMQAFQAAQFVNPELNRDEEGAALHLSPDTVTDVIEAVVQSVNLNPEHKKGLKRKGWLLEEQTRKKQKPLPEEEEQENNKSFNEAPVEIPSPSETPAKPSEPESTLQPVLSLIPREKKPPRPPKKKYQKAGLYSDVYKTTDPKSRLIQLKKEKLEYTPGEHEYGLFPAPIHVVFFVSGKYLRQKRIDFQLPYDILWQWKHNQLYKKPDVPLYKKIRSNVYVDVKPLSGYEATTCNCKKPDDDTRKGCVDDCLNRMIFAECSPNTCPCGEQCCNQRIQRHEWVQCLERFRAEEKGWGIRTKEPLKAGQFIIEYLGEVVSEQEFRNRMIEQYHNHSDHYCLNLDSGMVIDSYRMGNEARFINHSCDPNCEMQKWSVNGVYRIGLYALKDMPAGTELTYDYNFHSFNVEKQQLCKCGFEKCRGIIGGKSQRVNGLTSSKNSQPMATHKKSGRSKEKRKSKHKLKKRRGHLSEEPSENINTPTRLTPQLQMKPMSNRERNFVLKHHVFLVRNWEKIRQKQEEVKHTSDNIHSASLYTRWNGICRDDGNIKSDVFMTQFSALQTARSVRTRRLAAAEENIEVARAARLAQIFKEICDGIISYKDSSRQALAAPLLNLPPKKKNADYYEKISDPLDLITIEKQILTGYYKTVEAFDADMLKVFRNAEKYYGRKSPVGRDVCRLRKAYYNARHEASAQIDEIVGETASEADSSETSVSEKENGHEKDDDVIRCICGLYKDEGLMIQCDKCMVWQHCDCMGVNSDVEHYLCEQCDPRPVDREVPMIPRPHYAQPGCVYFICLLRDDLLLRQGDCVYLMRDSRRTPDGHPVRQSYRLLSHINRDKLDIFRIEKLWKNEKEERFAFGHHYFRPHETHHSPSRRFYHNELFRVPLYEIIPLEAVVGTCCVLDLYTYCKGRPKGVKEQDVYICDYRLDKSAHLFYKIHRNRYPVCTKPYAFDHFPKKLTPKKDFSPHYVPDNYKRNGGRSSWKSERSKPPLKDLGQEDDALPLIEEVLASQEQAANEIPSLEEPEREGATANVSEGEKKTEESSQEPQSTCTPEERRHNQRERLNQILLNLLEKIPGKNAIDVTYLLEEGSGRKLRRRTLFIPENSFRK

SEQ ID NO: 8456 - protein, 2964 aa, Artificial Sequence
  Description of Artificial Sequence: Synthetic coding sequence
MDPRNTAMLGLGSDSEGFSRKSPSAISTGTLVSKREVELEKNTKEEEDLRKRNRERNIEAGKDDGLTDAQQQFSVKETNFSEGNLKLKIGLQAKRTKKPPKNLENYVCRPAIKTTIKHPRKALKSGKMTDEKNEHCPSKRDPSKLYKKADDVAAIECQSEEVIRLHSQGENNPLSKKLSPVHSEMADYINATPSTLLGSRDPDLKDRALLNGGTSVTEKLAQLIATCPPSKSSKTKPKKLGTGTTAGLVSKDLIRKAGVGSVAGIIHKDLIKKPTISTAVGLVTKDPGKKPVFNAAVGLVNKDSVKKLGTGTTAVFINKNLGKKPGTITTVGLLSKDSGKKLGIGIVPGLVHKESGKKLGLGTVVGLVNKDLGKKLGSTVGLVAKDCAKKIVASSAMGLVNKDIGKKLMSCPLAGLISKDAINLKAEALLPTQEPLKASCSTNINNQESQELSESLKDSATSKTFEKNVVRQNKESILEKFSVRKEIINLEKEMFNEGTCIQQDSFSSSEKGSYETSKHEKQPPVYCTSPDFKMGGASDVSTAKSPFSAVGESNLPSPSPTVSVNPLTRSPPETSSQLAPNPLLLSSTTELIEEISESVGKNQFTSESTHLNVGHRSVGHSISIECKGIDKEVNDSKTTHIDIPRISSSLGKKPSLTSESSIHTITPSVVNFTSLFSNKPFLKLGAVSASDKHCQVAESLSTSLQSKPLKKRKGRKPRWTKVVARSTCRSPKGLELERSELFKNVSCSSLSNSNSEPAKFMKNIGPPSFVDHDFLKRRLPKLSKSTAPSLALLADSEKPSHKSFATHKLSSSMCVSSDLLSDIYKPKRGRPKSKEMPQLEGPPKRTLKIPASKVFSLQSKEEQEPPILQPEIEIPSFKQGLSVSPFPKKRGRPKRQMRSPVKMKPPVLSVAPFVATESPSKLESESDNHRSSSDFFESEDQLQDPDDLDDSHRPSVCSMSDLEMEPDKKITKRNNGQLMKTIIRKINKMKTLKRKKLLNQILSSSVESSNKGKVQSKLHNTVSSLAATFGSKLGQQINVSKKGTIYIGKRRGRKPKTVLNGILSGSPTSLAVLEQTAQQAAGSALGQILPPLLPSSASSSEILPSPICSQSSGTSGGQSPVSSDAGFVEPSSVPYLHLHSRQGSMIQTLAMKKASKGRRRLSPPTLLPNSPSHLSELTSLKEATPSPISESHSDETIPSDSGIGTDNNSTSDRAEKFCGQKKRRHSFEHVSLIPPETSTVLSSLKEKHKHKCKRRNHDYLSYDKMKRQKRKRKKKYPQLRNRQDPDFIAELEELISRLSEIRITHRSHHFIPRDLLPTIFRINFNSFYTHPSFPLDPLHYIRKPDLKKKRGRPPKMREAMAEMPFMHSLSFPLSSTGFYPSYGMPYSPSPLTAAPIGLGYYGRYPPTLYPPPPSPSFTTPLPPPSYMHAGHLLLNPAKYHKKKHKLLRQEAFLTTSRTPLLSMSTYPSVPPEMAYGWMVEHKHRHRHKHREHRSSEQPQVSMDTGSSRSVLESLKRYRFGKDAVGERYKHKEKHRCHMSCPHLSPSKSLINREEQWVHREPSESSPLALGLQTPLQIDCSESSPSLSLGGFTPNSEPASSDEHTNLFTSAIGSCRVSNPNSSGRKKLTDSPGLFSAQDTSLNRLHRKESLPSNERAVQTLAGSQPTSDKPSQRPSESTNCSPTRKRSSSESTSSTVNGVPSRSPRLVASGDDSVDSLLQRMVQNEDQEPMEKSIDAVIATASAPPSSSPGRSHSKDRTLGKPDSLLVPAVTSDSCNNSISLLSEKLTSSCSPHHIKRSVVEAMQRQARKMCNYDKILATKKNLDHVNKILKAKKLQRQARTGNNFVKRRPGRPRKCPLQAVVSMQAFQAAQFVNPELNRDEEGAALHLSPDTVTDVIEAVVQSVNLNPEHKKGLKRKGWLLEEQTRKKQKPLPEEEEQENNKSFNEAPVEIPSPSETPAKPSEPESTLQPVLSLIPREKKPPRPPKKKYQKAGLYSDVYKTTDPKSRLIQLKKEKLEYTPGEHEYGLFPAPIHVGKYLRQKRIDFQLPYDILWQWKHNQLYKKPDVPLYKKIRSNVYVDVKPLSGYEATTCNCKKPDDDTRKGCVDDCLNRMIFAECSPNTCPCGEQCCNQRIQRHEWVQCLERFRAEEKGWGIRTKEPLKAGQFIIEYLGEVVSEQEFRNRMIEQYHNHSDHYCLNLDSGMVIDSYRMGNEARFINHSCDPNCEMQKWSVNGVYRIGLYALKDMPAGTELTYDYNFHSFNVEKQQLCKCGFEKCRGIIGGKSQRVNGLTSSKNSQPMATHKKSGRSKEKRKSKHKLKKRRGHLSEEPSENINTPTRLTPQLQMKPMSNRERNFVLKHHVFLVRNWEKIRQKQEEVKHTSDNIHSASLYTRWNGICRDDGNIKSDVFMTQFSALQTARSVRTRRLAAAEENIEVARAARLAQIFKEICDGIISYKDSSRQALAAPLLNLPPKKKNADYYEKISDPLDLITIEKQILTGYYKTVEAFDADMLKVFRNAEKYYGRKSPVGRDVCRLRKAYYNARHEASAQIDEIVGETASEADSSETSVSEKENGHEKDDDVIRCICGLYKDEGLMIQCDKCMVWQHCDCMGVNSDVEHYLCEQCDPRPVDREVPMIPRPHYAQPGCVYFICLLRDDLLLRQGDCVYLMRDSRRTPDGHPVRQSYRLLSHINRDKLDIFRIEKLWKNEKEERFAFGHHYFRPHETHHSPSRRFYHNELFRVPLYEIIPLEAVVGTCCVLDLYTYCKGRPKGVKEQDVYICDYRLDKSAHLFYKIHRNRYPVCTKPYAFDHFPKKLTPKKDFSPHYVPDNYKRNGGRSSWKSERSKPPLKDLGQEDDALPLIEEVLASQEQAANEIPSLEEPEREGATANVSEGEKKTEESSQEPQSTCTPEERRHNQRERLNQILLNLLEKIPGKNAIDVTYLLEEGSGRKLRRRTLFIPENSFRK

SEQ ID NO: 8457 - protein, 287 aa, Artificial Sequence
  Description of Artificial Sequence: Synthetic coding sequence
MAKDFQDIQQLSSEENDHPFHQGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 8458 - protein, 311 aa, Artificial Sequence
  Description of Artificial Sequence: Synthetic coding sequence
MAKDFQDIQQLSSEENDHPFHQGEGPGTRRLNPRRGNPFLKGPPPAQPLAQRLCSMVCFSLLALSFNILLLVVICVTGSQSEGHGGAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 8459 - protein, 311 aa, Artificial Sequence; identical to SEQ ID NO: 8458
  Description of Artificial Sequence: Synthetic coding sequence

SEQ ID NO: 8460 - protein, 292 aa, Artificial Sequence
  Description of Artificial Sequence: Synthetic coding sequence
MAKDFQDIQQLSSEENDHPFHQGPPPAQPLAQRLCSMVCFSLLALSFNILLLVVICVTGSQSEGHGGAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 8461 - protein, 137 aa, Artificial Sequence
  Description of Artificial Sequence: Synthetic coding sequence
MAKDFQDIQQLSSEENDHPFHQGPPPAQPLAQRLCSMVCFSLLALSFNILLLVVICVTGSQSAQLQAELRSLKEAFSNFSSSTLTEVQAISTHGGSVGDKITSLGAKLEKQQQDLKAGQRASGVCAHVRACVRVRCV

SEQ ID NO: 8462 - protein, 473 aa, Artificial Sequence
  Description of Artificial Sequence: Synthetic coding sequence
MAQLEGYCFSAALSCTFLVSCLLFSAFSRALREPYMDEIFHLPQAQRYCEGHFSLSQWDPMITTLPGLYLVSVGVVKPAIWIFAWSEHVVCSIGMLRFVNLLFSVGNFYLLYLLFHKVQPRNKAASSIQRVLSTLTLAVFPTLYFFNFLYYTEAGSMFFTLFAYLMCLYGNHKTSAFLGFCGFMFRQTNIIWAVFCAGNVIAQKLTEAWKTELQKKEDRLPPIKGPFAEFRKILQFLLAYSMSFKNLSMLFCLTWPYILLGFLFCAFVVVNGGIVIGDRSSHEACLHFPQLFYFFSFTLFFSFPHLLSPSKIKTFLSLVWKHGILFLVVTLVSVFLVWKFTYAHKYLLADNRHYTFYVWKRVFQRYAILKYLLVPAYIFAGWSIADSLKSKPIFWNLMFFICLFIVIVPQKLLEFRYFILPYVIYRLNITLPPTSRLVCELSCYAIVNFITFYIFLNKTFQWPNSQDIQRFMW

SEQ ID NO: 8463 - protein, 390 aa, Artificial Sequence
  Description of Artificial Sequence: Synthetic coding sequence
MFPAQAKENAGFSGCGGDTEIDWKAYMAEVEGVINGTYDYTQLQGDTGPLVYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFSLAVSVKMNVLLFAPGLLFLLLTQFGFRGALPKLGICAGLQVVLGLPFLLENPSGYLSRSFDLGRQFLFHWTVNWRFLPEALFLHRAFHLALLTAHLTLLLLFALCRWHRTGESILSLLRDPSKRKVPPQPLTPNQIVSTLFTSNFIGICFSRSLHYQFYVWYFHTLPYLLWAMPARWLTHLLRLLVLGLIELSWNTYPSTSCSSAALHICHAVILLQLWLGPQPFPKSTQHSKKAH

SEQ ID NO: 8464 - protein, 324 aa, Artificial Sequence
  Description of Artificial Sequence: Synthetic coding sequence
MAPLLLQLAVLGAALAAAALVLISIVAFTTATKMPALHRHEEEKFFLNAKGQKETLPSIWDSPTKQLSVVVPSYNEEKRLPVMMDEALSYLEKRQKRDPAFTYEVIVVDDGSKDQTSKVAFKYCQKYGSDKVRVITLVKNRGKGGAIRMGIFSSRGEKILMADADGATKFPDVEKLEKGLNDLQPWPNQMAIACGSRAHLEKESIAQRSYFRTLLMYGFHFLVWFLCVKGIRDTQCGFKLFTREAASRTFSSLHVERWAFDVELLYIAQFFKIPIAEIAVNWTEIEGSKLVPFWSWLQMGKDLLFIRLRYLTGAWRLEQTRKMN

SEQ ID NO: 8465 - protein, 230 aa, Artificial Sequence
  Description of Artificial Sequence: Synthetic coding sequence
MAPLLLQLAVLGAALAAAALVLISIVAFTTATKMPALHRHEEEKFFLNAKGQKETLPSIWDSPTKQLSVVVPSYNEEKRLPVMMDEALSYLEKRQKRDPAFTYEVIVVDDGSKDQTSKVAFKYCQKYGSDKVRVITLVKNRGKGGAIRMGIFSSRGEKILMADADGATKFPDVEKLEKGLNDLQPWPNQMAIACGSRAHLEKESIAQHKCSFGGLISQPVFIGSILYGRH

SEQ ID NO: 8466 - protein, 294 aa, Artificial Sequence
  Description of Artificial Sequence: Synthetic coding sequence
MAPLLLQLAVLGAALAAAALVLISIVAFTTATKMPALHRHEEEKFFLNAKGQKETLPSIWDSPTKQLSVVVPSYNEEKRLPVMMDEALSYLEKRQKYGSDKVRVITLVKNRGKGGAIRMGIFSSRGEKILMADADGATKFPDVEKLEKGLNDLQPWPNQMAIACGSRAHLEKESIAQRSYFRTLLMYGFHFLVWFLCVKGIRDTQCGFKLFTREAASRTFSSLHVERWAFDVELLYIAQFFKIPIAEIAVNWTEIEGSKLVPFWSWLQMGKDLLFIRLRYLTGAWRLEQTRKMN

SEQ ID NO: 8467 - protein, 390 aa, Artificial Sequence
  Description of Artificial Sequence: Synthetic coding sequence
MKEGRGSFSVERGPRKERETAQSGMWKGNSPAGSQGAAMEGTGGELGGQGNWGPEDAPGLLARASLIMLPWPLPLASSALTLLFGALTSLFLWYCYRLGSQDMQALGAGSRAGGVRGGPVGCSEAGGPSPGGPGDPGEGPRTEGLVSRRLRAYARRYSWAGMGRVRRAAQGGPGPGRGPGVLGIQRPGLLFLPDLPSAPFVPRDAQRHDVELLESSFPAILRDFGAVSWDFSGTTPPPRGWSPPLAPGCYQLLLYQAGRCQPSNCRRCPGAYRALRGLRSFMSANTFGNAGFSVLLPGARLEGRCGPTNARVRCHLGLKIPPGCELVVGGEPQCWAEGHCLLVDDSFLHTVAHNGSPEDGPRVVFIVDLWHPNVAGAERQALDFVFAPDP

SEQ ID NO: 8468 - protein, 390 aa, Artificial Sequence; identical to SEQ ID NO: 8467
  Description of Artificial Sequence: Synthetic coding sequence

SEQ ID NO: 8469 - protein, 369 aa, Artificial Sequence
  Description of Artificial Sequence: Synthetic coding sequence
MVWAPLGPPRTDCLTLLHTPSKDSPKMSLEWLVAWSWSLDGLRDCIATGIQSVRDCDTTAVITVACLLVLFVWYCYHVGREQPRPYVSVNSLMQAADANGLQNGYVYCQSPECVRCTHNEGLNQKLYHNLQEYAKRYSWSGMGRIHKGIREQGRYLNSRPSIQKPEVFFLPDLPTTPYFSRDAQKHDVEVLERNFQTILCEFETLYKAFSNCSLPQGWKMNSTPSGEWFTFYLVNQGVCVPRNCRKCPRTYRLLGSLRTCIGNNVFGNACISVLSPGTVITEHYGPTNIRIRCHLGLKTPNGCELVVGGEPQCWAEGRCLLFDDSFLHAAFHEGSAEDGPRVVFMVDLWHPNVAAAERQALDFIFAPGR

SEQ ID NO: 8470 - protein, 501 aa, Artificial Sequence
  Description of Artificial Sequence: Synthetic coding sequence
MPSASASRKSQEKPREIMDAAEDYAKERYGISSMIQSQEKPDRVLVRVRDLTIQKADEVVWVRARVHTSRAKGKQCFLVLRQQQFNVQALVAVGDHASKQMVKFAANINKESIVDVEGVVRKVNQKIGSCTQQDVELHVQKIYVISLAEPRLPLQLDDAVRPEAEGEEEGRATVNQDTRLDNRVIDLRTSTSQAVFRLQSGICHLFRETLINKGFVEIQTPKIISAASEGGANVFTVSYFKNNAYLAQSPQLYKQMCICADFEKVFSIGPVFRAEDSNTHRHLTEFVGLDIEMAFNYHYHEVMEEIADTMVQIFKGLQERFQTEIQTVNKQFPCEPFKFLEPTLRLEYCEALAMLREAGVEMGDEDDLSTPNEKLLGHLVKEKYDTDFYILDKYPLAVRPFYTMPDPRNPKQSNSYDMFMRGEEILSGAQRIHDPQLLTERALHHGIDLEKIKAYIDSFRFGAPPHAGGGIGLERVTMLFLGLHNVRQTSMFPRDPKRLTP

SEQ ID NO: 8471 - protein, 401 aa, Artificial Sequence
  Description of Artificial Sequence: Synthetic coding sequence
MVKFAANINKESIVDVEGVVRKVNQKIGSCTQQDVELHVQKIYVISLAEPRLPLQLDDAVRPEAEGEEEGRATVNQDTRLDNRVIDLRTSTSQAVFRLQSGICHLFRETLINKGFVEIQTPKIISAASEGGANVFTVSYFKNNAYLAQSPQLYKQMCICADFEKVFSIGPVFRAEDSNTHRHLTEFVGLDIEMAFNYHYHEVMEEIADTMVQIFKGLQERFQTEIQTVNKQFPCEPFKFLEPTLRLEYCEALAMLREAGVEMGDEDDLSTPNEKLLGHLVKEKYDTDFYILDKYPLAVRPFYTMPDPRNPKQSNSYDMFMRGEEILSGAQRIHDPQLLTERALHHGIDLEKIKAYIDSFRFGAPPHAGGGIGLERVTMLFLGLHNVRQTSMFPRDPKRLTP

SEQ ID NO: 8472 - protein, 187 aa, Artificial Sequence
  Description of Artificial Sequence: Synthetic coding sequence
MTSREHQVSLCNCVPLLRRLLCDAPWRKARPLHALSRYFRSRVSPSKMAEEPQSVLQLPTSIAAGGEGLTDVSPETTTPEPPSSAAVSPGTEEPAGDTKKKIDILLKAVGDTPIMKTKKWAVERTRTIQGLIDFIKKFLKLVASEQLFIYVNQSFAPSPDQEVGTLYECFGSDGKLVLHYCKSQAWG

SEQ ID NO: 8473 - protein, 74 aa, Artificial Sequence
  Description of Artificial Sequence: Synthetic coding sequence
MAEEPQSVLQLPTSIAAGGEGLTDVSPETTTPEPPSSAAVSPGTEEPAGDTKKKIYLCESVLCSFPRPRSWNSL

SEQ ID NO: 8474 - protein, 140 aa, Artificial Sequence
  Description of Artificial Sequence: Synthetic coding sequence
MAEEPQSVLQLPTSIAAGGEGLTDVSPETTTPEPPSSAAVSPGTEEPAGDTKKKIDILLKAVGDTPIMKTKKWAVERTRTIQGLIDFIKKFLKLVASEQLFIYVNQSFAPSPDQEVGTLYECFGSDGKLVLHYCKSQAWG

SEQ ID NO: 8475 - protein, 492 aa, Artificial Sequence
  Description of Artificial Sequence: Synthetic coding sequence
MASPSGKGARALEAPGCGPRPLARDLVDSVDDAEGLYVAVERCPLCNTTRRRLTCAKCVQSGDFVYFDGRDRERFIDKKERLSRLKSKQEEFQKEVLKAMEGKWITDQLRWKIMSCKMRIEQLKQTICKGNEEMEKNSEGLLKTKEKNQKLYSRAQRHQEKKEKIQRHNRKLGDLVEKKTIDLRSHYERLANLRRSHILELTSVIFPIEEVKTGVRDPADVSSESDSAMTSSTVSKLAEARRTTYLSGRWVCDDHNGDTSISITGPWISLPNNGDYSAYYSWVEEKKTTQGPDMEQSNPAYTISAALCYATQLVNILSHILDVNLPKKLCNSEFCGENLSKQKFTRAVKKLNANILYLCFSQHVNLDQLQPLHTLRNLMYLVSPSSEHLGRSGPFEVRADLEESMEFVDPGVAGESDESGDERVSDEETDLGTDWENLPSPRFCDIPSQSVEVSQSQSTQASPPIASSSAGGMISSAAASVTSWFKAYTGHR

SEQ ID NO: 8476 - protein, 275 aa, Artificial Sequence
  Description of Artificial Sequence: Synthetic coding sequence
MTDDKDVLRDVWFGRIPTCFTLYQDEITEREAEPYYLLLPRVSYLTLVTDKVKKHFQKVMRQEDISEIWFEYEGTPLKWHYPIGLLFDLLASSSALPWNITVHFKSFPEKDLLHCPSKDAIEAHFMSCMKEADALKHKSQVINEMQKKDHKQLWMGLQNDRFDQFWAINRKLMEYPAEENGFRYIPFRIYQTTTERPFIQKLFRPVAADGQLHTLGDLLKEVCPSAIDPEDGEKKNQVMIHGIEPMLETPLQWLSEHLSYPDNFLHISIIPQPTD

SEQ ID NO: 8477 - protein, 91 aa, Artificial Sequence
  Description of Artificial Sequence: Synthetic coding sequence
MTDDKDVLRDVWFGRIPTCFTLYQDEITEREAEPYYTDLTSFGPSIGNSWNILQKKMDFVISPLEYIRQRLKDLSFRSCFVLWLQMDSCTH

SEQ ID NO: 8478 - protein, 197 aa, Artificial Sequence
  Description of Artificial Sequence: Synthetic coding sequence
MHYPIGLLFDLLASSSALPWNITVHFKSFPEKDLLHCPSKDAIEAHFMSCMKEADALKHKSQVINEMQKKDHKQLWMGLQNDRFDQFWAINRKLMEYPAEENGFRYIPFRIYQTTTERPFIQKLFRPVAADGQLHTLGDLLKEVCPSAIDPEDGEKKNQVMIHGIEPMLETPLQWLSEHLSYPDNFLHISIIPQPTD

SEQ ID NO: 8479 - protein, 275 aa, Artificial Sequence; identical to SEQ ID NO: 8476
  Description of Artificial Sequence: Synthetic coding sequence

SEQ ID NO: 8480 - protein, 127 aa, Artificial Sequence
  Description of Artificial Sequence: Synthetic coding sequence
MCCAVSEQRLTCADQMMPFGKISQQLCGVKKLPWSCDSRYFWGWLNAVFNKVDYDRIRDVGPDRAASEWLLRCGAMVRYHGQERWQKDYNHLPTGPLDKYKIQAIDATDSCIMSIGFDHMETSNICC

SEQ ID NO: 8481 - protein, 136 aa, Artificial Sequence
  Description of Artificial Sequence: Synthetic coding sequence
MCCAVSEQRLTCADQMMPFGKISQQLCGVKKLPWSCDSRYFWGWLNAVFNKVDYDRIRDVGPDRAASEWLLRCGAMVRYHGQERWQKDYNHLPTGPLDKYKIQAIDATDSCIMSIGFDHMGNYPIVLLIENADDLQ

SEQ ID NO: 8482 - protein, 260 aa, Artificial Sequence
  Description of Artificial Sequence: Synthetic coding sequence
MAAVVVAAAGGAGPAVLQVAGLYRGLCAVRSRALGLGLVSPAQLRVFPVRPGSGRPEGGADSSGVGAEAELQANPFYDRYRDKIQLLRRSDPAAFESRLEKRSEFRKQPVGHSRQGDFIKCVEQKTDALGKQSVNRGFTKDKTLSSIFNIEMVKEKTAEEIKQIWQQYFAAKDTVYAVIPAEKFDLIWNRAQSCPTNVAEAQCIANQVQLFYATDRKETYGLVETFNLRPNEFKYMSVIAELEQSGLGAELKCAQNQNKT

SEQ ID NO: 8483 - protein, 328 aa, Artificial Sequence
  Description of Artificial Sequence: Synthetic coding sequence
MAAVVVAAAGGAGPAVLQVAGLYRGLCAVRSRALGLGLVSPAQLRVFPVRPGSGRPEGGADSSGVGAEAELQANPFYDRYRDKIQLLRRSDPAAFESRLEKRSEFRKQPVGHSRQGDFIKCVEQKTDALGKQSVNRGFTKDKTLSSIFNIEMVKEKTAEEIKQIWQQYFAAKDTVYAVIPAEKFDLIWNRAQSCPTFLCALPRREGYEFFVGQWTGTELHFTALINIQTRGEAAASQLILYHYPELKEEKGIVLMTAEMDSTFLNVAEAQCIANQVQLFYATDRKETYGLVETFNLRPNEFKYMSVIAELEQSGLGAELKCAQNQNKT

SEQ ID NO: 8484 - protein, 240 aa, Artificial Sequence
  Description of Artificial Sequence: Synthetic coding sequence
MSDPAAFESRLEKRSEFRKQPVGHSRQGDFIKCVEQKTDALGKQSVNRGFTKDKTLSSIFNIEMVKEKTAEEIKQIWQQYFAAKDTVYAVIPAEKFDLIWNRAQSCPTFLCALPRREGYEFFVGQWTGTELHFTALINIQTRGEAAASQLILYHYPELKEEKGIVLMTAEMDSTFLNVAEAQCIANQVQLFYATDRKETYGLVETFNLRPNEFKYMSVIAELEQSGLGAELKCAQNQNKT

SEQ ID NO: 8485 - protein, 177 aa, Artificial Sequence
  Description of Artificial Sequence: Synthetic coding sequence
MVKEKTAEEIKQIWQQYFAAKDTVYAVIPAEKFDLIWNRAQSCPTFLCALPRREGYEFFVGQWTGTELHFTALINIQTRGEAAASQLILYHYPELKEEKGIVLMTAEMDSTFLNVAEAQCIANQVQLFYATDRKETYGLVETFNLRPNEFKYMSVIAELEQSGLGAELKCAQNQNKT

SEQ ID NO: 8486 - protein, 45 aa, Artificial Sequence
  Description of Artificial Sequence: Synthetic coding sequence
MSDPAAFESRLEKRSEFRKQPVGHSRQGDFIKCVEQKDGAQNKLV

SEQ ID NO: 8487 - protein, 260 aa, Artificial Sequence; identical to SEQ ID NO: 8482
  Description of Artificial Sequence: Synthetic coding sequence

SEQ ID NO: 8488 - protein, 68 aa, Artificial Sequence
  Description of Artificial Sequence: Synthetic coding sequence
MPQLNTTVWPTMITPMLLTLFLITQLKMLNTNYHLPPSPKPMKMKNYNKPWEPKWTKICSLHSLPPQS

SEQ ID NO: 8489 - protein, 168 aa, Artificial Sequence
  Description of Artificial Sequence: Synthetic coding sequence
MLPAALLRRPGLGRLVRHARAYAEAAAAPAAASGPNQMSFTFASPTQVFFNGANVRQVDVPTLTGAFGILAAHVPTLQVLRPGLVVVHAEDGTTSKYFVSSGSIAVNADSSVQLLAEEAVTLDMLDLGAAKANLEKAQAELVGTADEATRAEIQIRIEANEALVKALE

SEQ ID NO: 8490 - protein, 168 aa, Artificial Sequence; identical to SEQ ID NO: 8489
  Description of Artificial Sequence: Synthetic coding sequence

SEQ ID NO: 8491 - protein, 51 aa, Artificial Sequence
  Description of Artificial Sequence: Synthetic coding sequence
MVAYWRQAGLSYIRYSQICAKVVRDALKTEFKANAKKTSGNSVKIVKVKKE

SEQ ID NO: 8492 - protein, 256 aa, Artificial Sequence
  Description of Artificial Sequence: Synthetic coding sequence
MLSRVVLSAAATAAPSLKNAAFLGPGVLQATRTFHTGQPHLVPVPPLPEYGGKVRYGLIPEEFFQFLYPKTGVTGPYVLGTGLILYALSKEIYVISAETFTALSVLGVMVYGIKKYGPFVADFADKLNEQKLAQLEEAKQASIQHIQNAIDTEKSQQALVQKRHYLFDVQRNNIAMALEVTYRERLYRVYKEVKNRLDYHISVQNMMRRKEQEHMINWVEKHVVQSISTQQEKETIAKCIADLKLLAKKAQAQPVM

SEQ ID NO: 8493 - protein, 195 aa, Artificial Sequence
  Description of Artificial Sequence: Synthetic coding sequence
MLSRVVLSAAATAGPYVLGTGLILYALSKEIYVISAETFTALSVLGVMVYGIKKYGPFVADFADKLNEQKLAQLEEAKQASIQHIQNAIDTEKSQQALVQKRHYLFDVQRNNIAMALEVTYRERLYRVYKEVKNRLDYHISVQNMMRRKEQEHMINWVEKHVVQSISTQQEKETIAKCIADLKLLAKKAQAQPVM

SEQ ID NO: 8494 - protein, 161 aa, Artificial Sequence
  Description of Artificial Sequence: Synthetic coding sequence
MAGRKLALKTIDWVAFAEIIPQNQKAIASSLKSWNETLTSRLAALPENPPAIDWAYYKANVAKAGLVDDFEKKFNALKVPVPEDKYTAQVDAEEKEDVKSCAEWVSLSKARIVEYEKEMEKMKNLIPFDQMTIEDLNEAFPETKLDKKKYPYWPHQPIENL

SEQ ID NO: 8495 - protein, 137 aa, Artificial Sequence
  Description of Artificial Sequence: Synthetic coding sequence
MAGRKLALKTIDWVAFAEIIPQNQKAIASSLKSWNETLTSRLAALPENPPAIDWAYYKANVAKAGLVDDFEKKVKSCAEWVSLSKARIVEYEKEMEKMKNLIPFDQMTIEDLNEAFPETKLDKKKYPYWPHQPIENL

SEQ ID NO: 8496 - protein, 102 aa, Artificial Sequence
  Description of Artificial Sequence: Synthetic coding sequence
MAGRKLALKTIDWVAFAEIIPQNQKAIASSLKSWNETLTSRLAALPENPPAIDWAYYKANVAKAGLVDDFEKKFNALKVPVPEDKYTAQVDAEEKEDKKKKK

SEQ ID NO: 8497 - protein, 94 aa, Artificial Sequence
  Description of Artificial Sequence: Synthetic coding sequence
MASVGECPAPVPVKDKKLLEVKLGELPSWILMRDFSPSGIFGAFQRGYYRYYNKYINVKKGSISGITMVLACYVLFSYSFSYKHLKHERLRKYH

SEQ ID NO: 8498 - protein, 55 aa, Artificial Sequence
  Description of Artificial Sequence: Synthetic coding sequence
MASVGECPAPVPVKDKKLLEVKLGELPSWILMRDFSPSGIFGAFQREHERLRKYH

SEQ ID NO: 8499 - protein, 88 aa, Artificial Sequence
  Description of Artificial Sequence: Synthetic coding sequence
MASVVPVKDKKLLEVKLGELPSWILMRDFSPSGIFGAFQRGYYRYYNKYINVKKGSISGITMVLACYVLFSYSFSYKHLKHERLRKYH

SEQ ID NO: 8500 - protein, 49 aa, Artificial Sequence
  Description of Artificial Sequence: Synthetic coding sequence
MASVVPVKDKKLLEVKLGELPSWILMRDFSPSGIFGAFQREHERLRKYH

SEQ ID NO: 8501 - protein, 88 aa, Artificial Sequence
  Description of Artificial Sequence: Synthetic coding sequence
MSSKLPVKDKKLLEVKLGELPSWILMRDFSPSGIFGAFQRGYYRYYNKYINVKKGSISGITMVLACYVLFSYSFSYKHLKHERLRKYH

SEQ ID NO: 8502 - protein, 103 aa, Artificial Sequence
  Description of Artificial Sequence: Synthetic coding sequence
MAQFVRNLVEKTPALVNAAVTYSKPRLATFWYYAKVELVPPTPAEIPRAIQSLKKIVNSAQTGSFKQLTVKEAVLNGLVATEVLMWFYVGEIIGKRGIIGYDV

SEQ ID NO: 8503 - protein, 100 aa, Artificial Sequence
  Description of Artificial Sequence: Synthetic coding sequence
MAPFVRNLVEKTPALVNAAVTYLKPRLAAFWYYTTVELVPPTPAEIPRAIQSLKKIVSSAQTGSFKQLTVKEALLNGLVATEVSTWFYVREITGKRGIIG

SEQ ID NO: 8504 - protein, 215 aa, Artificial Sequence
  Description of Artificial Sequence: Synthetic coding sequence
MCCAVSEQRLTCADQMMPFGKISQQLCGVKKLPWSCDSRYFWGWLNAVFNKVDYDRIRDVGPDRAASEWLLRCGAMVRYHGQERWQKDYNHLPTGPLDKYKIQAIDATDSCIMSIGFDHMEGLEHVEKIRLCKCHYIEDDCLLRLSQLENLQKTILEMEIISCGNITDKGIIALRHLRNLKYLLLSDLPGVREKENLVQAFKTALPSLELKLQLK

SEQ ID NO: 8505 - protein, 266 aa, Artificial Sequence
  Description of Artificial Sequence: Synthetic coding sequence
MIRGSGAEACSNEDGCSEKGMKGVDYDRIRDVGPDRAASEWLLRCGAMVRYHGQERWQKDYNHLPTGPLDKYKIQAIDATDSCIMSIGFDHMEGLEHVEKIRLCKCHYIEDDCLLRLSQLENLQKTILEMEIISCGNITDKGIIALRHLRNLKYLLLSDLPGAGNPGPCVASGSSRTRAPLGFRERGLQETDVPGALVDRSYDLSPSAGMRMLELKATTAILKSRFQLSVPGGSLLFKQSPVGHSSISFWPYKAILRQSRAGDNQE

SEQ ID NO: 8506 - protein, 147 aa, Artificial Sequence
  Description of Artificial Sequence: Synthetic coding sequence
MAGRGKLIAVIGDEDTVTGFLLGGIGELNKNRHPNFLVVEKDTTINEIEDTFRSLGSLPGSVVEANPNQRDPPLWDEIDSRQFLNRDDIGIILINQYIAEMVRHALDAHQQSIPAVLEIPSKEHPYDAAKDSILRRARGMFTAEDLR

SEQ ID NO: 8507 - protein, 106 aa, Artificial Sequence
  Description of Artificial Sequence: Synthetic coding sequence
MAVTALAARTWLGVWGVRTMQARGFGSDQSENVDRGAGSIREAGGAFGKREQAEEERYFRAQSREQLAALKKHHEEEIVHHKKEIERLQKEIERHKQKIKMLKHDD

SEQ ID NO: 8508 - protein, 60 aa, Artificial Sequence
  Description of Artificial Sequence: Synthetic coding sequence
MAVTALAARTWLGVWGVRTMQARGFGSDQSENVDRGAGSIREAGGAFGKREQAEEERYFR

SEQ ID NO: 8509 - protein, 71 aa, Artificial Sequence
  Description of Artificial Sequence: Synthetic coding sequence
MAVTALAARTWLGVWGVRTMQARGFGSDQSENVDRGAGSIREAGGAFGKREQAEEERYFRHYRLCFEISLG

SEQ ID NO: 8510 - protein, 1086 aa, Artificial Sequence
  Description of Artificial Sequence: Synthetic coding sequence
MEKWEELNSHQPGEEYDPSKATFVKVVPTPNNGSTELVALHRNEGEDGLEVLSFEFQKIKYSYDALEKKQFLPVAFPVGNAFSYYQSNRGFQEDSEIRAAEKKFGSNKAEMVVPDFSELFKERATAPFFVFQVFCVGLWCLDEYWYYSVFTLSMLVAFEASLVQQQMRNMSEIRKMGNKPHMIQVYRSRKWRPIASDEIVPGDIVSIGRSPQENLVPCDVLLLRGRCIVDEAMLTGESVPQMKEPIEDLSPDRVLDLQADSRLHVIFGGTKVVQHIPPQKATTGLKPVDSGCVAYVLRTGFNTSQGKLLRTILFGVKRVTANNLETFIFILFLLVFAIAAAAYVWIEGTKDPSRNRYKLFLECTLILTSVVPPELPIELSLAVNTSLIALAKLYMYCTEPFRIPFAGKVEVCCFDKTGTLTSDSLVVRGVAGLRDGKEVTPVSSIPVETHRALASCHSLMQLDDGTLVGDPLEKAMLTAVDWTLTKDEKVFPRSIKTQGLKIHQRFHFASALKRMSVLASYEKLGSTDLCYIAAVKGAPETLHSMFSQCPPDYHHIHTEISREGARVLALGYKELGHLTHQQAREVKREALECSLKFVGFIVVSCPLKADSKAVIREIQNASHRVVMITGDNPLTACHVAQELHFIEKAHTLILQPPSEKGRQCEWRSIDGSIVLPLARGSPKALALEYALCLTGDGLAHLQATDPQQLLRLIPHVQVFARVAPKQKEFVITSLKELGYVTLMCGDGTNDVGALKHADVGVALLANAPERVVERRRRPRDSPTLSNSGIRATSRTAKQRSGLPPSEEQPTSQRDRLSQVLRDLEDESTPIVKLGDASIAAPFTSKLSSIQCICHVIKQGRCTLVTTLQMFKILALNALILAYSQSVLYLEGVKFSDFQATLQGLLLAGCFLFISRSKPLKTLSRERPLPNIFNLYTILTVMLQFFVHFLSLVYLYREAQARSPEKQEQFVDLYKEFEPSLVNSTVYIMAMAMQMATFAINYKGPPFMESLPENKPLVWSLAVSLLAIIGLLLGSSPDFNSQFGLVDIPVEFKLVIAQVLLLDFCLALLADRVLQFFLGTPKLKVPS

SEQ ID NO: 8511 - protein, 1204 aa, Artificial Sequence
  Description of Artificial Sequence: Synthetic coding sequence
MAAAAAVGNAVPCGARPCGVRPDGQPKPGPQPRALLAAGPALIANGDELVAAVWPYRRLALLRRLTVLPFAGLLYPAWLGAAAAGCWGWGSSWVQIPEAALLVLATICLAHALTVLSGHWSVHAHCALTCTPEYDPSKATFVKVVPTPNNGSTELVALHRNEGEDGLEVLSFEFQKIKYSYDALEKKQFLPVAFPVGNAFSYYQSNRGFQEDSEIRAAEKKFGSNKAEMVVPDFSELFKERATAPFFVFQVFCVGLWCLDEYWYYSVFTLSMLVAFEASLVQQQMRNMSEIRKMGNKPHMIQVYRSRKWRPIASDEIVPGDIVSIGRSPQENLVPCDVLLLRGRCIVDEAMLTGESVPQMKEPIEDLSPDRVLDLQADSRLHVIFGGTKVVQHIPPQKATTGLKPVDSGCVAYVLRTGFNTSQGKLLRTILFGVKRVTANNLETFIFILFLLVFAIAAAAYVWIEGTKDPSRNRYKLFLECTLILTSVVPPELPIELSLAVNTSLIALAKLYMYCTEPFRIPFAGKVEVCCFDKTGTLTSDSLVVRGVAGLRDGKEVTPVSSIPVETHRALASCHSLMQLDDGTLVGDPLEKAMLTAVDWTLTKDEKVFPRSIKTQGLKIHQRFHFASALKRMSVLASYEKLGSTDLCYIAAVKGAPETLHSMFSQCPPDYHHIHTEISREGARVLALGYKELGHLTHQQAREVKREALECSLKFVGFIVVSCPLKADSKAVIREIQNASHRVVMITGDNPLTACHVAQELHFIEKAHTLILQPPSEKGRQCEWRSIDGSIVLPLARGSPKALALEYALCLTGDGLAHLQATDPQQLLRLIPHVQVFARVAPKQKEFVITSLKELGYVTLMCGDGTNDVGALKHADVGVALLANAPERVVERRRRPRDSPTLSNSGIRATSRTAKQRSGLPPSEEQPTSQRDRLSQVLRDLEDESTPIVKLGDASIAAPFTSKLSSIQCICHVIKQGRCTLVTTLQMFKILALNALILAYSQSVLYLEGVKFSDFQATLQGLLLAGCFLFISRSKPLKTLSRERPLPNIFNLYTILTVMLQFFVHFLSLVYLYREAQARSPEKQEQFVDLYKEFEPSLVNSTVYIMAMAMQMATFAINYKGPPFMESLPENKPLVWSLAVSLLAIIGLLLGSSPDFNSQFGLVDIPVEFKLVIAQVLLLDFCLALLADRVLQFFLGTPKLKVPS

SEQ ID NO: 8512 - protein, 1226 aa, Artificial Sequence
  Description of Artificial Sequence: Synthetic coding sequence
MDREERKTINQGQEDEMEIYGYNLSRWKLAIVSLGVICSGGFLLLLLYWMPEWRVKATCVRAAIKDCEVVLLRTTDEFKMWFCAKIRVLSLETYPVSSPKSMSNKLSNGHAVCLIENPTEENRHRISKYSQTESQQIRYFTHHSVKYFWNDTIHNFDFLKGLDEGVSCTSIYEKHSAGLTKGMHAYRKLLYGVNEIAVKVPSVFKLLIKEVLNPFYIFQLFSVILWSTDEYYYYALAIVVMSIVSIVSSLYSIRKQYVMLHDMVATHSTVRVSVCRVNEEIEEIFSTDLVPGDVMVIPLNGTIMPCDAVLINGTCIVNESMLTGESVPVTKTNLPNPSVDVKGIGDELYNPETHKRHTLFCGTTVIQTRFYTGELVKAIVVRTGFSTSKGQLVRSILYPKPTDFKLYRDAYLFLLCLVAVAGIGFIYTIINSILNEVQVGVIIIESLDIITITVPPALPAAMTAGIVYAQRRLKKIGIFCISPQRINICGQLNLVCFDKTGTLTEDGLDLWGIQRVENARFLSPEENVCNEMLVKSQFVACMATCHSLTKIEGVLSGDPLDLKMFEAIGWILEEATEEETALHNRIMPTVVRPPKQLLPESTPAGNQEMELFELPATYEIGIVRQFPFSSALQRMSVVARVLGDRKMDAYMKGAPEAIAGLCKPETVPVDFQNVLEDFTKQGFRVIALAHRKLESKLTWHKVQNISRDAIENNMDFMGLIIMQNKLKQETPAVLEDLHKANIRTVMVTGDSMLTAVSVARDCGMILPQDKVIIAEALPPKDGKVAKINWHYADSLTQCSHPSAIDPEAIPVKLVHDSLEDLQMTRYHFAMNGKSFSVILEHFQDLVPKLMLHGTVFARMAPDQKTQLIEALQNVDYFVGMCGDGANDCGALKRAHGGISLSELEASVASPFTSKTPSISCVPNLIREGRAALITSFCVFKFMALYSIIQYFSVTLLYSILSNLGDFQFLFIDLAIILVVVFTMSLNPAWKELVAQRPPSGLISGALLFSVLSQIIICIGFQSLGFFWVKQQPWYEVWHPKSDACNTTGSGFWNSSHVDNETELDEHNIQNYENTTVFFISSFQYLIVAIAFSKGKPFRQPCYKNYFFVFSVIFLYIFILFIMLYPVASVDQVLQIVCVPYQWRVTMLIIVLVNAFVSITVEESVDRWGKCCLPWALGCRKKTPKAKYMYLAQELLVDPEWPPKPQTTTEAKALVKENGSCQIITIT

SEQ ID NO: 8513 - protein, 716 aa, Artificial Sequence
  Description of Artificial Sequence: Synthetic coding sequence
MVATHSTVRVSVCRVNEEIEEIFSTDLVPGDVMVIPLNGTIMPCDAVLINGTCIVNESMLTGESVPVTKTNLPNPSVDVKGIGDELYNPETHKRHTLFCGTTVIQTRFYTGELVKAIVVRTGFSTSKGQLVRSILYPKPTDFKLYRDAYLFLLCLVAVAGIGFIYTIINSILNEVQVGVIIIESLDIITITVPPALPAAMTAGIVYAQRRLKKIGIFCISPQRINICGQLNLVCFDKTGTLTEDGLDLWGIQRVENARFLSPEENVCNEMLVKSQFVACMATCHSLTKIEGVLSGDPLDLKMFEAIGWILEEATEEETALHNRIMPTVVRPPKQLLPESTPAGNQEMELFELPATYEIGIVRQFPFSSALQRMSVVARVLGDRKMDAYMKGAPEAIAGLCKPETVPVDFQNVLEDFTKQGFRVIALAHRKLESKLTWHKVQNISRDAIENNMDFMGLIIMQNKLKQETPAVLEDLHKANIRTVMVTGDSMLTAVSVARDCGMILPQDKVIIAEALPPKDGKVAKINWHYADSLTQCSHPSAIDPEAIPVKLVHDSLEDLQMTRYHFAMNGKSFSVILEHFQDLVPKLMLHGTVFARMAPDQKTQLIEALQNVDYFVGMCGDGANDCGALKRAHGGISLSELEASVASPFTSKTPSISCVPNLIREGRAALITSFCELALFSIVTYSLDHFIISILISNMLVLFFSDFHNCAFYSLV

SEQ ID NO: 8514 - protein, 1226 aa, Artificial Sequence; identical to SEQ ID NO: 8512
  Description of Artificial Sequence: Synthetic coding sequence

SEQ ID NO: 8515 - protein, 47 aa, Artificial Sequence
  Description of Artificial Sequence: Synthetic coding sequence
MDREERKTINQGQEDEMEIYGYNLSRWKLAIVSLGVICSGGFLLLLL

SEQ ID NO: 8516 - protein, 103 aa, Artificial Sequence
  Description of Artificial Sequence: Synthetic coding sequence
MDREERKTINQGQEDEMEIYGYNLSRWKLAIVSLGVICSGGFLLLLLYWMPEWRVKATCVRAAIKDCEVVLLRTTDEFKMWFCAKIRVLSLETYPVSSPKSMS

SEQ ID NO: 8517 - protein, 576 aa, Artificial Sequence
  Description of Artificial Sequence: Synthetic coding sequence
MGHFEKGQHALLNEGEENEMEIFGYRTQGCRKSLCLAGSIFSFGILPLVFYWRPAWHVWAHCVPCSLQEADTVLLRTTDEFQIYSWKKVIWIYLSALNSAFGLTPDHPLMTDEEYIINRAIRKPDLKVRCIKVQKIRYVWNYLEGQFQKIGSLEDWLSSAKIHQKFGSGLTREEQEIRRLICGPNTIDVEVTPIWKLLIKEVLNPFYIFQLFSVCLWFSEDYKEYAFAIIIMSIISISLTVYDLREQSVKLHHLVESHNSITVSVCGRKAGVQELESRVLVPGDLLILTGNKVLMPCDAVLIEGSCVVDEGMLTGESIPVTKTPLPKMDSSVPWKTQSEADYKRHVLFCGTEVIQAKAACSGTVRAVVLQTGFNTAKGDLVRSILYPKPVNFQLYRDAIRFLLCLVGTATIGMIYTLCVYVLSGEPPEEVVRKALDVITIAVPPALPAALTTGIIYAQRRLKKRGIFCISPQRINVCGQLNLVCFDKTGTLTRDGLDLWGVVSCDRNGFQEVHSFASGQALPWGPLCAAMASCHSLILLDGTIQGDPLDLKMFEATTWVSLCSSENLRSFFNARAT

SEQ ID NO: 8518 - protein, 1196 aa, Artificial Sequence
  Description of Artificial Sequence: Synthetic coding sequence
MGHFEKGQHALLNEGEENEMEIFGYRTQGCRKSLCLAGSIFSFGILPLVFYWRPAWHVWAHCVPCSLQEADTVLLRTTDEFQIYSWKKVIWIYLSALNSAFGLTPDHPLMTDEEYIINRAIRKPDLKVRCIKVQKIRYVWNYLEGQFQKIGSLEDWLSSAKIHQKFGSGLTREEQEIRRLICGPNTIDVEVTPIWKLLIKEVLNPFYIFQLFSVCLWFSEDYKEYAFAIIIMSIISISLTVYDLREQSVKLHHLVESHNSITVSVCGRKAGVQELESRVLVPGDLLILTGNKVLMPCDAVLIEGSCVVDEGMLTGESIPVTKTPLPKMDSSVPWKTQSEADYKRHVLFCGTEVIQAKAACSGTVRAVVLQTGFNTAKGDLVRSILYPKPVNFQLYRDAIRFLLCLVGTATIGMIYTLCVYVLSGEPPEEVVRKALDVITIAVPPALPAALTTGIIYAQRRLKKRGIFCISPQRINVCGQLNLVCFDKTGTLTRDGLDLWGVVSCDRNGFQEVHSFASGQALPWGPLCAAMASCHSLILLDGTIQGDPLDLKMFEATTWEMAFSGDDFHIKGVPAHAMVVKPCRTASQVPVEGIAILHQFPFSSALQRMTVIVQEMGGDRLAFMKGAPERVASFCQPETVPTSFVSELQIYTTQGFRVIALAYKKLENDHHATTLTRETVESDLIFLGLLILENRLKEETKPVLEELISARIRTVMITGDNLQTAITVARKSGMVSESQKVILIEANETTGSSSASISWTLVEEKKHIMYGNQDNYINIRDEVSDKGREGSYHFALTGKSFHVISQHFSSLLPKILINGTIFARMSPGQKSSLVEEFQKLDYFVGMCGDGANDCGALKMAHVGISLSEQEASVASPFTSKTPNIECVPHLIKEGRAALVTSFCMFKYMALYSMIQYVGVLLLYWETNSLSNYQFLFQDLAITTLIGVTMNLNGAYPKLVPFRPAGRLISPPLLLSVIFNILLSLAMHIAGFILVQRQPWYSVEIHSACTVQNESISELTMSPTAPEKMESNSTFTSFENTTVWFLGTINCITVALVFSKGKPFRQPTYTNYIFVLVLIIQLGVCLFILFADIPELYRRLDLLCTPVLWRASIVIMLSLNFIVSLVAEEAVIENRALWMMIKRCFGYQSKSQYRIWQRDLANDPSWPPLNQTSHSDMPECGRGVSYSNPVFESNEEQL

SEQ ID NO: 8519 - protein, 212 aa, Artificial Sequence
  Description of Artificial Sequence: Synthetic coding sequence
MHIAGFILVQRQPWYSVEIHSACTVQNESISELTMSPTAPEKMESNSTFTSFENTTVWFLGTINCITVALVFSKGKPFRQPTYTNYIFVLVLIIQLGVCLFILFADIPELYRRLDLLCTPVLWRASIVIMLSLNFIVSLVAEEAVIENRALWMMIKRCFGYQSKSQYRIWQRDLANDPSWPPLNQTSHSDMPECGRGVSYSNPVFESNEEQL

SEQ ID NO: 8520 - protein, 1218 aa, Artificial Sequence
  Description of Artificial Sequence: Synthetic coding sequence
MEENSKKDHRALLNQGEEDELEVFGYRDHNVRKAFCLVASVLTCGGLLLVFYWRPQWRVWANCIPCPLQEADTVLLRTTDEFQRYMRKKVFCLYLSTLKFPVSKKWEESLVADRHSVINQALIKPELKLRCMEVQKIRYVWNDLEKRFQKVGLLEDSNSCSDIHQTFGLGLTSEEQEVRRLVCGPNAIEVEIQPIWKLLVKQVLNPFYVFQAFTLTLWLSQGYIEYSVAIIILTVISIVLSVYDLRQQSVKLHNLVEDHNKVQVTIIVKDKGLEELESRLLVPGDILILPGKFSLPCDAVLIDGSCVVNEGMLTGESIPVTKTPLPQMENTMPWKCHSLEDYRKHVLFCGTEVIQVKPSGQGPVRAVVLQTGYNTAKGDLVRSILYPRPLNFKLYSDAFKFIVFLACLGVMGFFYALGVYMYHGVPPKDTVTMALILLTVTVPPVLPAALTIGNVYAQKRLKKKKIFCISPQRINMCGQINLVCFDKTGTLTEDGLDLWGTVPTADNCFQEAHSFASGQAVPWSPLCAAMASCHSLILLNGTIQGDPLDLKMFEGTAWKMEDCIVDSCKFGTSVSNIIKPGPKASKSPVEAIITLCQFPFSSSLQRMSVIAQLAGENHFHVYMKGAPEMVARFCRSETVPKNFPQELRSYTVQGFRVIALAHKTLKMGNLSEVEHLAREKVESELTFLGLLIMENRLKKETKLVLKELSEARIRTVMITGDNLQTAITVAKNSEMIPPGSQVIIVEADEPEEFVPASVTWQLVENQETGPGKKEIYMHTGNSSTPRGEGGSCYHFAMSGKSYQVIFQHFNSLLPKILVNGTVFARMSPGQKSSLIEEFQKLNYYVGMCGDGANDCGALKAAHAGISLSEQEASVASPFTSKTTNIQCVPHLIREGRAALVSSFGVFKYLTMYGIIQFISALLLYWQLQLFGNYQYLMQDVAITLMVCLTMSSTHAYPKLAPYRPAGQLLSPPLLLSIFLNSCFSCIVQISAFLYVKQQPWYCEVYQYSECFLANQSNFSTNVSLERNWTGNATLIPGSILSFETTTLWPITTINYITVAFIFSKGKPFRKPIYTNYIFSFLLLAALGLTIFILFSDFQVIYRGMELIPTITSWRVLILVVALTQFCVAFFVEDSILQNHELWLLIKREFGFYSKSQYRTWQKKLAEDSTWPPINRTDYSGDGKNGFYINGGYESHEQIPKRKLKLGGQPTEQHFWARL

SEQ ID NO: 8521 - protein, 1149 aa, Artificial Sequence
  Description of Artificial Sequence: Synthetic coding sequence
MPTMRRTVSEIRSRAEGYEKTDDVSEKTSLADQEEVRTIFINQPQLTKFCNNHVSTAKYNIITFLPRFLYSQFRRAANSFFLFIALLQQIPDVSPTGRYTTLVPLLFILAVAAIKEIIEDIKRHKADNAVNKKQTQVLRNGAWEIVHWEKVNVGDIVIIKGKEYIPADTVLLSSSEPQAMCYIETSNLDGETNLKIRQGLPATSDIKDVDSLMRISGRIECESPNRHLYDFVGNIRLDGHGTVPLGADQILLRGAQLRNTQWVHGIVVYTGHDTKLMQNSTSPPLKLSNVERITNVQILILFCILIAMSLVCSVGSAIWNRRHSGKDWYLNLNYGGASNFGLNFLTFIILFNNLIPISLLVTLEVVKFTQAYFINWDLDMHYEPTDTAAMARTSNLNEELGQVKYIFSDKTGTLTCNVMQFKKCTIAGVAYGQNSQFGDEKTFSDSSLLENLQNNHPTAPIICEFLTMMAVCHTAVPEREGDKIIYQAASPDEGALVRAAKQLNFVFTGRTPDSVIIDSLGQEERYELLNVLEFTSARKRMSVIVRTPSGKLRLYCKGADTVIYDRLAETSKYKEITLKHLEQFATEGLRTLCFAVAEISESDFQEWRAVYQRASTSVQNRLLKLEESYELIEKNLQLLGATAIEDKLQDQVPETIETLMKADIKIWILTGDKQETAINIGHSCKLLKKNMGMIVINEGSLDGTRETLSRHCTTLGDALRKENDFALIIDGKTLKYALTFGVRQYFLDLALSCKAVICCRVSPLQKSEVVEMVKKQVKVVTLAIGDGANDVSMIQTAHVGVGISGNEGLQAANSSDYSIAQFKYLKNLLMIHGAWNYNRVSKCILYCFYKNIVLYIIEIWFAFVNGFSGQILFERWCIGLYNVMFTAMPPLTLGIFERSCRKENMLKYPELYKTSQNALDFNTKVFWVHCLNGLFHSVILFWFPLKALQYGTAFGNGKTSDYLLLGNFVYTFVVITVCLKAGLETSYWTWFSHIAIWGSIALWVVFFGIYSSLWPAIPMAPDMSGEAAMLFSSGVFWMGLLFIPVASLLLDVVYKVIKRTAFKTLVDEVQELEAKSQDPGAVVLGKSLTERAQLLKNVFKKNHVNLYRSESLQQNLLHGYAFSQDENGIVSQSEVIRAYDTTKQRPDEW

SEQ ID NO: 8522 - protein, 1164 aa, Artificial Sequence
  Description of Artificial Sequence: Synthetic coding sequence
MPTMRRTVSEIRSRAEGYEKTDDVSEKTSLADQEEVRTIFINQPQLTKFCNNHVSTAKYNIITFLPRFLYSQFRRAANSFFLFIALLQQIPDVSPTGRYTTLVPLLFILAVAAIKEIIEDIKRHKADNAVNKKQTQVLRNGAWEIVHWEKVAVGEIVKVTNGEHLPADLISLSSSEPQAMCYIETSNLDGETNLKIRQGLPATSDIKDVDSLMRISGRIECESPNRHLYDFVGNIRLDGHGTVPLGADQILLRGAQLRNTQWVHGIVVYTGHDTKLMQNSTSPPLKLSNVERITNVQILILFCILIAMSLVCSVGSAIWNRRHSGKDWYLNLNYGGASNFGLNFLTFIILFNNLIPISLLVTLEVVKFTQAYFINWDLDMHYEPTDTAAMARTSNLNEELGQVKYIFSDKTGTLTCNVMQFKKCTIAGVAYGHVPEPEDYGCSPDEWQNSQFGDEKTFSDSSLLENLQNNHPTAPIICEFLTMMAVCHTAVPEREGDKIIYQAASPDEGALVRAAKQLNFVFTGRTPDSVIIDSLGQEERYELLNVLEFTSARKRMSVIVRTPSGKLRLYCKGADTVIYDRLAETSKYKEITLKHLEQFATEGLRTLCFAVAEISESDFQEWRAVYQRASTSVQNRLLKLEESYELIEKNLQLLGATAIEDKLQDQVPETIETLMKADIKIWILTGDKQETAINIGHSCKLLKKNMGMIVINEGSLDGTRETLSRHCTTLGDALRKENDFALIIDGKTLKYALTFGVRQYFLDLALSCKAVICCRVSPLQKSEVVEMVKKQVKVVTLAIGDGANDVSMIQTAHVGVGISGNEGLQAANSSDYSIAQFKYLKNLLMIHGAWNYNRVSKCILYCFYKNIVLYIIEIWFAFVNGFSGQILFERWCIGLYNVMFTAMPPLTLGIFERSCRKENMLKYPELYKTSQNALDFNTKVFWVHCLNGLFHSVILFWFPLKALQYGTAFGNGKTSDYLLLGNFVYTFVVITVCLKAGLETSYWTWFSHIAIWGSIALWVVFFGIYSSLWPAIPMAPDMSGEAAMLFSSGVFWMGLLFIPVASLLLDVVYKVIKRTAFKTLVDEVQELEAKSQDPGAVVLGKSLTERAQLLKNVFKKNHVNLYRSESLQQNLLHGYAFSQDENGIVSQSEVIRAYDTTKQRPDEW

SEQ ID NO: 8523 - protein, 1192 aa, Artificial Sequence
  Description of Artificial Sequence: Synthetic coding sequence
MFCSEKKLREVERIVKANDREYNEKFQYADNRIHTSKYNILTFLPINLFEQFQRVANAYFLCLLILQLIPEISSLTWFTTIVPLVLVITMTAVKDATDDYFRHKSDNQVNNRQSEVLINSKLQNEKWMNVKVGDIIKLENNQFVAADLLLLSSSEPHGLCYVETAELDGETNLKVRHALSVTSELGADISRLAGFDGIVVCEVPNNKLDKFMGILSWKDSKHSLNNEKIILRGCILRNTSWCFGMVIFAGPDTKLMQNSGKTKFKRTSIDRLMNTLVLWIFGFLICLGIILAIGNSIWESQTGDQFRTFLFWNEGEKSSVFSGFLTFWSYIIILNTVVPISLYVSVEVIRLGHSYFINWDRKMYYSRKAIPAVARTTTLNEELGQIEYIFSDKTGTLTQNIMTFKRCSINGRIYGEVHDDLDQKTEITQEKEPVDFSVKSQADREFQFFDHHLMESIKMGDPKVHEFLRLLALCHTVMSEENSAGELIYQVQSPDEGALVTAARNFGFIFKSRTPETITIEELGTLVTYQLLAFLDFNNTRKRMSVIVRNPEGQIKLYSKGADTILFEKLHPSNEVLLSLTSDHLSEFAGEGLRTLAIAYRDLDDKYFKEWHKMLEDANAATEERDERIAGLYEEIERDLMLLGATAVEDKLQEGVIETVTSLSLANIKIWVLTGDKQETAINIGYACNMLTDDMNDVFVIAGNNAVEVREELRKAKQNLFGQNRNFSNGHVVCEKKQQLELDSIVEETITGDYALIINGHSLAHALESDVKNDLLELACMCKTVICCRVTPLQKAQVVELVKKYRNAVTLAIGDGANDVSMIKSAHIGVGISGQEGLQAVLASDYSFAQFRYLQRLLLVHGRWSYFRMCKFLCYFFYKNFAFTLVHFWFGFFCGFSAQTVYDQWFITLFNIVYTSLPVLAMGIFDQDVSDQNSVDCPQLYKPGQLNLLFNKRKFFICVLHGIYTSLVLFFIPYGAFYNVAGEDGQHIADYQSFAVTMATSLVIVVSVQIALDTSYWTFINHVFIWGSIAIYFSILFTMHSNGIFGIFPNQFPFVGNARHSLTQKCIWLVILLTTVASVMPVVAFRFLKVDLYPTLSDQIRRWQKAQKKARPPSSRRPRTRRSSSRRSGYAFAHQEGYGELITSGKNMRAKNPPPTSGLEKTHYNSTSWIENLCKKTTDTVSSFSQDKTVKL

SEQ ID NO: 8524 - protein, 53 aa, Artificial Sequence
  Description of Artificial Sequence: Synthetic coding sequence
MFCSEKKLREVERIVKANDREYNEKFQYADNRIHTSKYNILTFLPINLFEQFQ

SEQ ID NO: 8525 - protein, 1192 aa, Artificial Sequence; identical to SEQ ID NO: 8523
  Description of Artificial Sequence: Synthetic coding sequence

SEQ ID NO: 8526 - protein, 911 aa, Artificial Sequence
  Description of Artificial Sequence: Synthetic coding sequence
MDSRPRAGCCEWLRCCGGGEARPRTVWLGHPEKRDQRYPRNVINNQKYNFFTFLPGVLFNQFKYFFNLYFLLLACSQFVPEMRLGALYTYWVPLGFVLAVTVIREAVEEIRCYVRDKEVNSQVYSRLTARGTVVGVVLYTGRELRSVMNTSNPRSKIGLFDLEVNCLTKILFGALVVVSLVMVALQHFAGRWYLQIIRFLLLFSNIIPISLRVNLDMGKIVYSWVIRRDSKIPGTVVRSSTIPEQLGRISYLLTDKTGTLTQNEMIFKRLHLGTVAYGLDSMDEVQSHIFSIYTQQSQDPPAQKGPTLTTKVRRTMSSRVHEAVKAIALCHNVTPVYESNGVTDQAEAEKQYEDSCRVYQASSPDEVALVQWTESVGLTLVGRDQSSMQLRTPGDQILNFTILQIFPFTYESKRMGIIVRDESTGEITFYMKGADVVMAGIVQYNDWLEEECGNMAREGLRVLVVAKKSLAEEQYQDFEARYVQAKLSVHDRSLKVATVIESLEMEMELLCLTGVEDQLQADVRPTLETLRNAGIKVWMLTGDKLETATCTAKNAHLVTRNQDIHVFRLVTNRGEAHLELNAFRRKHDCALVISGDSLEVCLKYYEYEFMELACQCPAVVCCRCAPTQKAQIVRLLQERTGKLTCAVGDGGNDVSMIQESDCGVGVEGKEGKQASLAADFSITQFKHLGRLLMVHGRNSYKRSAALSQFVIHRSLCISTMQAVFSSVFYFASVPLYQGFLIIGYSTIYTMFPVFSLVLDKDVKSEVAMLYPELYKDLLKGRPLSYKTFLIWVLISIYQGSTIMYGALLLFESEFVHIVAISFTSLILTELLMVALTIQTWHWLMTVAELLSLACYIASLVFLHEFIDVYFIATLSFLWKVSVITLVSCLPLYVLKYLRRRFSPPSYSKLTS

SEQ ID NO: 8527 - protein, 1047 aa, Artificial Sequence
  Description of Artificial Sequence: Synthetic coding sequence
MTDNIPLQPVRQKKRMDSRPRAGCCEWLRCCGGGEARPRTVWLGHPEKRDQRYPRNVINNQKYNFFTFLPGVLFNQFKYFFNLYFLLLACSQFVPEMRLGALYTYWVPLGFVLAVTVIREAVEEIRCYVRDKEVNSQVYSRLTARGTVKVKSSNIQVGDLIIVEKNQRVPADMIFLRTSEKNGSCFLRTDQLDGETDWKLRLPVACTQRLPTAADLLQIRSYVYAEEPNIDIHNFVGTFTREDSDPPISESLSIENTLWAGTVVASGTVVGVVLYTGRELRSVMNTSNPRSKIGLFDLEVNCLTKILFGALVVVSLVMVALQHFAGRWYLQIIRFLLLFSNIIPISLRVNLDMGKIVYSWVIRRDSKIPGTVVRSSTIPEQLGRISYLLTDKTGTLTQNEMIFKRLHLGTVAYGLDSMDEVQSHIFSIYTQQSQDPPAQKGPTLTTKVRRTMSSRVHEAVKAIALCHNVTPVYESNGVTDQAEAEKQYEDSCRVYQASSPDEVALVQWTESVGLTLVGRDQSSMQLRTPGDQILNFTILQIFPFTYESKRMGIIVRDESTGEITFYMKGADVVMAGIVQYNDWLEEECGNMAREGLRVLVVAKKSLAEEQYQDFEARYVQAKLSVHDRSLKVATVIESLEMEMELLCLTGVEDQLQADVRPTLETLRNAGIKVWMLTGDKLETATCTAKNAHLVTRNQDIHVFRLVTNRGEAHLELNAFRRKHDCALVISGDSLEVCLKYYEYEFMELACQCPAVVCCRCAPTQKAQIVRLLQERTGKLTCAVGDGGNDVSMIQESDCGVGVEGKEGKQASLAADFSITQFKHLGRLLMVHGRNSYKRSAALSQFVIHRSLCISTMQAVFSSVFYFASVPLYQGFLIIGYSTIYTMFPVFSLVLDKDVKSEVAMLYPELYKDLLKGRPLSYKTFLIWVLISIYQGSTIMYGALLLFESEFVHIVAISFTSLILTELLMVALTIQTWHWLMTVAELLSLACYIASLVFLHEFIDVYFIATLSFLWKVSVITLVSCLPLYVLKYLRRRFSPPSYSKLTS

SEQ ID NO: 8528 - protein, 926 aa, Artificial Sequence
  Description of Artificial Sequence: Synthetic coding sequence
MTDNIPLQPVRQKKRMDSRPRAGCCEWLRCCGGGEARPRTVWLGHPEKRDQRYPRNVINNQKYNFFTFLPGVLFNQFKYFFNLYFLLLACSQFVPEMRLGALYTYWVPLGFVLAVTVIREAVEEIRCYVRDKEVNSQVYSRLTARGTVVGVVLYTGRELRSVMNTSNPRSKIGLFDLEVNCLTKILFGALVVVSLVMVALQHFAGRWYLQIIRFLLLFSNIIPISLRVNLDMGKIVYSWVIRRDSKIPGTVVRSSTIPEQLGRISYLLTDKTGTLTQNEMIFKRLHLGTVAYGLDSMDEVQSHIFSIYTQQSQDPPAQKGPTLTTKVRRTMSSRVHEAVKAIALCHNVTPVYESNGVTDQAEAEKQYEDSCRVYQASSPDEVALVQWTESVGLTLVGRDQSSMQLRTPGDQILNFTILQIFPFTYESKRMGIIVRDESTGEITFYMKGADVVMAGIVQYNDWLEEECGNMAREGLRVLVVAKKSLAEEQYQDFEARYVQAKLSVHDRSLKVATVIESLEMEMELLCLTGVEDQLQADVRPTLETLRNAGIKVWMLTGDKLETATCTAKNAHLVTRNQDIHVFRLVTNRGEAHLELNAFRRKHDCALVISGDSLEVCLKYYEYEFMELACQCPAVVCCRCAPTQKAQIVRLLQERTGKLTCAVGDGGNDVSMIQESDCGVGVEGKEGKQASLAADFSITQFKHLGRLLMVHGRNSYKRSAALSQFVIHRSLCISTMQAVFSSVFYFASVPLYQGFLIIGYSTIYTMFPVFSLVLDKDVKSEVAMLYPELYKDLLKGRPLSYKTFLIWVLISIYQGSTIMYGALLLFESEFVHIVAISFTSLILTELLMVALTIQTWHWLMTVAELLSLACYIASLVFLHEFIDVYFIATLSFLWKVSVITLVSCLPLYVLKYLRRRFSPPSYSKLTS

SEQ ID NO: 8529 - protein, 1461 aa, Artificial Sequence
  Description of Artificial Sequence: Synthetic coding sequence
MALSVDSSWHRWQWRVRDGFPHCPSETTPLLSPEKGRQSYNLTQQRVVFPNNSIFHQDWEEVSRRYPGNRTCTTKYTLFTFLPRNLFEQFHRWANLYFLFLVILNWMPSMEVFHREITMLPLAIVLFVIMIKDGMEDFKRHRFDKAINCSNIRIYERKEQTYVQKCWKDVRVGDFIQMKCNEIVPADILLLFSSDPNGICHLETASLDGETNLKQRCVVKGFSQQEVQFEPELFHNTIVCEKPNNHLNKFKGYMEHPDQTRTGFGCESLLLRGCTIRNTEMAVGIVIYAGHETKAMLNNSGPRYKRSKIERRMNIDIFFCIGILILMCLIGAVGHSIWNGTFEEHPPFDVPDANGSFLPSALGGFYMFLTMIILLQVLIPISLYVSIELVKLGQVFFLSNDLDLYDEETDLSIQCRALNIAEDLGQIQYIFSDKTGTLTENKMVFRRCTIMGSEYSHQENAKRLETPKELDSDGEEWTQYQCLSFSARWAQDPATMRSQKGAQPLRRSQSARVPIQGHYRQRSMGHRESSQPPVAFSSSIEKDVTPDKNLLTKVRDAALWLETLSDSRPAKASLSTTSSIADFFLALTICNSVMVSTTTEPRQRVTIKPSSKALGTSLEKIQQLFQKLKLLSLSQSFSSTAPSDTDLGESLGANVATTDSDERDDASVCSGGDSTDDGGYRSSMWDQGDILESGSGTSLEEALEAPATDLARPEFCYEAESPDEAALVHAAHAYSFTLVSRTPEQVTVRLPQGTCLTFSLLCTLGFDSVRKRMSVVVRHPLTGEIVVYTKGADSVIMDLLEDPACVPDINMEKKLRKIRARTQKHLDLYARDGLRTLCIAKKVVSEEDFRRWASFRREAEASLDNRDELLMETAQHLENQLTLLGATGIEDRLQEGVPDTIATLREAGIQLWVLTGDKQETAVNIAHSCRLLNQTDTVYTINTENQETCESILNCALEELKQFRELQKPDRKLFGFRLPSKTPSITSEAVVPEAGLVIDGKTLNAIFQGKLEKKFLELTQYCRSVLCCRSTPLQKSMIVKLVRDKLRVMTLSIGDGANDVSMIQAADIGIGISGQEGMQAVMSSDFAITRFKHLKKLLLVHGHWCYSRLARMVVYYLYKNVCYVNLLFWYQFFCGFSSSTMIDYWQMIFFNLFFTSLPPLVFGVLDKDISAETLLALPELYKSGQNSECYNLSTFWISMVDAFYQSLICFFIPYLAYKGSDIDVFTFGTPINTISLTTILLHQAMEMKTWTIFHGVVLLGSFLMYFLVSLLYNATCVICNSPTNPYWVMEGQLSNPTFYLVCFLTPVVALLPRYFFLSLQGTCGKSLISKAQKIDKLPPDKRNLEIQSWRSRQRPAPVPEVARPTHHPVSSITGQDFSASTPKSSNPPKRKHVEESVLHEQRCGTECMRDDSCSGDSSAQLSSGEHLLGPNRIMAYSRGQTDMCRCSKRSSHRRSQSSLTI

SEQ ID NO: 8530 - protein, 1426 aa, Artificial Sequence
  Description of Artificial Sequence: Synthetic coding sequence
MTEALQWARYHWRRLIRGATRDDDSGPYNYSSLLACGRKSSQTPKLSGRHRIVVPHIQPFKDEYEKFSGAYVNNRIRTTKYTLLNFVPRNLFEQFHRAANLYFLFLVVLNWVPLVEAFQKEITMLPLVVVLTIIAIKDGLEDYRKYKIDKQINNLITKVYSRKEKKYIDRCWKDVTVGDFIRLSCNEVIPADMVLLFSTDPDGICHIETSGLDGESNLKQRQVVRGYAEQDSEVDPEKFSSRIECESPNNDLSRFRGFLEHSNKERVGLSKENLLLRGCTIRNTEAVVGIVVYAGHETKAMLNNSGPRYKRSKLERRANTDVLWCVMLLVIMCLTGAVGHGIWLSRYEKMHFFNVPEPDGHIISPLLAGFYMFWTMIILLQVLIPISLYVSIEIVKLGQIYFIQSDVDFYNEKMDSIVQCRALNIAEDLGQIQYLFSDKTGTLTENKMVFRRCSVAGFDYCHEENARRLESYQEAVSEDEDFIDTVSGSLSNMAKPRAPSCRTVHNGPLGNKPSNHLAGSSFTLGSGEGASEVPHSRQAAFSSPIETDVVPDTRLLDKFSQITPRLFMPLDETIQNPPMETLYIIDFFIALAICNTVVVSAPNQPRQKIRHPSLGGLPIKSLEEIKSLFQRWSVRRSSSPSLNSGKEPSSGVPNAFVSRLPLFSRMKPASPVEEEVSQVCESPQCSSSSACCTETEKQHGDAGLLNGKAESLPGQPLACNLCYEAESPDEAALVYAARAYQCTLRSRTPEQVMVDFAALGPLTFQLLHILPFDSVRKRMSVVVRHPLSNQVVVYTKGADSVIMELLSVASPDGASLEKQQMIVREKTQKHLDDYAKQGLRTLCIAKKVMSDTEYAEWLRNHFLAETSIDNREELLLESAMRLENKLTLLGATGIEDRLQEGVPESIEALHKAGIKIWMLTGDKQETAVNIAYACKLLEPDDKLFILNTQSKDACGMLMSTILKELQKKTQALPEQVSLSEDLLQPPVPRDSGLRAGLIITGKTLEFALQESLQKQFLELTSWCQAVVCCRATPLQKSEVVKLVRSHLQVMTLAIGDGANDVSMIQVADIGIGVSGQEGMQAVMASDFAVSQFKHLSKLLLVHGHWCYTRLSNMILYFFYKNVAYVNLLFWYQFFCGFSGTSMTDYWVLIFFNLLFTSAPPVIYGVLEKDVSAETLMQLPELYRSGQKSEAYLPHTFWITLLDAFYQSLVCFFVPYFTYQGSDTDIFAFGNPLNTAALFIVLLHLVIESKSLTWIHLLVIIGSILSYFLFAIVFGAMCVTCNPPSNPYWIMQEHMLDPVFYLVCILTTSIALLPRFVYRVLQGSLFPSPILRAKHFDRLTPEERTKALKKWRGAGKMNQVTSKYANQSAGKSGRRPMPGPSAVFAMKSASSCAIEQGNLSLCETALDQGYSETKAFEMAGPSKGKES

SEQ ID NO: 8531 - protein, 535 aa, Artificial Sequence
  Description of Artificial Sequence: Synthetic coding sequence
MTEALQWARYHWRRLIRGATRDDDSGPYNYSSLLACGRKSSQTPKLSGRHRIVVPHIQPFKDEYEKFSGAYVNNRIRTTKYTLLNFVPRNLFEQFHRAANLYFLFLVVLNWVPLVEAFQKEITMLPLVVVLTIIAIKDGLEDYRKYKIDKQINNLITKVYSRKEKKYIDRCWKDVTVGDFIRLSCNEVIPADMVLLFSTDPDGICHIETSGLDGESNLKQRQVVRGYAEQDSEVDPEKFSSRIECESPNNDLSRFRGFLEHSNKERVGLSKENLLLRGCTIRNTEAVVGIVVYAGHETKAMLNNSGPRYKRSKLERRANTDVLWCVMLLVIMCLTGAVGHGIWLSRYEKMHFFNVPEPDGHIISPLLAGFYMFWTMIILLQLGQIYFIQSDVDFYNEKMDSIVQCRALNIAEDLGQIQYLFSDKTGTLTENKMVFRRCSVAGFDYCHEENARRLESYQEAVSEDEDFIDTVSGSLSNMAKPRAPSCRTVHNGPLGNKPSNHLAGSSFTLGSGEGASEVPHSRQAAFSSPIVSMNA

SEQ ID NO: 8532 - protein, 1132 aa, Artificial Sequence
  Description of Artificial Sequence: Synthetic coding sequence
MQMVPSLPPASECAGEEKRVGTRTVFVGNHPVSETEAYIAQRFCDNRIVSSKYTLWNFLPKNLFEQFRRIANFYFLIIFLVQVTVDTPTSPVTSGLPLFFVITVTAIKQGYEDCLRHRADNEVNKSTVYIIENAKRVRKESEKIKVGDVVEVQADETFPCDLILLSSCTTDGTCYVTTASLDGESNCKTHYAVRDTIALCTAESIDTLRAAIECEQPQPDLYKFVGRINIYSNSLEAVARSLGPENLLLKGATLKNTEKIYGVAVYTGMETKMALNYQGKSQKRSAVEKSINAFLIVYLFILLTKAAVCTTLKYVWQSTPYNDEPWYNQKTQKERETLKVLKMFTDFLSFMVLFNFIIPVSMYVTVEMQKFLGSFFISWDKDFYDEEINEGALVNTSDLNEELGQVDYVFTDKTGTLTENSMEFIECCIDGHKYKGVTQEVDGLSQTDGTLTYFDKVDKNREELFLRALCLCHTVEIKTNDAVDGATESAELTYISSSPDEIALVKGAKRYGFTFLGNRNGYMRVENQRKEIEEYELLHTLNFDAVRRRMSVIVKTQEGDILLFCKGADSAVFPRVQNHEIELTKVHVERNAMDGYRTLCVAFKEIAPDDYERINRQLIEAKMALQDREEKMEKVFDDIETNMNLIGATAVEDKLQDQAAETIEALHAAGLKVWVLTGDKMETAKSTCYACRLFQTNTELLELTTKTIEESERKEDRLHELLIEYRKKLLHEFPKSTRSFKKAWTEHQEYGLIIDGSTLSLILNSSQDSSSNNYKSIFLQICMKCTAVLCCRMAPLQKAQIVRMVKNLKGSPITLSIGDGANDVSMILESHVGIGIKGKEGRQAARNSDYSVPKFKHLKKLLLAHGHLYYVRIAHLVQYFFYKNLCFILPQFLYQFFCGFSQQPLYDAAYLTMYNICFTSLPILAYSLLEQHINIDTLTSDPRLYMKISGNAMLQLGPFLYWTFLAAFEGTVFFFGTYFLFQTASLEENGKVYGNWTFGTIVFTVLVFTVTLKLALDTRFWTWINHFVIWGSLAFYVFFSFFWGGIIWPFLKQQRMYFVFAQMLSSVSTWLAIILLIFISLFPEILLIVLKNVRRRSARRNLSCRRASDSLSARPSVRPLLLRTFSDESNVL

SEQ ID NO: 8533 - protein, 1108 aa, Artificial Sequence
  Description of Artificial Sequence: Synthetic coding sequence
MQMVPSLPPASECAGEEKRVGTRTVFVGNHPVSETEAYIAQRFCDNRIVSSKYTLWNFLPKNLFEQFRRIANFYFLIIFLVQVTVDTPTSPVTSGLPLFFVITVTAIKQGYEDCLRHRADNEVNKSTVYIIENAKRVRKESEKIKVGDVVEVQADETFPCDLILLSSCTTDGTCYVTTASLDGESNCKTHYAVRDTIALCTAESIDTLRAAIECEQPQPDLYKFVGRINIYSNSLEAVARSLGPENLLLKGATLKNTEKIYGVAVYTGMETKMALNYQGKSQKRSAVEKSINAFLIVYLFILLTKAAVCTTLKYVWQSTPYNDEPWYNQKTQKERETLKVLKMFTDFLSFMVLFNFIIPVSMYVTVEMQKFLGSFFISWDKDFYDEEINEGALVNTSDLNEELGQVDYVFTDKTGTLTENSMEFIECCIDGHKYKGVTQEVDGLSQTDGTLTYFDKVDKNREELFLRALCLCHTVEIKTNDAVDGATESAELTYISSSPDEIALVKGAKRYGFTFLGNRNGYMRVENQRKEIEEYELLHTLNFDAVRRRMSVIVKTQEGDILLFCKGADSAVFPRVQNHEIELTKVHVERNAMDGYRTLCVAFKEIAPDDYERINRQLIEAKMALQDREEKMEKVFDDIETNMNLIGATAVEDKLQDQAAETIEALHAAGLKVWVLTGDKMETAKSTCYACRLFQTNTELLELTTKTIEESERKEDRLHELLIEYRKKLLHEFPKSTRSFKKAWTEHQEYGLIIDGSTLSLILNSSQDSSSNNYKSIFLQICMKCTAVLCCRMAPLQKAQIVRMVKNLKGSPITLSIGDGANDVSMILESHVGIGIKGKEGRQAARNSDYSVPKFKHLKKLLLAHGHLYYVRIAHLVQYFFYKNLCFILPQFLYQFFCGFSQQPLYDAAYLTMYNICFTSLPILAYSLLEQHINIDTLTSDPRLYMKISGNAMLQLGPFLYWTFLAAFEGTVFFFGTYFLFQTASLEENGKVYGNWTFGTIVFTVLVFTVTLKLALDTRFWTWINHFVIWGSLAFYVFFSFFWGGIIWPFLKQQRMYFVFAQMLSSVSTWLAIILLIFISLFPEILLIVLKNVRRRSARVHHLISSSA

SEQ ID NO: 8534 - protein, 1119 aa, Artificial Sequence
  Description of Artificial Sequence: Synthetic coding sequence
MQMVPSLPPASECAGEEKRVGTRTVFVGNHPVSETEAYIAQRFCDNRIVSSKYTLWNFLPKNLFEQFRRIANFYFLIIFLVQVTVDTPTSPVTSGLPLFFVITVTAIKQGYEDCLRHRADNEVNKSTVYIIENAKRVRKESEKIKVGDVVEVQADETFPCDLILLSSCTTDGTCYVTTASLDGESNCKTHYAVRDTIALCTAESIDTLRAAIECEQPQPDLYKFVGRINIYSNSLEAVARSLGPENLLLKGATLKNTEKIYGVAVYTGMETKMALNYQGKSQKRSAVEKSINAFLIVYLFILLTKAAVCTTLKYVWQSTPYNDEPWYNQKTQKERETLKVLKMFTDFLSFMVLFNFIIPVSMYVTVEMQKFLGSFFISWDKDFYDEEINEGALVNTSDLNEELGQVDYVFTDKTGTLTENSMEFIECCIDGHKYKGVTQEVDGLSQTDGTLTYFDKVDKNREELFLRALCLCHTVEIKTNDAVDGATESAELTYISSSPDEIALVKGAKRYGFTFLGNRNGYMRVENQRKEIEEYELLHTLNFDAVRRRMSVIVKTQEGDILLFCKGADSAVFPRVQNHEIELTKVHVERNAMDGYRTLCVAFKEIAPDDYERINRQLIEAKMALQDREEKMEKVFDDIETNMNLIGATAVEDKLQDQAAETIEALHAAGLKVWVLTGDKMETAKSTCYACRLFQTNTELLELTTKTIEESERKEDRLHELLIEYRKKLLHEFPKSTRSFKKAWTEHQEYGLIIDGSTLSLILNSSQDSSSNNYKSIFLQICMKCTAVLCCRMAPLQKAQIVRMVKNLKGSPITLSIGDGANDVSMILESHVGIGIKGKEGRQAARNSDYSVPKFKHLKKLLLAHGHLYYVRIAHLVQYFFYKNLCFILPQFLYQFFCGFSQQPLYDAAYLTMYNICFTSLPILAYSLLEQHINIDTLTSDPRLYMKISGNAMLQLGPFLYWTFLAAFEGTVFFFGTYFLFQTASLEENGKVYGNWTFGTIVFTVLVFTVTLKLALDTRFWTWINHFVIWGSLAFYVFFSFFWGGIIWPFLKQQRMYFVFAQMLSSVSTWLAIILLIFISLFPEILLIVLKNVRRRSARNPNLELPMLLSYKHTDSGYS

SEQ ID NO: 8535 - protein, 1128 aa, Artificial Sequence
  Description of Artificial Sequence: Synthetic coding sequence
MQMVPSLPPASECAGEEKRVGTRTVFVGNHPVSETEAYIAQRFCDNRIVSSKYTLWNFLPKNLFEQFRRIANFYFLIIFLVQVTVDTPTSPVTSGLPLFFVITVTAIKQGYEDCLRHRADNEVNKSTVYIIENAKRVRKESEKIKVGDVVEVQADETFPCDLILLSSCTTDGTCYVTTASLDGESNCKTHYAVRDTIALCTAESIDTLRAAIECEQPQPDLYKFVGRINIYSNSLEAVARSLGPENLLLKGATLKNTEKIYGVAVYTGMETKMALNYQGKSQKRSAVEKSINAFLIVYLFILLTKAAVCTTLKYVWQSTPYNDEPWYNQKTQKERETLKVLKMFTDFLSFMVLFNFIIPVSMYVTVEMQKFLGSFFISWDKDFYDEEINEGALVNTSDLNEELGQVDYVFTDKTGTLTENSMEFIECCIDGHKYKGVTQEVDGLSQTDGTLTYFDKVDKNREELFLRALCLCHTVEIKTNDAVDGATESAELTYISSSPDEIALVKGAKRYGFTFLGNRNGYMRVENQRKEIEEYELLHTLNFDAVRRRMSVIVKTQEGDILLFCKGADSAVFPRVQNHEIELTKVHVERNAMDGYRTLCVAFKEIAPDDYERINRQLIEAKMALQDREEKMEKVFDDIETNMNLIGATAVEDKLQDQAAETIEALHAAGLKVWVLTGDKMETAKSTCYACRLFQTNTELLELTTKTIEESERKEDRLHELLIEYRKKLLHEFPKSTRSFKKAWTEHQEYGLIIDGSTLSLILNSSQDSSSNNYKSIFLQICMKCTAVLCCRMAPLQKAQIVRMVKNLKGSPITLSIGDGANDVSMILESHVGIGIKGKEGRQAARNSDYSVPKFKHLKKLLLAHGHLYYVRIAHLVQYFFYKNLCFILPQFLYQFFCGFSQQPLYDAAYLTMYNICFTSLPILAYSLLEQHINIDTLTSDPRLYMKISGNAMLQLGPFLYWTFLAAFEGTVFFFGTYFLFQTASLEENGKVYGNWTFGTIVFTVLVFTVTLKLALDTRFWTWINHFVIWGSLAFYVFFSFFWGGIIWPFLKQQRMYFVFAQMLSSVSTWLAIILLIFISLFPEILLIVLKNVRRRSARVTKRLPSSGTSAIFMLSQTSSNHSFSWSE

SEQ ID NO: 8536 - protein, 1113 aa, Artificial Sequence
  Description of Artificial Sequence: Synthetic coding sequence
MFRRSLNRFCAGEEKRVGTRTVFVGNHPVSETEAYIAQRFCDNRIVSSKYTLWNFLPKNLFEQFRRIANFYFLIIFLVQVTVDTPTSPVTSGLPLFFVITVTAIKQGYEDCLRHRADNEVNKSTVYIIENAKRVRKESEKIKVGDVVEVQADETFPCDLILLSSCTTDGTCYVTTASLDGESNCKTHYAVRDTIALCTAESIDTLRAAIECEQPQPDLYKFVGRINIYSNSLEAVARSLGPENLLLKGATLKNTEKIYGVAVYTGMETKMALNYQGKSQKRSAVEKSINAFLIVYLFILLTKAAVCTTLKYVWQSTPYNDEPWYNQKTQKERETLKVLKMFTDFLSFMVLFNFIIPVSMYVTVEMQKFLGSFFISWDKDFYDEEINEGALVNTSDLNEELGQVDYVFTDKTGTLTENSMEFIECCIDGHKYKGVTQEVDGLSQTDGTLTYFDKVDKNREELFLRALCLCHTVEIKTNDAVDGATESAELTYISSSPDEIALVKGAKRYGFTFLGNRNGYMRVENQRKEIEEYELLHTLNFDAVRRRMSVIVKTQEGDILLFCKGADSAVFPRVQNHEIELTKVHVERNAMDGYRTLCVAFKEIAPDDYERINRQLIEAKMALQDREEKMEKVFDDIETNMNLIGATAVEDKLQDQAAETIEALHAAGLKVWVLTGDKMETAKSTCYACRLFQTNTELLELTTKTIEESERKEDRLHELLIEYRKKLLHEFPKSTRSFKKAWTEHQEYGLIIDGSTLSLILNSSQDSSSNNYKSIFLQICMKCTAVLCCRMAPLQKAQIVRMVKNLKGSPITLSIGDGANDVSMILESHVGIGKEGRQAARNSDYSVPKFKHLKKLLLAHGHLYYVRIAHLVQYFFYKNLCFILPQFLYQFFCGFSQQPLYDAAYLTMYNICFTSLPILAYSLLEQHINIDTLTSDPRLYMKISGNAMLQLGPFLYWTFLAAFEGTVFFFGTYFLFQTASLEENGKVYGNWTFGTIVFTVLVFTVTLKLALDTRFWTWINHFVIWGSLAFYVFFSFFWGGIIWPFLKQQRMYFVFAQMLSSVSTWLAIILLIFISLFPEILLIVLKNVRRRSARNPNLELPMLLSYKHTDSGYS

SEQ ID NO: 8537 - protein, 202 aa, Artificial Sequence
  Description of Artificial Sequence: Synthetic coding sequence
  MOD_RES (1)..(1): Any amino acid
XECCIDGHKYKGVTQEVDGLSQTDGTLTYFDKVDKNREELFLRALCLCHTVEIKTNDAVDGATESAELTYISSSPDEIALVKGAKRYELLHTLNFDAVRRRMSVIVKTQEGDILLFCKGADSAVFPRVQNHEIELTKVHVERNAMDGYRTLCVAFKEIAPDDYERINRQLIEAKMALQDREEKMEKVFDDIETNMNLIGATA

SEQ ID NO: 8538 - protein, 165 aa, Artificial Sequence
  Description of Artificial Sequence: Synthetic coding sequence
  MOD_RES (1)..(1): Any amino acid
XEGTVFFFGTYFLFQTASLEENGKVYGNWTFGTIVFTVLVFTVTLKLALDTRFWTWINHFVIWGSLAFYVFFSFFWGGIIWPFLKQQRMYFVFAQMLSSVSTWLAIILLIFISLFPEILLIVLKNVRRRSARRNLSCRRASDSLSARPSVRPLLLRTFSDESNVL

SEQ ID NO: 8539 - protein, 172 aa, Artificial Sequence
  Description of Artificial Sequence: Synthetic coding sequence
TLTSDPRLYMKISGNAMLQLGPFLYWTFLAAFEGTVFFFGTYFLFQTASLEENGKVYGNWTFGTIVFTVLVFTVTLKLALDTRFWTWINHFVIWGSLAFYVFFSFFWGGIIWPFLKQQRMYFVFAQMLSSVSTWLAIILLIFISLFPEILLIVLKNVRRRSARVHHLISSSA

SEQ ID NO: 8540 - protein, 118 aa, Artificial Sequence
  Description of Artificial Sequence: Synthetic coding sequence
MTSQSQGIHQLLQAEKRAKDKLEEAKKRKGKRLKQAKEEAMVEIDQYRMQRDKEFRLKQSKIMGSQNNLSDEIEEQTLGKIQELNGHYNKYMESVMNQLLSMVCDMKPEIHVNYRATN

SEQ ID NO: 8541 - protein, 59 aa, Artificial Sequence
  Description of Artificial Sequence: Synthetic coding sequence
MTSQSQGIHQLLQAEKRAKDKLEEAKKILHLLFLKRRDWDCFWKRKAIEASQGGSNGRN

SEQ ID NO: 8542 - protein, 124 aa, Artificial Sequence
  Description of Artificial Sequence: Synthetic coding sequence
MTSQSQGIHQLLQAEKRAKDKLEEAKKKTGTASGKGKRLKQAKEEAMVEIDQYRMQRDKEFRLKQSKIMGSQNNLSDEIEEQTLGKIQELNGHYNKYMESVMNQLLSMVCDMKPEIHVNYRATN

SEQ ID NO: 8543 - protein, 118 aa, Artificial Sequence; identical to SEQ ID NO: 8540
  Description of Artificial Sequence: Synthetic coding sequence

SEQ ID NO: 8544 - protein, 124 aa, Artificial Sequence; identical to SEQ ID NO: 8542
  Description of Artificial Sequence: Synthetic coding sequence

SEQ ID NO: 8545 - protein, 119 aa, Artificial Sequence
  Description of Artificial Sequence: Synthetic coding sequence
MAGRGKLIAVIGDEDTVTGFLLGGIGELNKNRHPNFLVVEKDTTINEIEDTFRQFLNRDDIGIILINQYIAEMVRHALDAHQQSIPAVLEIPSKEHPYDAAKDSILRRARGMFTAEDLR

SEQ ID NO: 8546 - protein, 226 aa, Artificial Sequence
  Description of Artificial Sequence: Synthetic coding sequence
MALSDVDVKKQIKHMMAFIEQEANEKAEEIDAKAEEEFNIEKGRLVQTQRLKIMEYYEKKEKQIEQQKKILMSTMRNQARLKVLRARNDLISDLLSEAKLRLSRIVEDPEVYQGLLDKLVLQGLLRLLEPVMIVRCRPQDLLLVEAAVQKAIPEYMTISQKHVEVQIDKEAYLAVNAAGGVEVYSGNQRIKVSNTLESRLDLSAKQKMPEIRMALFGANTNRKFFI

SEQ ID NO: 8547 - protein, 226 aa, Artificial Sequence; identical to SEQ ID NO: 8546
  Description of Artificial Sequence: Synthetic coding sequence

SEQ ID NO: 8548 - protein, 247 aa, Artificial Sequence
  Description of Artificial Sequence: Synthetic coding sequence
MSGKDRIEIFPSRMAQTIMKARLKGAQTGRNLLKKKSDALTLRFRQILKKIIETKMLMGEVMREAAFSLAEAKFTAGDFSTTVIQNVNKAQVKIRAKKDNVAGVTLPVFEHYHEGTDSYELTGLARGGEQLAKLKRNYAKAVELLVELASLQTSFVTLDEAIKITNRRVNAIEHVIIPRIERTLAYIITELDEREREEFYRLKKIQEKKKILKEKSEKDLEQRRAAGEVLEPANLLAEEKDEDLLFE

SEQ ID NO: 8549 - protein, 247 aa, Artificial Sequence; identical to SEQ ID NO: 8548
  Description of Artificial Sequence: Synthetic coding sequence

SEQ ID NO: 8550 - protein, 72 aa, Artificial Sequence
  Description of Artificial Sequence: Synthetic coding sequence
MSGKDRIEIFPSRMAQTIMKARLKGAQTGRNLLKKKSDALTLRFRQILKKIIETKMLMGEVMREAAFSLAEA

SEQ ID NO: 8551 - protein, 350 aa, Artificial Sequence
  Description of Artificial Sequence: Synthetic coding sequence
MLEGAELYFNVDHGYLEGLVRGCKASLLTQQDYINLVQCETLEDLKIHLQTTDYGNFLANHTNPLTVSKIDTEMRKRLCGEFEYFRNHSLEPLSTFLTYMTCSYMIDNVILLMNGALQKKSVKEILGKCHPLGRFTEMEAVNIAETPSDLFNAILIETPLAPFFQDCMSENALDELNIELLRNKLYKSYLEAFYKFCKNHGDVTAEVMCPILEFEADRRAFIITLNSFGTELSKEDRETLYPTFGKLYPEGLRLLAQAEDFDQMKNVADHYGVYKPLFEAVGGSGGKTLEDVFYEREVQMNVLAFNRQFHYGVFYAYVKLKEQEIRNIVWIAECISQRHRTKINSYIPIL

SEQ ID NO: 8552 - protein, 36 aa, Artificial Sequence
  Description of Artificial Sequence: Synthetic coding sequence
MLEGAELYFNVDHGYLEGLVRGCKASLLTQQDYINL

SEQ ID NO: 8553 - protein, 43 aa, Artificial Sequence
  Description of Artificial Sequence: Synthetic coding sequence
MLEGAELYFNVDHGYLEGLVRGCKASLLTQQDYINLVQCETLE

SEQ ID NO: 8554 - protein, 427 aa, Artificial Sequence
  Description of Artificial Sequence: Synthetic coding sequence
MSEFWLISAPGDKENLQALERMNTVTSKSNLSYNTKFAIPDFKVGTLDSLVGLSDELGKLDTFAESLIRRMAQSVVEVMEDSKGKVQEHLLANGVDLTSFVTHFEWDMAKYPVKQPLVSVVDTIAKQLAQIEMDLKSRTAAYNTLKTNLENLEKKSMGNLFTRTLSDIVSKEDFVLDSEYLVTLLVIVPKPNYSQWQKTYESLSDMVVPRSTKLITEDKEGGLFTVTLFRKVIEDFKTKAKENKFTVREFYYDEKEIEREREEMARLLSDKKQQYQTSCVALKKGSSTFPDHKVKVTPLGNPDRPAAGQTDRERESEGEGEGPLLRWLKVNFSEAFIAWIHIKALRVFVESVLRYGLPVNFQAVLLQPHKKSSTKRLREVLNSVFRHLDEVAATSILDASVEIPGLQLNNQDYFPYVYFHIDLSLLD

SEQ ID NO: 8555 - protein, 381 aa, Artificial Sequence
  Description of Artificial Sequence: Synthetic coding sequence
MSEFWLISAPGDKENLQALERMNTVTSKSNLSYNTKFAIPDFKVGTLDSLVGLSDELGKLDTFAESLIRRMAQSVVEVMEDSKGKVQEHLLANGVDLTSFVTHFEWDMAKYPVKQPLVSVVDTIAKQLAQIEMDLKSRTAAYNTLKTNLENLEKKSMGNLFTRTLSDIVSKEDFVLDSEYLVTLLVIVPKPNYSQWQKTYESLSDMVVPRSTKLITEDKEGGLFTVTLFRKVIEDFKTKAKENKFTVREFYYDEKEIEREREEMARLLSDKKQQYGPLLRWLKVNFSEAFIAWIHIKALRVFVESVLRYGLPVNFQAVLLQPHKKSSTKRLREVLNSVFRHLDEVAATSILDASVEIPGLQLNNQDYFPYVYFHIDLSLLD

SEQ ID NO: 8556 - protein, 465 aa, Artificial Sequence
  Description of Artificial Sequence: Synthetic coding sequence
MTKMDIRGAVDAAVPTNIIAAKAAEVRANKVNWQSYLQGQMISAEDCEFIQRFEMKRSPEEKQEMLQTEGSQCAKTFINLMTHICKEQTVQYILTMVDDMLQENHQRVSIFFDYARCSKNTAWPYFLPMLNRQDPFTVHMAARIIAKLAAWGKELMEGSDLNYYFNWIKTQLSSQSSQYVQCVAGCLQLMLRVNEYRFAWVEADGVNCIMGVLSNKCGFQLQYQMIFSIWLLAFSPQMCEHLRRYNIIPVLSDILQESVKEKVTRIILAAFRNFLEKSTERETRQEYALAMIQCKVLKQLENLEQQKYDDEDISEDIKFLLEKLGESVQDLSSFDEYSSELKSGRLEWSPVHKSEKFWRENAVRLNEKNYELLKILTKLLEVSDDPQVLAVAAHDVGEYVRHYPRGKRVIEQLGGKQLVMNHMHHEDQQVRYNALLAVQKLMVHNWEYLGKQLQSEQPQTAAARS

SEQ ID NO: 8557 - protein, 483 aa, Artificial Sequence
  Description of Artificial Sequence: Synthetic coding sequence
MTKMDIRGAVDAAVPTNIIAAKAAEVRANKVNWQSYLQGQMISAEDCEFIQRFEMKRSPEEKQEMLQTEGSQCAKTFINLMTHICKEQTVQYILTMVDDMLQENHQRVSIFFDYARCSKNTAWPYFLPMLNRQDPFTVHMAARIIAKLAAWGKELMEGSDLNYYFNWIKTQLSSQKLRGSGVAVETGTVSSSDSSQYVQCVAGCLQLMLRVNEYRFAWVEADGVNCIMGVLSNKCGFQLQYQMIFSIWLLAFSPQMCEHLRRYNIIPVLSDILQESVKEKVTRIILAAFRNFLEKSTERETRQEYALAMIQCKVLKQLENLEQQKYDDEDISEDIKFLLEKLGESVQDLSSFDEYSSELKSGRLEWSPVHKSEKFWRENAVRLNEKNYELLKILTKLLEVSDDPQVLAVAAHDVGEYVRHYPRGKRVIEQLGGKQLVMNHMHHEDQQVRYNALLAVQKLMVHNWEYLGKQLQSEQPQTAAARS

SEQ ID NO: 8558 - protein, 483 aa, Artificial Sequence; identical to SEQ ID NO: 8557
  Description of Artificial Sequence: Synthetic coding sequence

SEQ ID NO: 8559 - protein, 102 aa, Artificial Sequence
  Description of Artificial Sequence: Synthetic coding sequence
MTKMDIRGAVDAAVPTNIIAAKAAEVRANKVNWQSYLQGQMISAEDCEFIQRFEMKRSPEEKQEMLQTEGSQCAKTFINLMTHICKEQTVQYILTMVDDMLQ

SEQ ID NO: 8560 - protein, 101 aa, Artificial Sequence
  Description of Artificial Sequence: Synthetic coding sequence
MTKMDIRGAVDAAVPTNIIAAKAAEVRANKVNWQSYLQGQMISAEDCEFIQRFEMKRSPEEKQEMLQTEGSQCAKTFINLMTHICKEQTVQYILTMVDDML

SEQ ID NO: 8561 - protein, 513 aa, Artificial Sequence
  Description of Artificial Sequence: Synthetic coding sequence
MAMEIDSRPGGLPGSSCNLGAAREHMQAVTRNYITHPRVTYRTVCSVNGPLVVLDRVKFAQYAEIVHFTLPDGTQRSGQVLEVAGTKAIVQVFEGTSGIDARKTTCEFTGDILRTPVSEDMLGRVFNGSGKPIDKGPVVMAEDFLDINGQPINPHSRIYPEEMIQTGISPIDVMNSIARGQKIPIFSAAGLPHNEIAAQICRQAGLVKKSKAVLDYHDDNFAIVFAAMGVNMETARFFKSDFEQNGTMGNVCLFLNLANDPTIERIITPRLALTTAEFLAYQCEKHVLVILTDMSSYAEALREVSAAREEVPGRRGFPGYMYTDLATIYERAGRVEGRGGSITQIPILTMPNDDITHPIPDLTGFITEGQIYVDRQLHNRQIYPPINVLPSLSRLMKSAIGEGMTRKDHGDVSNQLYACYAIGKDVQAMKAVVGEEALTSEDLLYLEFLQKFEKNFINQGPYENRSVFESLDLGWKLLRIFPKEMLKRIPQAVIDEFYSREGALQDLAPDTAL

SEQ ID NO: 8562 - protein, 496 aa, Artificial Sequence
  Description of Artificial Sequence: Synthetic coding sequence
MAMEIDSRPGGLPGSSCNLGAAREHMQAVTRNYITHPRVTYRTVCSVNGPLVVLDRVKFAQYAEIVHFTLPDGTQRSGQVLEVAGTKAIVQVFEGTSGIDARKTTCEFTGDILRTPVSEDMLGRVFNGSGKPIDKGPVVMAEDFLDINGQPINPHSRIYPEEMIQTGISPIDVMNSIARGQKIPIFSAAGLPHNEIAAQICRQAGLVKKSKAVLDYHDDNFAIVFAAMGVNMETARFFKSDFEQNGTMGNVCLFLNLANDPTIERIITPRLALTTAEFLAYQCEKHVLVILTDMSSYAEALREVSAAREEVPGRRGFPGYMYTDLATIYERAGRVEDITHPIPDLTGFITEGQIYVDRQLHNRQIYPPINVLPSLSRLMKSAIGEGMTRKDHGDVSNQLYACYAIGKDVQAMKAVVGEEALTSEDLLYLEFLQKFEKNFINQGPYENRSVFESLDLGWKLLRIFPKEMLKRIPQAVIDEFYSREGALQDLAPDTAL

SEQ ID NO: 8563 - protein, 488 aa, Artificial Sequence
  Description of Artificial Sequence: Synthetic coding sequence
MQAVTRNYITHPRVTYRTVCSVNGPLVVLDRVKFAQYAEIVHFTLPDGTQRSGQVLEVAGTKAIVQVFEGTSGIDARKTTCEFTGDILRTPVSEDMLGRVFNGSGKPIDKGPVVMAEDFLDINGQPINPHSRIYPEEMIQTGISPIDVMNSIARGQKIPIFSAAGLPHNEIAAQICRQAGLVKKSKAVLDYHDDNFAIVFAAMGVNMETARFFKSDFEQNGTMGNVCLFLNLANDPTIERIITPRLALTTAEFLAYQCEKHVLVILTDMSSYAEALREVSAAREEVPGRRGFPGYMYTDLATIYERAGRVEGRGGSITQIPILTMPNDDITHPIPDLTGFITEGQIYVDRQLHNRQIYPPINVLPSLSRLMKSAIGEGMTRKDHGDVSNQLYACYAIGKDVQAMKAVVGEEALTSEDLLYLEFLQKFEKNFINQGPYENRSVFESLDLGWKLLRIFPKEMLKRIPQAVIDEFYSREGALQDLAPDTAL

SEQ ID NO: 8564 - protein, 511 aa, Artificial Sequence
  Description of Artificial Sequence: Synthetic coding sequence
MALRAMRGIVNGAAPELPVPTGGPAVGAREQALAVSRNYLSQPRLTYKTVSGVNGPLVILDHVKFPRYAEIVHLTLPDGTKRSGQVLEVSGSKAVVQVFEGTSGIDAKKTSCEFTGDILRTPVSEDMLGRVFNGSGKPIDRGPVVLAEDFLDIMGQPINPQCRIYPEEMIQTGISAIDGMNSIARGQKIPIFSAAGLPHNEIAAQICRQAGLVKKSKDVVDYSEENFAIVFAAMGVNMETARFFKSDFEENGSMDNVCLFLNLANDPTIERIITPRLALTTAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHADVSNQLYACYAIGKDVQAMKAVVGEEALTSDDLLYLEFLQKFERNFIAQGPYENRTVFETLDIGWQLLRIFPKEMLKRIPQSTLSEFYPRDSAKH

SEQ ID NO: 8565 - protein, 385 aa, Artificial Sequence
  Description of Artificial Sequence: Synthetic coding sequence
MLGRVFNGSGKPIDRGPVVLAEDFLDIMGQPINPQCRIYPEEMIQTGISAIDGMNSIARGQKIPIFSAAGLPHNEIAAQICRQAGLVKKSKDVVDYSEENFAIVFAAMGVNMETARFFKSDFEENGSMDNVCLFLNLANDPTIERIITPRLALTTAEFLAYQCEKHVLVILTDMSSYAEALREVSAAREEVPGRRGFPGYMYTDLATIYERAGRVEGRNGSITQIPILTMPNDDITHPIPDLTGYITEGQIYVDRQLHNRQIYPPINVLPSLSRLMKSAIGEGMTRKDHADVSNQLYACYAIGKDVQAMKAVVGEEALTSDDLLYLEFLQKFERNFIAQGPYENRTVFETLDIGWQLLRIFPKEMLKRIPQSTLSEFYPRDSAKH

SEQ ID NO: 8566 - protein, 617 aa, Artificial Sequence
  Description of Artificial Sequence: Synthetic coding sequence
MDFSKLPKILDEDKESTFGYVHGVSGPVVTACDMAGAAMYELVRVGHSELVGEIIRLEGDMATIQVYEETSGVSVGDPVLRTGKPLSVELGPGIMGAIFDGIQRPLSDISSQTQSIYIPRGVNVSALSRDIKWDFTPCKNLRVGSHITGGDIYGIVSENSLIKHKIMLPPRNRGTVTYIAPPGNYDTSDVVLELEFEGVKEKFTMVQVWPVRQVRPVTEKLPANHPLLTGQRVLDALFPCVQGGTTAIPGAFGCGKTVISQSLSKYSNSDVIIYVGCGERGNEMSEVLRDFPELTMEVDGKVESIMKRTALVANTSNMPVAAREASIYTGITLSEYFRDMGYHVSMMADSTSRWAEALREISGRLAEMPADSGYPAYLGARLASFYERAGRVKCLGNPEREGSVSIVGAVSPPGGDFSDPVTSATLGIVQVFWGLDKKLAQRKHFPSVNWLISYSKYMRALDEYYDKHFTEFVPLRTKAKEILQEEEDLAEIVQLVGKASLAETDKITLEVAKLIKDDFLQQNGYTPYDRFCPFYKTVGMLSNMIAFYDMARRAVETTAQSDNKITWSIIREHMGDILYKLSSMKFKDPLKDGEAKIKSDYAQLLEDMQNAFRSLED

SEQ ID NO: 8567 - protein, 221 aa, Artificial Sequence
  Description of Artificial Sequence: Synthetic coding sequence
MDFSKLPKILDEDKESTFGYVHGVSGPVVTACDMAGAAMYELVRVGHSELVGEIIRLEGDMATIQVYEETSGVSVGDPVLRTGKPLSVELGPGIMGAIFDGIQRPLSDISSQTQSIYIPRGVNVSALSRDIKWDFTPCKNLRVGSHITGGDIYGIVSENSLIKHKIMLPPRNRGTVTYIAPPGNYDTSDVVLELEFEGVKEKFTMVQVWPVRQVRPVTEKL

SEQ ID NO: 8568 - protein, 584 aa, Artificial Sequence
  Description of Artificial Sequence: Synthetic coding sequence
MAGAAMYELVRVGHSELVGEIIRLEGDMATIQVYEETSGVSVGDPVLRTGKPLSVELGPGIMGAIFDGIQRPLSDISSQTQSIYIPRGVNVSALSRDIKWDFTPCKNLRVGSHITGGDIYGIVSENSLIKHKIMLPPRNRGTVTYIAPPGNYDTSDVVLELEFEGVKEKFTMVQVWPVRQVRPVTEKLPANHPLLTGQRVLDALFPCVQGGTTAIPGAFGCGKTVISQSLSKYSNSDVIIYVGCGERGNEMSEVLRDFPELTMEVDGKVESIMKRTALVANTSNMPVAAREASIYTGITLSEYFRDMGYHVSMMADSTSRWAEALREISGRLAEMPADSGYPAYLGARLASFYERAGRVKCLGNPEREGSVSIVGAVSPPGGDFSDPVTSATLGIVQVFWGLDKKLAQRKHFPSVNWLISYSKYMRALDEYYDKHFTEFVPLRTKAKEILQEEEDLAEIVQLVGKASLAETDKITLEVAKLIKDDFLQQNGYTPYDRFCPFYKTVGMLSNMIAFYDMARRAVETTAQSDNKITWSIIREHMGDILYKLSSMKFKDPLKDGEAKIKSDYAQLLEDMQNAFRSLED

SEQ ID NO: 8569 - protein, 334 aa, Artificial Sequence
  Description of Artificial Sequence: Synthetic coding sequence
MSEVLRDFPELTMEVDGKVESIMKRTALVANTSNMPVAAREASIYTGITLSEYFRDMGYHVSMMADSTSRWAEALREISGRLAEMPADSGYPAYLGARLASFYERAGRVKCLGNPEREGSVSIVGAVSPPGGDFSDPVTSATLGIVQVFWGLDKKLAQRKHFPSVNWLISYSKYMRALDEYYDKHFTEFVPLRTKAKEILQEEEDLAEIVQLVGKASLAETDKITLEVAKLIKDDFLQQNGYTPYDRFCPFYKTVGMLSNMIAFYDMARRAVETTAQSDNKITWSIIREHMGDILYKLSSMKFKDPLKDGEAKIKSDYAQLLEDMQNAFRSLED

SEQ ID NO: 8570 - protein, 81 aa, Artificial Sequence [sequence omitted]

SEQ ID NO: 8571 - protein, 81 aa, Artificial Sequence [sequence omitted]

SEQ ID NO: 8572 - protein, 470 aa, Artificial Sequence
  Description of Artificial Sequence: Synthetic coding sequence
MMAAMATARVRMGPRCAQALWRMPWLPVFLSLAAAAAAAAAEQQVPLVLWSSDRDLWAPAADTHEGHITSDLQLSTYLDPALELGPRNVLLFLQDKLSIEDFTAYGGVFGNKQDSAFSNLENALDLAPSSLVLPAVDWYAVSTLTTYLQEKLGASPLHVDLATLRELKLNASLPALLLIRLPYTASSGLMAPREVLTGNDEVIGQVLSTLKSEDVPYTAALTAVRPSRVARDVAVVAGGLGRQLLQKQPVSPVIHPPVSYNDTAPRILFWAQNFSVAYKDQWEDLTPLTFGVQELNLTGSFWNDSFARLSLTYERLFGTTVTFKFILANRLYPVSARHWFTMERLEVHSNGSVAYFNASQVTGPSIYSFHCEYVSSLSKKGSLLVARTQPSPWQMMLQDFQIQAFNVMGEQFSYASDCASFFSPGIWMGLLTSLFMLFIFTYGLHMILSLKTMDRFDDHKGPTISLTQIV

SEQ ID NO: 8573 - protein, 273 aa, Artificial Sequence
  Description of Artificial Sequence: Synthetic coding sequence
MMAAMATARVRMGPRCAQALWRMPWLPVFLSLAAAAAAAAAEQQVPLVLWSSDRDLWAPAADTHEGHITSDLQLSTYLDPALELGPRNVLLFLQDKLSIEDFTAYGGVFGNKQDSAFSNLENALDLAPSSLVLPAVDWYAVSTLTTYLQEKLGASPLHVARDVAVVAGGLGRQLLQKQPVSPVIHPPVSYNDTAPRILFWAQNFSVAYKDQWEDLTPLTFGVQELNLTGSFWNDSFARFILANRLYPVSARHWFTMERLEVHSNGSVAYFNAS

SEQ ID NO: 8574 - protein, 294 aa, Artificial Sequence
  Description of Artificial Sequence: Synthetic coding sequence
MKATSPATCSSGLMAPREVLTGNDEVIGQVLSTLKSEDVPYTAALTAVRPSRVARDVAVVAGGLGRQLLQKQPVSPVIHPPVSYNDTAPRILFWAQNFSVAYKDQWEDLTPLTFGVQELNLTGSFWNDSFARLSLTYERLFGTTVTFKFILANRLYPVSARHWFTMERLEVHSNGSVAYFNASQVTGPSIYSFHCEYVSSLSKKGSLLVARTQPSPWQMMLQDFQIQAFNVMGEQFSYASDCASFFSPGIWMGLLTSLFMLFIFTYGLHMILSLKTMDRFDDHKGPTISLTQIV

SEQ ID NO: 8575 - protein, 230 aa, Artificial Sequence
  Description of Artificial Sequence: Synthetic coding sequence
MMAAMATARVRMGPRCAQALWRMPWLPVFLSLAAAAAAAAAEQQVPLVLWSSDRDLWAPAADTHEGHITSDLQLSTYLDPALELGPRNVLLFLQDKLSIEDFTAYGGVFGNKQDSAFSNLENALDLAPSSLVLPAVDWYAVSTLTTYLQEKLGASPLHVDLATLRELKLNASLPALLLIRLPYTASSGLMAPREVLTDEVIGQVLSTLKSEDVPYTAALTAVRPSRVARD

SEQ ID NO: 8576 - protein, 224 aa, Artificial Sequence
  Description of Artificial Sequence: Synthetic coding sequence
MRLWKARVLKLVLKTAKDSRLGLNSKWLSLKLGDAGNPRSLAIRFILTNYNKLSIQSWFSLRRVEIISNNSIQAVFNPTGVYAPSGYSYRCQRVGSLQQDQALLLPSDTDDGSSLWEVTFIDFQIQGFAIKGGRFTKAQDCASSFSPAFLIGLAMSLILLLVLAYALHMLIYLRYLDQQYDLIASPAHFSQLKARDTAEEKELLRSQGAECYKLRSQQISKIYV

SEQ ID NO: 8577 - protein, 224 aa, Artificial Sequence; identical to SEQ ID NO: 8576
  Description of Artificial Sequence: Synthetic coding sequence

SEQ ID NO: 8578 - protein, 357 aa, Artificial Sequence
  Description of Artificial Sequence: Synthetic coding sequence
MRRQLRSRRAPSFPYSYRYRLDDPDEANQNYLADEEEEAEEEARVTVVPKSEEEEEEEEKEEEEEEEKEEEEGQGQPTGNAWWQKLQIMSEYLWDPERRMFLARTGQSWSLILLIYFFFYASLAAVITLCMYTLFLTISPYIPTFTERVKPPGVMIRPFAHSLNFNFNVSEPDTWQHYVISLNGFLQGYNDSLQEEMNVDCPPGQYFIQDGNEDEDKKACQFKRSFLKNCSGLEDPTFGYSTGQPCILLKMNRIVGFRPELGDPVKVSCKVQRGDENDIRSISYYPESASFDLRYYPYYGKLTHVNYTSPLVAMHFTDVVKNQAVPVQCQLKGKGVINDVINDRFVGRVIFTLNIET

SEQ ID NO: 8579 - protein, 353 aa, Artificial Sequence
  Description of Artificial Sequence: Synthetic coding sequence
MRRQLRSRRAPSFPYSYRYRLDDPDEANQNYLADEEEEAEEEARVTVVPKSEEEEEEEEKEEEEEEEKEEEEGQGQPTGNAWWQKLQIMSEYLWDPERRMFLARTGLILLIYFFFYASLAAVITLCMYTLFLTISPYIPTFTERVKPPGVMIRPFAHSLNFNFNVSEPDTWQHYVISLNGFLQGYNDSLQEEMNVDCPPGQYFIQDGNEDEDKKACQFKRSFLKNCSGLEDPTFGYSTGQPCILLKMNRIVGFRPELGDPVKVSCKVQRGDENDIRSISYYPESASFDLRYYPYYGKLTHVNYTSPLVAMHFTDVVKNQAVPVQCQLKGKGVINDVINDRFVGRVIFTLNIET

SEQ ID NO: 8580 - protein, 314 aa, Artificial Sequence
  Description of Artificial Sequence: Synthetic coding sequence
MRRQLRSRRAPSFPYSYRYRLDDPDEANQNYLADEEEEAEEEARVTVVPKSEEEEEEEEKEEEEEEEKEEEEGQGQPTGNAWWQKLQIMSEYLWDPERRMFLARTGQSWRVMIRPFAHSLNFNFNVSEPDTWQHYVISLNGFLQGYNDSLQEEMNVDCPPGQYFIQDGNEDEDKKACQFKRSFLKNCSGLEDPTFGYSTGQPCILLKMNRIVGFRPELGDPVKVSCKVQRGDENDIRSISYYPESASFDLRYYPYYGKLTHVNYTSPLVAMHFTDVVKNQAVPVQCQLKGKGVINDVINDRFVGRVIFTLNIET

SEQ ID NO: 8581 - protein, 126 aa, Artificial Sequence
  Description of Artificial Sequence: Synthetic coding sequence
MVDENDIRALNVRHYRDHIGVVSQEPVLFGTTISNNIKYGRDDVTDEEMERAAREANAYDFIMEFPNKFNTLVGEKGAQMSGGQKQRIAIARALVRNPKILILDEATSALDSESKSAVQAALEKKK

SEQ ID NO: 8582 - protein, 812 aa, Artificial Sequence
  Description of Artificial Sequence: Synthetic coding sequence
MVDENDIRALNVRHYRDHIGVVSQEPVLFGTTISNNIKYGRDDVTDEEMERAAREANAYDFIMEFPNKFNTLVGEKGAQMSGGQKQRIAIARALVRNPKILILDEATSALDSESKSAVQAALEKASKGRTTIVVAHRLSTIRSADLIVTLKDGMLAEKGAHAELMAKRGLYYSLVMSQDIKKADEQMESMTYSTERKTNSLPLHSVKSIKSDFIDKAEESTQSKEISLPEVSLLKILKLNKPEWPFVVLGTLASVLNGTVHPVFSIIFAKIITMFGNNDKTTLKHDAEIYSMIFVILGVICFVSYFMQGLFYGRAGEILTMRLRHLAFKAMLYQDIAWFDEKENSTGGLTTILAIDIAQIQGATGSRIGVLTQNATNMGLSVIISFIYGWEMTFLILSIAPVLAVTGMIETAAMTGFANKDKQELKHAGKIATEALENIRTIVSLTREKAFEQMYEEMLQTQHRNTSKKAQIIGSCYAFSHAFIYFAYAAGFRFGAYLIQAGRMTPEGMFIVFTAIAYGAMAIGETLVLAPEYSKAKSGAAHLFALLEKKPNIDSRSQEGKKPDTCEGNLEFREVSFFYPCRPDVFILRGLSLSIERGKTVAFVGSSGCGKSTSVQLLQRLYDPVQGQVLFDGVDAKELNVQWLRSQIAIVPQEPVLFNCSIAENIAYGDNSRVVPLDEIKEAANAANIHSFIEGLPEKYNTQVGLKGAQLSGGQKQRLAIARALLQKPKILLLDEATSALDNDSEKVVQHALDKARTGRTCLVVTHRLSAIQNADLIVVLHNGKIKEQGTHQELLRNRDIYFKLVNAQSVQ

SEQ ID NO: 8583 - protein, 1257 aa, Artificial Sequence
  Description of Artificial Sequence: Synthetic coding sequence
MENSERAEEMQENYQRNGTAEEQPKLRKEAVGSIEIFRFADGLDITLMILGILASLVNGACLPLMPLVLGEMSDNLISGCLVQTNTTNYQNCTQSQEKLNEDMTLLTLYYVGIGVAALIFGYIQISLWIITAARQTKRIRKQFFHSVLAQDIGWFDSCDIGELNTRMTDDIDKISDGIGDKIALLFQNMSTFSIGLAVGLVKGWKLTLVTLSTSPLIMASAAACSRMVISLTSKELSAYSKAGAVAEEVLSSIRTVIAFRAQEKELQRYTQNLKDAKDFGIKRTIASKVSLGAVYFFMNGTYGLAFWYGTSLILNGEPGYTIGTVLAVFFSVIHSSYCIGAAVPHFETFAIARGAAFHIFQVIDKKPSIDNFSTAGYKPESIEGTVEFKNVSFNYPSRPSIKILKGLNLRIKSGETVALVGLNGSGKSTVVQLLQRLYDPDDGFIMVDENDIRALNVRHYRDHIGVVSQEPVLFGTTISNNIKYGRDDVTDEEMERAAREANAYDFIMEFPNKFNTLVGEKGAQMSGGQKQRIAIARALVRNPKILILDEATSALDSESKSAVQAALEKASKGRTTIVVAHRLSTIRSADLIVTLKDGMLAEKGAHAELMAKRGLYYSLVMSQDIKKADEQMESMTYSTERKTNSLPLHSVKSIKSDFIDKAEESTQSKEISLPEVSLLKILKLNKPEWPFVVLGTLASVLNGTVHPVFSIIFAKIITMFGNNDKTTLKHDAEIYSMIFVILGVICFVSYFMQGLFYGRAGEILTMRLRHLAFKAMLYQDIAWFDEKENSTGGLTTILAIDIAQIQGATGSRIGVLTQNATNMGLSVIISFIYGWEMTFLILSIAPVLAVTGMIETAAMTGFANKDKQELKHAGKIATEALENIRTIVSLTREKAFEQMYEEMLQTQHRNTSKKAQIIGSCYAFSHAFIYFAYAAGFRFGAYLIQAGRMTPEGMFIVFTAIAYGAMAIGETLVLAPEYSKAKSGAAHLFALLEKKPNIDSRSQEGKKPDTCEGNLEFREVSFFYPCRPDVFILRGLSLSIERGKTVAFVGSSGCGKSTSVQLLQRLYDPVQGQVLFDGVDAKELNVQWLRSQIAIVPQEPVLFNCSIAENIAYGDNSRVVPLDEIKEAANAANIHSFIEGLPEKYNTQVGLKGAQLSGGQKQRLAIARALLQKPKILLLDEATSALDNDSEKVVQHALDKARTGRTCLVVTHRLSAIQNADLIVVLHNGKIKEQGTHQELLRNRDIYFKLVNAQSVQ

SEQ ID NO: 8584 - protein, 131 aa, Artificial Sequence
  Description of Artificial Sequence: Synthetic coding sequence
MVDENDIRALNVRHYRDHIGVVSQEPVLFGTTISNNIKYGRDDVTDEEMERAAREANAYDFIMEFPNKFNTLVGEKGAQMSGGQKQRIAIARALVRNPKILILDEATSALDSESKSAVQAALEKDTPRYSF

SEQ ID NO: 8585 - protein, 1582 aa, Artificial Sequence
  Description of Artificial Sequence: Synthetic coding sequence
MPLAFCGSENHSAAYRVDQGVLNNGCFVDALNVVPHVFLLFITFPILFIGWGSQSSKVHIHHSTWLHFPGHNLRWILTFMLLFVLVCEIAEGILSDGVTESHHLHLYMPAGMAFMAAVTSVVYYHNIETSNFPKLLIALLVYWTLAFITKTIKFVKFLDHAIGFSQLRFCLTGLLVILYGMLLLVEVNVIRVRRYIFFKTPREVKPPEDLQDLGVRFLQPFVNLLSKGTYWWMNAFIKTAHKKPIDLRAIGKLPIAMRALTNYQRLCEAFDAQVRKDIQGTQGARAIWQALSHAFGRRLVLSSTFRILADLLGFAGPLCIFGIVDHLGKENDVFQPKTQFLGVYFVSSQEFLANAYVLAVLLFLALLLQRTFLQASYYVAIETGINLRGAIQTKIYNKIMHLSTSNLSMGEMTAGQICNLVAIDTNQLMWFFFLCPNLWAMPVQIIVGVILLYYILGVSALIGAAVIILLAPVQYFVATKLSQAQRSTLEYSNERLKQTNEMLRGIKLLKLYAWENIFRTRVETTRRKEMTSLRAFAIYTSISIFMNTAIPIAAVLITFVGHVSFFKEADFSPSVAFASLSLFHILVTPLFLLSSVVRSTVKALVSVQKLSEFLSSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKETVTERKATEPPQGLSRAMSSRDGLLQDEEEEEEEAAESEEDDNLSSMLHQRAEIPWRACAKYLSSAGILLLSLLVFSQLLKHMVLVAIDYWLAKWTDSALTLTPAARNCSLSQECTLDQTVYAMVFTVLCSLGIVLCLVTSVTVEWTGLKVAKRLHRSLLNRIILAPMRFFETTPLGSILNRFSSDCNTIDQHIPSTLECLSRSTLLCVSALAVISYVTPVFLVALLPLAIVCYFIQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLAPSLIPKNWPDQGKIQIQNLSVRYDSSLKPVLKHVNALIAPGQKIGICGRTGSGKSSFSLAFFRMVDTFEGHIIIDGIDIAKLPLHTLRSRLSIILQDPVLFSGTIRFNLDPERKCSDSTLWEALEIAQLKLVVKALPGGLDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 8586 - protein, 1011 aa, Artificial Sequence
  Description of Artificial Sequence: Synthetic coding sequence
RSQLSPSPARARAAMPLAFCGSENHSAAYRVDQGVLNNGCFVDALNVVPHVFLLFITFPILFIGWGSQSSKVHIHHSTWLHFPGHNLRWILTFMLLFVLVCEIAEGILSDGVTESHHLHLYMPAGMAFMAAVTSVVYYHNIETSNFPKLLIALLVYWTLAFITKTIKFVKFLDHAIGFSQLRFCLTGLLVILYGMLLLVEVNVIRVRRYIFFKTPREVKPPEDLQDLGVRFLQPFVNLLSKGTYWWMNAFIKTAHKKPIDLRAIGKLPIAMRALTNYQRLCEAFDAQVRKDIQGTQGARAIWQALSHAFGRRLVLSSTFRILADLLGFAGPLCIFGIVDHLGKENDVFQPKTQFLGVYFVSSQEFLANAYVLAVLLFLALLLQRTFLQASYYVAIETGINLRGAIQTKIYNKIMHLSTSNLSMGEMTAGQICNLVAIDTNQLMWFFFLCPNLWAMPVQIIVGVILLYYILGVSALIGAAVIILLAPVQYFVATKLSQAQRSTLEYSNERLKQTNEMLRGIKLLKLYAWENIFRTRVETTRRKEMTSLRAFAIYTSISIFMNTAIPIAAVLITFVGHVSFFKEADFSPSVAFASLSLFHILVTPLFLLSSVVRSTVKALVSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKRRQLRARRMTTCRPCCTSVLRSHGEPAPSTCPPPASCSCRCWSSHSCSSTWSWWPSTTGWPSGPTAP

SEQ ID NO: 8587 - protein, 1581 aa, Artificial Sequence
  Description of Artificial Sequence: Synthetic coding sequence
MPLAFCGSENHSAAYRVDQGVLNNGCFVDALNVVPHVFLLFITFPILFIGWGSQSSKVHIHHSTWLHFPGHNLRWILTFMLLFVLVCEIAEGILSDGVTESHHLHLYMPAGMAFMAAVTSVVYYHNIETSNFPKLLIALLVYWTLAFITKTIKFVKFLDHAIGFSQLRFCLTGLLVILYGMLLLVEVNVIRVRRYIFFKTPREVKPPEDLQDLGVRFLQPFVNLLSKGTYWWMNAFIKTAHKKPIDLRAIGKLPIAMRALTNYQRLCEAFDAQVRKDIQGTQGARAIWQALSHAFGRRLVLSSTFRILADLLGFAGPLCIFGIVDHLGKENDVFQPKTQFLGVYFVSSQEFLANAYVLAVLLFLALLLQRTFLQASYYVAIETGINLRGAIQTKIYNKIMHLSTSNLSMGEMTAGQICNLVAIDTNQLMWFFFLCPNLWAMPVQIIVGVILLYYILGVSALIGAAVIILLAPVQYFVATKLSQAQRSTLEYSNERLKQTNEMLRGIKLLKLYAWENIFRTRVETTRRKEMTSLRAFAIYTSISIFMNTAIPIAAVLITFVGHVSFFKEADFSPSVAFASLSLFHILVTPLFLLSSVVRSTVKALVSVQKLSEFLSSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKETVTERKATEPPQGLSRAMSSRDGLLQDEEEEEEEAAESEEDDNLSSMLHQRAEIPWRACAKYLSSAGILLLSLLVFSQLLKHMVLVAIDYWLAKWTDSALTLTPAARNCSLSQECTLDQTVYAMVFTVLCSLGIVLCLVTSVTVEWTGLKVAKRLHRSLLNRIILAPMRFFETTPLGSILNRFSSDCNTIDQHIPSTLECLSRSTLLCVSALAVISYVTPVFLVALLPLAIVCYFIQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLAPSLIPKNWPDQGKIQIQNLSVRYDSSLKPVLKHVNALIAPGQKIGICGRTGSGKSSFSLAFFRMVDTFEGHIIIDGIDIAKLPLHTLRSRLSIILQDPVLFSGTIRFNLDPERKCSDSTLWEALEIAQLKLVVKALPGGLDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 8588 - protein, 997 aa, Artificial Sequence
  Description of Artificial Sequence: Synthetic coding sequence
MPLAFCGSENHSAAYRVDQGVLNNGCFVDALNVVPHVFLLFITFPILFIGWGSQSSKVHIHHSTWLHFPGHNLRWILTFMLLFVLVCEIAEGILSDGVTESHHLHLYMPAGMAFMAAVTSVVYYHNIETSNFPKLLIALLVYWTLAFITKTIKFVKFLDHAIGFSQLRFCLTGLLVILYGMLLLVEVNVIRVRRYIFFKTPREVKPPEDLQDLGVRFLQPFVNLLSKGTYWWMNAFIKTAHKKPIDLRAIGKLPIAMRALTNYQRLCEAFDAQVRKDIQGTQGARAIWQALSHAFGRRLVLSSTFRILADLLGFAGPLCIFGIVDHLGKENDVFQPKTQFLGVYFVSSQEFLANAYVLAVLLFLALLLQRTFLQASYYVAIETGINLRGAIQTKIYNKIMHLSTSNLSMGEMTAGQICNLVAIDTNQLMWFFFLCPNLWAMPVQIIVGVILLYYILGVSALIGAAVIILLAPVQYFVATKLSQAQRSTLEYSNERLKQTNEMLRGIKLLKLYAWENIFRTRVETTRRKEMTSLRAFAIYTSISIFMNTAIPIAAVLITFVGHVSFFKEADFSPSVAFASLSLFHILVTPLFLLSSVVRSTVKALVSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKRRQLRARRMTTCRPCCTSVLRSHGEPAPSTCPPPASCSCRCWSSHSCSSTWSWWPSTTGWPSGPTAP

SEQ ID NO: 8589 - protein, 263 aa, Artificial Sequence
  Description of Artificial Sequence: Synthetic coding sequence
MSFAVFLIHTKRKKGVQSSGVLFGYWLLCFVLPATNAAQQASGAGFQSDPVRHLSTYLCLSLVVAQFVLSCLADQPPFFPEDPQQSNPCPETGAAFPSKATFWWVSGLVWRGYRRPLRPKDLWSLGRENSSEELVSRLEKEWMRNRSAARGHNKAIAFKRKGGSGMEAPETEPFLRQEGSQWRPLLKAIWQVFHSTFLLGTLSLVISDVFRFTVPKLLSLFLEFIGDPKPPAWKGYLLAVLMFLSACLQTLFEQQNMYRLKVL

SEQ ID NO: 8590 - protein, 199 aa, Artificial Sequence
  Description of Artificial Sequence: Synthetic coding sequence
MLLGRLTSQLLRAVPWAGGRPPWPVSGVLGSRVCGPLYSTSPAGPGRAASLPRKGAQLELEEMLVPRKMSVSPLESWLTARCFLPRLDTGTAGTVAPPQSYQCPPSQIGEGAEQGDEGVADAPQIQCKNVLKIRRRKMNHHKYRKLVKKTRFLRRKVQEGRLRRKQIKFEKDLRRIWLKAGLKEAPEGWQTPKIYLRGK

SEQ ID NO: 8591 - protein, 199 aa, Artificial Sequence; identical to SEQ ID NO: 8590
  Description of Artificial Sequence: Synthetic coding sequence

SEQ ID NO: 8592 - protein, 199 aa, Artificial Sequence; identical to SEQ ID NO: 8590
  Description of Artificial Sequence: Synthetic coding sequence

SEQ ID NO: 8593 - protein, 199 aa, Artificial Sequence; identical to SEQ ID NO: 8590
  Description of Artificial Sequence: Synthetic coding sequence

SEQ ID NO: 8594 - protein, 289 aa, Artificial Sequence
  Description of Artificial Sequence: Synthetic coding sequence
MKTLPAMLGTGKLFWVFFLIPYLDIWNIHGKESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 8595 - protein, 241 aa, Artificial Sequence
  Description of Artificial Sequence: Synthetic coding sequence
MKTLPAMLGTGKLFWVFFLIPYLDIWNIHGKESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 8596 - protein, 454 aa, Artificial Sequence
  Description of Artificial Sequence: Synthetic coding sequence
MTWRAAASTCAALLILLWALTTEGDLKVEMMAGGTQITPLNDNVTIFCNIFYSQPLNITSMGITWFWKSLTFDKEVKVFEFFGDHQEAFRPGAIVSPWRLKSGDASLRLPGIQLEEAGEYRCEVVVTPLKAQGTVQLEVVASPASRLLLDQVGMKENEDKYMCESSGFYPEAINITWEKQTQKFPHPIEISEDVITGPTIKNMDGTFNVTSCLKLNSSQEDPGTVYQCVVRHASLHTPLRSNFTLTAARHSLSETEKTDNFSIHWWPISFIGVGLVLLIVLIPWKKICNKSSSAYTPLKCILKHWNSFDTQTLKKEHLIFFCTRAWPSYQLQDGEAWPPEGSVNINTIQQLDVFCRQEGKWSEVPYVQAFFALRDNPDLCQCCRIDPALLTVTSGKSIDDNSTKSEKQTPREHSDAVPDAPILPVSPIWEPPPATTSTTPVLSSQPPTLLLPLQ

SEQ ID NO: 8597 - protein, 454 aa, Artificial Sequence; identical to SEQ ID NO: 8596
  Description of Artificial Sequence: Synthetic coding sequence

SEQ ID NO: 8598 - protein, 219 aa, Artificial Sequence
  Description of Artificial Sequence: Synthetic coding sequence
MAPEMDQFYRSTMAIYKSIMEQFNPALENLVYLGNNYLRAFHALSEAAEVYFSAIQKIGERALQSPTSQILGEILVQMSDTQRHLNSDLEVVVQTFHGGLLQHMEKNTKLDMQFIKDSRQHYELEYRHRAANLEKCMSELWRMERKRDKNVREMKESVNRLHAQMQAFVSESQRAAELEEKRRYRFLAEKHLLLSNTFLQFFGRMLADGRLVVSTLWLS

SEQ ID NO: 8599 - protein, 529 aa, Artificial Sequence
  Description of Artificial Sequence: Synthetic coding sequence
MAPEMDQFYRSTMAIYKSIMEQFNPALENLVYLGNNYLRAFHALSEAAEVYFSAIQKIGERALQSPTSQILGEILVQMSDTQRHLNSDLEVVVQTFHGGLLQHMEKNTKLDMQFIKDSRQHYELEYRHRAANLEKCMSELWRMERKRDKNVREMKESVNRLHAQMQAFVSESQRAAELEEKRRYRFLAEKHLLLSNTFLQFFGRARGMLQNRVLLWKEQSEASRSPSRAHSPGLLGPALGPPYPSGRLTPTCLDMPPRPLGEFSSPRSRHGSGSYGTEPDARPASQLEPDRRSLPRTPSASSLYSGSAQSSRSNSFGERPGGGGGARRVRALVSHSEGANHTLLRFSAGDVVEVLVPEAQNGWLYGKLEGSSASGWFPEAYVKALEEGPVNPMTPVTPMTSMTSMSPMTPMNPGNELPSRSYPLRGSHSLDDLLDRPGNSIAPSEYWDGQSRSRTPSRVPSRAPSPAPPPLPSSRRSSMGSTAVATDVKKLMSSEQYPPQELFPRGTNPFATVKLRPTITNDRSAPLIR

SEQ ID NO: 8600 - protein, 515 aa, Artificial Sequence
  Description of Artificial Sequence: Synthetic coding sequence
MAPEMDQFYRSTMAIYKSIMEQFNPALENLVYLGNNYLRAFHALSEAAEVYFSAIQKIGERALQSPTSQILGEILVQMSDTQRHLNSDLEVVVQTFHGGLLQHMEKNTKLDMQFIKDSRQHYELEYRHRAANLEKCMSELWRMERKRDKNVREMKESVNRLHAQMQAFVSESQRAAELEEKRRYRFLAEKHLLLSNTFLQFFGRARGMLQNRVLLWKEQSEASRSPSRAHSPGLLGPALGPPYPSGRLTPTCLDMPPRPLGEFSSPRSRHGSGSYGTEPDARPASQLEPDRRSLPRTPSASSLYSGSAQSSRSNSFGERPGGGGGARRVRALVSHSEGANHTLLRFSAGDVVEVLVPEAQNGWLYGKLEGSSASGWFPEAYVKALEEGPVNPMTPVTPMTSMTSMSPMTPMNPGNELPSRSYPLRGSHSLDDLLDRPGNSTPSRVPSRAPSPAPPPLPSSRRSSMGSTAVATDVKKLMSSEQYPPQELFPRGTNPFATVKLRPTITNDRSAPLIR

SEQ ID NO: 8601 - protein, 241 aa, Artificial Sequence
  Description of Artificial Sequence: Synthetic coding sequence
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQDRLERGNKKRL

SEQ ID NO: 8602 - protein, 241 aa, Artificial Sequence; identical to SEQ ID NO: 8601
  Description of Artificial Sequence: Synthetic coding sequence

SEQ ID NO: 8603 - protein, 348 aa, Artificial Sequence
  Description of Artificial Sequence: Synthetic coding sequence
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQHSSFGEFLSKRSHKNGSIGKQTGSRKGSFRKRQQEKTVNFIKDTCNILCQNDNFVMLASRKFKFRKMHYDRFVIFLMPHIGCIVMALSKYLMMFQIYCKVCIPALKKNISMLNTIFTY

SEQ ID NO: 8604 - protein, 155 aa, Artificial Sequence
  Description of Artificial Sequence: Synthetic coding sequence
MKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQKSHSQPGAAAFLVKEVESF

SEQ ID NO: 8605 - protein, 133 aa, Artificial Sequence
  Description of Artificial Sequence: Synthetic coding sequence
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSN

SEQ ID NO: 8606 - protein, 163 aa, Artificial Sequence
  Description of Artificial Sequence: Synthetic coding sequence
  MOD_RES (1)..(1): Any amino acid
XDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQKSHSQPGAAAFLVKEVESF

SEQ ID NO: 8607 - protein, 348 aa, Artificial Sequence; identical to SEQ ID NO: 8603
  Description of Artificial Sequence: Synthetic coding sequence

SEQ ID NO: 8608 - protein, 230 aa, Artificial Sequence
  Description of Artificial Sequence: Synthetic coding sequence
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQ

SEQ ID NO: 8609 - protein, 147 aa, Artificial Sequence
  Description of Artificial Sequence: Synthetic coding sequence
MKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQDRLERGNKKRL

SEQ ID NO: 8610 - protein, 64 aa, Artificial Sequence
  Description of Artificial Sequence: Synthetic coding sequence
MTLQWAAVATFLYAEIGLILIFCLPFIPPQRWQKIFSFNVWGKIATFWNKAFLTIIILLIVLFL

SEQ ID NO: 8611 - protein, 196 aa, Artificial Sequence
  Description of Artificial Sequence: Synthetic coding sequence
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSD

SEQ ID NO: 8612 - protein, 246 aa, Artificial Sequence
  Description of Artificial Sequence: Synthetic coding sequence
MSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLEEENRSLKADLQKLKDELASTKQKLEKAENQVLAMRKQSEGLTKEYDRLLEEHAKLQAAVDGPMDKKEE

SEQ ID NO: 8613 - protein, 182 aa, Artificial Sequence
  Description of Artificial Sequence: Synthetic coding sequence
MSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLEEENR

SEQ ID NO: 8614 - protein, 178 aa, Artificial Sequence
  Description of Artificial Sequence: Synthetic coding sequence
MSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLE

SEQ ID NO: 8615 - protein, 313 aa, Artificial Sequence
  Description of Artificial Sequence: Synthetic coding sequence
MGAEASSSWCPGTALPEERLSVKRASEISGFLGQGSSGEAALDVLTHVLEGAGNKLTSSCGKPSSNRMSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLEEENRSLKADLQKLKDELASTKQKLEKAENQVLAMRKQSEGLTKEYDRLLEEHAKLQAAVDGPMDKKEE

SEQ ID NO: 8616 - protein, 187 aa, Artificial Sequence
  Description of Artificial Sequence: Synthetic coding sequence
MSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLEEENRSLKAD

SEQ ID NO: 8617 - protein, 138 aa, Artificial Sequence
  Description of Artificial Sequence: Synthetic coding sequence
MSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKK

SEQ ID NO: 8618 - protein, 246 aa, Artificial Sequence; identical to SEQ ID NO: 8612
  Description of Artificial Sequence: Synthetic coding sequence

SEQ ID NO: 8619 - protein, 188 aa, Artificial Sequence
  Description of Artificial Sequence: Synthetic coding sequence
MSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLEEENRSLKADL

SEQ ID NO: 8620 - protein, 313 aa, Artificial Sequence; identical to SEQ ID NO: 8615
  Description of Artificial Sequence: Synthetic coding sequence

SEQ ID NO: 8621 - protein, 271 aa, Artificial Sequence
  Description of Artificial Sequence: Synthetic coding sequence
MAAPQDVHVRICNQEIVKFDLEVKALIQDIRDCSGPLSALTELNTKVKEKFQQLRHRIQPVLYQRAFIWTASTFFFKLTYSLTDFSSTQHDFNSPTTPVTFSDLEQLAKEQDKESEKQLLLQEVENHKKQMLSNQASWRKANLTCKIAIDNLEKAELLQGGDLLRQRKTTKESLAQTSSTITESLMGISRMMAQQVQQSEEAMQSLVTSSRTILDANEEFKSMSGTIQLGRKLITKYNRRELTDKLLIFLALALFLATVLYIVKKRLFPFL

SEQ ID NO: 8622 - protein, 228 aa, Artificial Sequence
  Description of Artificial Sequence: Synthetic coding sequence
MAAPQDVHVRICNQEIVKFDLEVKALIQDIRDCSGPLSALTELNTKVKEKFQQLRHRIQDLEQLAKEQDKESEKQLLLQEVENHKKQMLSNQASWRKANLTCKIAIDNLEKAELLQGGDLLRQRKTTKESLAQTSSTITESLMGISRMMAQQVQQSEEAMQSLVTSSRTILDANEEFKSMSGTIQLGRKLITKYNRRELTDKLLIFLALALFLATVLYIVKKRLFPFL

SEQ ID NO: 8623 - protein, 237 aa, Artificial Sequence
  Description of Artificial Sequence: Synthetic coding sequence
MAAPQDVHVRICNQEIVKFDLEVKALIQDIRDCSGPLSALTELNTKVKEKFQQLRHRIQPVLYQRAFIWTASTFFFKLTYSLTDFSSTQHDFNSPTTPVTFSDLEQLAKEQDKESEKQLLLQEVENHKKQMLRKTTKESLAQTSSTITESLMGISRMMAQQVQQSEEAMQSLVTSSRTILDANEEFKSMSGTIQLGRKLITKYNRRELTDKLLIFLALALFLATVLYIVKKRLFPFL

SEQ ID NO: 8624 - protein, 194 aa, Artificial Sequence
  Description of Artificial Sequence: Synthetic coding sequence
MAAPQDVHVRICNQEIVKFDLEVKALIQDIRDCSGPLSALTELNTKVKEKFQQLRHRIQDLEQLAKEQDKESEKQLLLQEVENHKKQMLRKTTKESLAQTSSTITESLMGISRMMAQQVQQSEEAMQSLVTSSRTILDANEEFKSMSGTIQLGRKLITKYNRRELTDKLLIFLALALFLATVLYIVKKRLFPFL

SEQ ID NO: 8625 - protein, 485 aa, Artificial Sequence
  Description of Artificial Sequence: Synthetic coding sequence
MASSSTVPLGFHYETKYVVLSYLGLLSQEKLQEQHLSSPQGVQLDIASQSLDQEILLKVKTEIEEELKSLDKEISEAFTSTGFDRHTSPVFSPANPESSMEDCLAHLGEKVSQELKEPLHKALQMLLSQPVTYQAFRECTLETTVHASGWNKILVPLVLLRQMLLELTRRGQEPLSALLQFGVTYLEDYSAEYIIQQGGWGTVFSLESEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEVEEVVPALEPTETLLSEKEINAREESLVEELSPASEKKPVPPSEGKSRLSPAGEMKPMPLSEGKSILLFGGAAAVAILAVAIGVALALRKK

SEQ ID NO: 8626 - protein, 323 aa, Artificial Sequence
  Description of Artificial Sequence: Synthetic coding sequence
MLLELTRRGQEPLSALLQFGVTYLEDYSAEYIIQQGGWGTVFSLESEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEVEEVVPALEPTETLLSEKEINAREESLVEELSPASEKKPVPPSEGKSRLSPAGEMKPMPLSEGKSILLFGGAAAVAILAVAIGVALALRKK

SEQ ID NO: 8627 - protein, 201 aa, Artificial Sequence
  Description of Artificial Sequence: Synthetic coding sequence
MASSSTVPLGFHYETKYVVLSYLGLLSQEKLQEQHLSSPQGVQLDIASQSLDQEILLKVKTEIEEELKSLDKEISEAFTSTGFDRHTSPVFSPANPESSMEDCLAHLGEKVSQELKEPLHKALQMLLSQPVTYQAFRECTLETTVHASGWNKILVPLVLLRQMLLELTRRGQEPLSALLQFGVTYLEDYSAEYIIQQGGWV

SEQ ID NO: 8628 - protein, 104 aa, Artificial Sequence
  Description of Artificial Sequence: Synthetic coding sequence
MASSSTVPLGFHYETKYVVLSYLGLLSQEKLQEQHLSSPQGVQLDIASQSLDQEILLKVKTEIEEELKSLDKEISEGWSAVAPSRPTTTSISQVQMILLSQPPE

SEQ ID NO: 8629 - protein, 201 aa, Artificial Sequence; identical to SEQ ID NO: 8627
  Description of Artificial Sequence: Synthetic coding sequence

SEQ ID NO: 8630 - protein, 361 aa, Artificial Sequence
  Description of Artificial Sequence: Synthetic coding sequence
MKQSMLFSATWDSSLKRSCKSNIFPHPKILVPLVLLRQMLLELTRRGQEPLSALLQFGVTYLEDYSAEYIIQQGGWGTVFSLESEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEVEEVVPALEPTETLLSEKEINAREESLVEELSPASEKKPVPPSEGKSRLSPAGEMKPMPLSEGKSILLFGGAAAVAILAVAIGVALALRKK

SEQ ID NO: 8631 - protein, 323 aa, Artificial Sequence; identical to SEQ ID NO: 8626
  Description of Artificial Sequence: Synthetic coding sequence

SEQ ID NO: 8632 - protein, 171 aa, Artificial Sequence
  Description of Artificial Sequence: Synthetic coding sequence
MASSSTVPLGFHYETKYVVLSYLGLLSQEKLQEQHLSSPQGVQLDIASQSLDQEILLKVKTEIEEELKSLDKEISEAFTSTGFDRHTSPVFSPANPESSMEDCLAHLGEKVSQELKEPLHKALQMLLSQALCLVLSQRRRNTLESLQKIAMTFTSCPATTLDKSVPQSLQL

SEQ ID NO: 8633 - protein, 133 aa, Artificial Sequence
  Description of Artificial Sequence: Synthetic coding sequence
MDKYILDNGKVHLGSGIWVDEEKWHQLQVTQGDSKYTKNLAVMIWGTDVLKNRSVTGVATKKKKDAVPKPPLSPHKLSIVRECLYDRIAQETVDETEIAQRLSKVNKYICEKIMDINKSCKNEERREAKYNLQ

SEQ ID NO: 8634 - protein, 421 aa, Artificial Sequence
  Description of Artificial Sequence: Synthetic coding sequence
MYAFVRFLEDNVCYALPVSCVRDFSPRSRLDFDNQKVYAVYRGPEELGAGPESPPRAPRDWGALLLHKAQILALAEDKSDLENSVMQKKIKIPKLSLNHVEEDGEVKDYGEEDLQLRHIKRPEGRKPSEVAHKSIEAVVARLEKQNGLSLGHSTCPEEVFVEASPGTEDMDSLEDAVVPRALYEELLRNYQQQQEEMRHLQQELERTRRQLVQQAKKLKEYGALVSEMKELRDLNRRLQDVLLLRLGSGPAIDLEKVKSECLEPEPELRSTFSEEANTSSYYPAPAPVMDKYILDNGKVHLGSGIWVDEEKWHQLQVTQGDSKYTKNLAVMIWGTDVLKNRSVTGVATKKKKDAVPKPPLSPHKLSIVRECLYDRIAQETVDETEIAQRLSKVNKYICEKIMDINKSCKNEERREAKYNLQ

SEQ ID NO: 8635 - protein, 323 aa, Artificial Sequence
  Description of Artificial Sequence: Synthetic coding sequence
MKSALFTRFFILLPWILIVIIMLDVDTRRPVPPLTPRPYFSPYAVGRGGARLPLRRGGPAHGTQKRNQSRPQPQPEPQLPTIYAITPTYSRPVQKAELTRLANTFRQVAQLHWILVEDAAARSELVSRFLARAGLPSTHLHVPTPRRYKRPGLPRATEQRNAGLAWLRQRHQHQRAQPGVLFFADDDNTYSLELFQEMRTTRKVSVWPVGLVGGRRYERPLVENGKVVGWYTGWRADRPFAIDMAGFAVSLQVILSNPKAVFKRRGSQPGMQESDFLKQITTVEELEPKANNCTKVLVWHTRTEKVNLANEPKYHLDTVKIEV

SEQ ID NO: 8636 - protein, 331 aa, Artificial Sequence
  Description of Artificial Sequence: Synthetic coding sequence
MASALWTVLPSRMSLRSLKWSLLLLSLLSFFVMWYLSLPHYNVIERVNWMYFYEYEPIYRQDFHFTLREHSNCSHQNPFLVILVTSHPSDVKARQAIRVTWGEKKSWWGYEVLTFFLLGQEAEKEDKMLALSLEDEHLLYGDIIRQDFLDTYNNLTLKTIMAFRWVTEFCPNAKYVMKTDTDVFINTGNLVKYLLNLNHSEKFFTGYPLIDNYSYRGFYQKTHISYQEYPFKVFPPYCSGLGYIMSRDLVPRIYEMMGHVKPIKFEDVYVGICLNLLKVNIHIPEDTNLFFLYRIHLDVCQLRRVIAAHGFSSKEIITFWQVMLRNTTCHY

SEQ ID NO: 8637 - protein, 331 aa, Artificial Sequence; identical to SEQ ID NO: 8636
  Description of Artificial Sequence: Synthetic coding sequence

SEQ ID NO: 8638 - protein, 331 aa, Artificial Sequence; identical to SEQ ID NO: 8636
  Description of Artificial Sequence: Synthetic coding sequence

SEQ ID NO: 8639 - protein, 331 aa, Artificial Sequence; identical to SEQ ID NO: 8636
  Description of Artificial Sequence: Synthetic coding sequence

SEQ ID NO: 8640 - protein, 91 aa, Artificial Sequence
  Description of Artificial Sequence: Synthetic coding sequence
MASALWTVLPSRMSLRSLKWSLLLLSLLSFFVMWYLSLPHYNVIERVNWMYFYEIHLDVCQLRRVIAAHGFSSKEIITFWQVMLRNTTCHY

SEQ ID NO: 8641 - protein, 111 aa, Artificial Sequence
  Description of Artificial Sequence: Synthetic coding sequence
MASALWTVLPSRMSLRSLKWSLLLLSLLSFFVMWYLSLPHYNVIERVNWMYFYEYEPIYRQDFHFTLREHSNCSHQNPFLVILVTSHPSDVKARQAIRVTWGEKKSWWGYE

SEQ ID NO: 8642 - protein, 58 aa, Artificial Sequence
  Description of Artificial Sequence: Synthetic coding sequence
MASALWTVLPSRMSLRSLKWSLLLLSLLSFFVMWYLSLPHYNVIERVNWMYFYEYEPI

SEQ ID NO: 8643 - protein, 331 aa, Artificial Sequence; identical to SEQ ID NO: 8636
  Description of Artificial Sequence: Synthetic coding sequence

SEQ ID NO: 8644 - protein, 41 aa, Artificial Sequence
  Description of Artificial Sequence: Synthetic coding sequence
MASALWTVLPSRMSLRSLKWSLLLLSLLSFFVMWYLSLPHY

SEQ ID NO: 8645 - protein, 331 aa, Artificial Sequence; identical to SEQ ID NO: 8636
  Description of Artificial Sequence: Synthetic coding sequence

SEQ ID NO: 8646 - protein, 65 aa, Artificial Sequence
  Description of Artificial Sequence: Synthetic coding sequence
MASALWTVLPSRMSLRSLKWSLLLLSLLSFFVMWYLSLPHYNVIERVNWMYFYEYEPIYRQDFHF

SEQ ID NO: 8647 - protein, 29 aa, Artificial Sequence
  Description of Artificial Sequence: Synthetic coding sequence
MASALWTVLPSRMSLRSLKWSLLLLSLLS

SEQ ID NO: 8648 - protein, 54 aa, Artificial Sequence
  Description of Artificial Sequence: Synthetic coding sequence
MASALWTVLPSRMSLRSLKWSLLLLSLLSFFVMWYLSLPHYNVIERVNWMYFYE

SEQ ID NO: 8649 - protein, 326 aa, Artificial Sequence
  Description of Artificial Sequence: Synthetic coding sequence
MRNWLVLLCPCVLGAALHLWLRLRSPPPACASGAGPAGGVSLLLPRLECNGAVSAHPNLHLPGSRDSPASASQVAGITDQLALFPQWKSTHYDVVVGVLSARNNHELRNVIRSTWMRHLLQHPTLSQRVLVKFIIGAHGCEVPVEDREDPYSCKLLNITNPVLNQEIEAFSLSEDTSSGLPEDRVVSVSFRVLYPIVITSLGVFYDANDVGFQRNITVKLYQAEQEEALFIARFSPPSCGVQVNKLWYKPVEQFILPESFEGTIVWESQDLHGLVSRNLHKVTVNDGGGVLRVITAGEGALPHEFLEGVEGVAGGFIYTIQGKFAS

SEQ ID NO: 8650 - protein, 321 aa, Artificial Sequence
  Description of Artificial Sequence: Synthetic coding sequence
MRNWLVLLCPCVLGAALHLWLRLRSPPPACASGAGPAGGVSLLLPRLECNGAVSAHPNLHLPGSRDSPASASQVAGITDQLALFPQWKSTHYDVVVGVLSARNNHELRNVIRSTWMRHLLQHPTLSQRVLVKFIIGAHGCEVPVEDREDPYSCKLLNITNPVLNQEIEAFSLSEDTSSGLPEDRVVSVSFRVLYPIVITSLGVFYDANDVGFQRNITVKLYQAEQEEALFIARFSPPSCGVQVNKLWYKPVEQFILPESFEGTIVWESQDLHGLVSRNLHKVTVNDGGGVLRVITAGEGALPHEFLEGVEGVAGGFIYTIQ

SEQ ID NO: 8651 - protein, 500 aa, Artificial Sequence
  Description of Artificial Sequence: Synthetic coding sequence
MRNWLVLLCPCVLGAALHLWLRLRSPPPACASGAGPADQLALFPQWKSTHYDVVVGVLSARNNHELRNVIRSTWMRHLLQHPTLSQRVLVKFIIGAHGCEVPVEDREDPYSCKLLNITNPVLNQEIEAFSLSEDTSSGLPEDRVVSVSFRVLYPIVITSLGVFYDANDVGFQRNITVKLYQAEQEEALFIARFSPPSCGVQVNKLWYKPVEQFILPESFEGTIVWESQDLHGLVSRNLHKVTVNDGGGVLRVITAGEGALPHEFLEGVEGVAGGFIYTIQEGDALLHNLHSRPQRLIDHIRNLHEEDALLKEESSIYDDIVFVDVVDTYRNVPAKLLNFYRWTVETTSFNLLLKTDDDCYIDLEAVFNRIVQKNLDGPNFWWGNFRLNWAVDRTGKWQELEYPSPAYPAFACGSGYVISKDIVKWLASNSGRLKTYQGEDVSMGIWMAAIGPKRYQDSLWLCEKTCETGMLSSPQYSPWELTELWKLKERCGDPCRCQAR

SEQ ID NO: 8652 - protein, 533 aa, Artificial Sequence
  Description of Artificial Sequence: Synthetic coding sequence
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADTVRFSTEGHEAAFTIRIRHPPNPRLYPPGSLPQGAQYNISALVTIATKTFLRYDRLRALITSIRRFYPTVTVVIADDSDKPERVSGPYVEHYLMPFGKGWFAGRNLAVSQVTTKYVLWVDDDFVFTARTRLERLVDVLERTPLDLVGGAVREISGFATTYRQLLSVEPGAPGLGNCLRQRRGFHHELVGFPGCVVTDGVVNFFLARTDKVREVGFDPRLSRVAHLEFFLDGLGSLRVGSCSDVVVDHASKLKLPWTSRDAGAETYARYRYPGSLDESQMAKHRLLFFKHRLQCMTSQ

SEQ ID NO: 8653 - protein, 237 aa, Artificial Sequence
  Description of Artificial Sequence: Synthetic coding sequence
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQEFQAFLSRSQSPADQLLIAPANSPLQYPLQGVEVQPLRSILVPGLSLQAASGQEVYQVNLTASLGTWDVAGEVTGVTLTGEGQADLTLVSPGLDQLNRQLQLVTYSSRSYQTNTADT

SEQ ID NO: 8654 - protein, 120 aa, Artificial Sequence
  Description of Artificial Sequence: Synthetic coding sequence
MWLGRRALCALVLLLACASLGLLYASTRDAPGLRLPLAPWAPPQSPRRPELPDLAPEPRYAHIPVRIKEQVVGLLAWNNCSCESSGGGLPLPFQKQVRAIDLTKAFDPAELRAASATREQ

SEQ ID NO: 8655 - protein, 566 aa, Artificial Sequence
  Description of Artificial Sequence: Synthetic coding sequence
MGSAGFSVGKFHVEVASRGRECVSGTPECGNRLGSAGFGALCLELRGADPAWGPFAAHGRSRRQGSRFLWLLKILVIILVLGIVGFMFGSMFLQAVFSSPKPELPSPAPGVQKLKLLPEERLRNLFSYDGIWLFPKNQCKCEANKEQGGYNFQDAYGQSDLPAVKARRQAEFEHFQRREGLPRPLPLLVQPNLPFGYPVHGVEVMPLHTVPIPGLQFEGPDAPVYEVTLTASLGTLNTLADVPDSVVQGRGQKQLIISTSDRKLLKFILQHVTYTSTGYQHQKVDIVSLESRSSVAKFPVTIRHPVIPKLYDPGPERKLRNLVTIATKTFLRPHKLMIMLRSIREYYPDLTVIVADDSQKPLEIKDNHVEYYTMPFGKGWFAGRNLAISQVTTKYVLWVDDDFLFNEETKIEVLVDVLEKTELDVVGGSVLGNVFQFKLLLEQSENGACLHKRMGFFQPLDGFPSCVVTSGVVNFFLAHTERLQRVGFDPRLQRVAHSEFFIDGLGTLLVGSCPEVIIGHQSRSPVVDSELAALEKTYNTYRSNTLTRVQFKLALHYFKNHLQCAA

SEQ ID NO: 8656 - protein, 506 aa, Artificial Sequence
  Description of Artificial Sequence: Synthetic coding sequence
MTSGGSRFLWLLKILVIILVLGIVGFMFGSMFLQAVFSSPKPELPSPAPGVQKLKLLPEERLRNLFSYDGIWLFPKNQCKCEANKEQGGYNFQDAYGQSDLPAVKARRQAEFEHFQRREGLPRPLPLLVQPNLPFGYPVHGVEVMPLHTVPIPGLQFEGPDAPVYEVTLTASLGTLNTLADVPDSVVQGRGQKQLIISTSDRKLLKFILQHVTYTSTGYQHQKVDIVSLESRSSVAKFPVTIRHPVIPKLYDPGPERKLRNLVTIATKTFLRPHKLMIMLRSIREYYPDLTVIVADDSQKPLEIKDNHVEYYTMPFGKGWFAGRNLAISQVTTKYVLWVDDDFLFNEETKIEVLVDVLEKTELDVVGGSVLGNVFQFKLLLEQSENGACLHKRMGFFQPLDGFPSCVVTSGVVNFFLAHTERLQRVGFDPRLQRVAHSEFFIDGLGTLLVGSCPEVIIGHQSRSPVVDSELAALEKTYNTYRSNTLTRVQFKLALHYFKNHLQCAA

SEQ ID NO: 8657 - protein, 480 aa, Artificial Sequence
  Description of Artificial Sequence: Synthetic coding sequence
MFGSMFLQAVFSSPKPELPSPAPGVQKLKLLPEERLRNLFSYDGIWLFPKNQCKCEANKEQGGYNFQDAYGQSDLPAVKARRQAEFEHFQRREGLPRPLPLLVQPNLPFGYPVHGVEVMPLHTVPIPGLQFEGPDAPVYEVTLTASLGTLNTLADVPDSVVQGRGQKQLIISTSDRKLLKFILQHVTYTSTGYQHQKVDIVSLESRSSVAKFPVTIRHPVIPKLYDPGPERKLRNLVTIATKTFLRPHKLMIMLRSIREYYPDLTVIVADDSQKPLEIKDNHVEYYTMPFGKGWFAGRNLAISQVTTKYVLWVDDDFLFNEETKIEVLVDVLEKTELDVVGGSVLGNVFQFKLLLEQSENGACLHKRMGFFQPLDGFPSCVVTSGVVNFFLAHTERLQRVGFDPRLQRVAHSEFFIDGLGTLLVGSCPEVIIGHQSRSPVVDSELAALEKTYNTYRSNTLTRVQFKLALHYFKNHLQCAA

SEQ ID NO: 8658 - protein, 1039 aa, Artificial Sequence
  Description of Artificial Sequence: Synthetic coding sequence
MPRLPVKKIRKQMKLLLLLLLLSCAAWLTYVHLGLVRQGRALRQRLGYGRDGEKLTSETDGRGVHAAPSTQRAEDSSESREEEQAPEGRDLDMLFPGGAGRLPLNFTHQTPPWREEYKGQVNLHVFEDWCGGAVGHLRRNLHFPLFPHTRTTVKKLAVSPKWKNYGLRIFGFIHPARDGDVQFSVASDDNSEFWLSLDESPAAAQLVAFVGKTGSEWTAPGEFTKFSSQVSKPRRLMASRRYYFELLHKQDDRGSDHVEVGWRAFLPGLKFEVISSAHISLYTDESALKMDHVAHVPQSPASHVGGRPPQEETSADMLRPDPRDTFFLTPRMESSSLENVLEPCAYAPTYVVKDFPIARYQGLQFVYLSFVYPNDYTRLTHMETDNKCFYRESPLYLERFGFYKYMKMDKEEGDEDEEDEVQRRAFLFLNPDDFLDDEDEGELLDSLEPTEAAPPRSGPQSPAPAAPAQPGATLAPPTPPRPRDGGTPRHSRALSWAARAARPLPLFLGRAPPPRPAVEQPPPKVYVTRVRPGQRASPRAPAPRAPWPPFPGVFLHPRPLPRVQLRAPPRPPRPHGRRTGGPQATQPRPPARAQATQGGREGQARTLGPAAPTVDSNLSSEARPVTSFLSLSQVSGPQLPGEGEEEEEGEDDGAPGDEAASEDSEEAAGPALGRWREDAIDWQRTFSVGAVDFELLRSDWNDLRCNVSGNLQLPEAEAVDVTAQYMERLNARHGGRFALLRIVNVEKRRDSARGSRFLLELELQERGGGRLRLSEYVFLRLPGARVGDADGESPEPAPAASVRPDGRPELCRPLRLAWRQDVMVHFIVPVKNQARWVAQFLADMAALHARTGDSRFSVVLVDFESEDMDVERALRAARLPRYQYLRRTGNFERSAGLQAGVDAVEDASSIVFLCDLHIHFPPNILDGIRKHCVEGRLAFAPVVMRLSCGSSPRDPHGYWEVNGFGLFGIYKSDFDRVGGMNTEEFRDQWGGEDWELLDRVLQAGLEVERLRLRNFYHHYHSKRGMWSVRSRKGSRTGAS

SEQ ID NO: 8659 - protein, 118 aa, Artificial Sequence
  Description of Artificial Sequence: Synthetic coding sequence
MRRAGLGEGVPPGNYGNYGYANSGYSACEEENERLTESLRSKVTAIKSLSIEIGHEVKTQNKLLAEMDSQFDSTTGFLGKTMGKLKILSRGSQTKLLCYMMLFSLFVFFIIYWIIKLR

SEQ ID NO: 8660 - protein, 102 aa, Artificial Sequence
  Description of Artificial Sequence: Synthetic coding sequence
MADWARAQSPGAVEEILDRENKRMADSLASKVTRLKSLALDIDRDAEDQNRYLDGMVRAHGVRVSVPCPSTTCCRACSVSFSTGAGGWSNHHFCVILLGFLP

SEQ ID NO: 8661 - protein, 111 aa, Artificial Sequence
  Description of Artificial Sequence: Synthetic coding sequence
MADWARAQSPGAVEEILDRENKRMADSLASKVTRLKSLALDIDRDAEDQNRYLDGMDSDFTSMTSLLTGSVKRFSTMARSGQDNRKLLCGMAVGLIVAFFILSYFLSRART

SEQ ID NO: 8662 - protein, 1115 aa, Artificial Sequence
  Description of Artificial Sequence: Synthetic coding sequence
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLANLQDFKLDVQHVIEVDEGNTAVIACHLPESHPKAQVRYSVKQEWLEASRGNYLIMPSGNLQIVNASQEDEGMYKCAAYNPVTQEVKTSGSSDRLRVRRSTAEAARIIYPPEAQTIIVTKGQSLILECVASGIPPPRVTWAKDGSSVTGYNKTRFLLSNLLIDTTSEEDSGTYRCMADNGVGQPGAAVILYNVQVFEPPEVTMELSQLVIPWGQSAKLTCEVRGNPPPSVLWLRNAVPLISSQRLRLSRRALRVLSMGPEDEGVYQCMAENEVGSAHAVVQLRTSRPSITPRLWQDAELATGTPPVSPSKLGNPEQMLRGQPALPRPPTSVGPASPQCPGEKGQGAPAEAPIILSSPRTSKTDSYELVWRPRHEGSGRAPILYYVVKHRKQVTNSSDDWTISGIPANQHRLTLTRLDPGSLYEVEMAAYNCAGEGQTAMVTFRTGRRPKPEIMASKEQQIQRDDPGASPQSSSQPDHGRLSPPEAPDRPTISTASETSVYVTWIPRGNGGFPIQSFRVEYKKLKKVGDWILATSAIPPSRLSVEITGLEKGTSYKFRVRALNMLGESEPSAPSRPYVVSGYSGRVYERPVAGPYITFTDAVNETTIMLKWMYIPASNNNTPIHGFYIYYRPTDSDNDSDYKKDMVEGDKYWHSISHLQPETSYDIKMQCFNEGGESEFSNVMICETKARKSSGQPGRLPPPTLAPPQPPLPETIERPVGTGAMVARSSDLPYLIVGVVLGSIVLIIVTFIPFCLWRAWSKQKHTTDLGFPRSALPPSCPYTMVPLGGLPGHQASGQPYLSGISGRACANGIHMNRGCPSAAVGYPGMKPQQHCPGELQQQSDTSSLLRQTHLGNGYDPQSHQITRGPKSSPDEGSFLYTLPDDSTHQLLQPHHDCCQRQEQPAAVGQSGVRRAPDSPVLEAVWDPPFHSGPPCCLGLVPVEEVDSPDSCQVSGGDWCPQHPVGAYVGQEPGMQLSPGPLVRVSFETPPLTI

SEQ ID NO: 8663 - protein, 1114 aa, Artificial Sequence
  Description of Artificial Sequence: Synthetic coding sequence
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLANLQDFKLDVQHVIEVDEGNTAVIACHLPESHPKAQVRYSVKQEWLEASRGNYLIMPSGNLQIVNASQEDEGMYKCAAYNPVTQEVKTSGSSDRLRVRRSTAEAARIIYPPEAQTIIVTKGQSLILECVASGIPPPRVTWAKDGSSVTGYNKTRFLLSNLLIDTTSEEDSGTYRCMADNGVGQPGAAVILYNVQVFEPPEVTMELSQLVIPWGQSAKLTCEVRGNPPPSVLWLRNAVPLISSQRLRLSRRALRVLSMGPEDEGVYQCMAENEVGSAHAVVQLRTSRPSITPRLWQDAELATGTPPVSPSKLGNPEQMLRGQPALPRPPTSVGPASPQCPGEKGQGAPAEAPIILSSPRTSKTDSYELVWRPRHEGSGRAPILYYVVKHRKVTNSSDDWTISGIPANQHRLTLTRLDPGSLYEVEMAAYNCAGEGQTAMVTFRTGRRPKPEIMASKEQQIQRDDPGASPQSSSQPDHGRLSPPEAPDRPTISTASETSVYVTWIPRGNGGFPIQSFRVEYKKLKKVGDWILATSAIPPSRLSVEITGLEKGTSYKFRVRALNMLGESEPSAPSRPYVVSGYSGRVYERPVAGPYITFTDAVNETTIMLKWMYIPASNNNTPIHGFYIYYRPTDSDNDSDYKKDMVEGDKYWHSISHLQPETSYDIKMQCFNEGGESEFSNVMICETKARKSSGQPGRLPPPTLAPPQPPLPETIERPVGTGAMVARSSDLPYLIVGVVLGSIVLIIVTFIPFCLWRAWSKQKHTTDLGFPRSALPPSCPYTMVPLGGLPGHQASGQPYLSGISGRACANGIHMNRGCPSAAVGYPGMKPQQHCPGELQQQSDTSSLLRQTHLGNGYDPQSHQITRGPKSSPDEGSFLYTLPDDSTHQLLQPHHDCCQRQEQPAAVGQSGVRRAPDSPVLEAVWDPPFHSGPPCCLGLVPVEEVDSPDSCQVSGGDWCPQHPVGAYVGQEPGMQLSPGPLVRVSFETPPLTI

SEQ ID NO: 8664 - protein, 22 aa, Artificial Sequence
  Description of Artificial Sequence: Synthetic coding sequence
MLRGTMTAWRGMRPEVTLACLL

SEQ ID NO: 8665 - protein, 85 aa, Artificial Sequence
  Description of Artificial Sequence: Synthetic coding sequence
MLRGTMTAWRGMRPEVTLACLLLATAGCFADLNEVPQVTVQPASTVQKPGGTVILGCVVEPPRMNVTWRLNGKELNGSDDALGVL

SEQ ID NO: 8666 - protein, 157 aa, Artificial Sequence
  Description of Artificial Sequence: Synthetic coding sequence
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLASESAPLPPCHGAVPPHLSHPEAPTIHAASCYS

SEQ ID NO: 8667 - protein, 157 aa, Artificial Sequence; identical to SEQ ID NO: 8666
  Description of Artificial Sequence: Synthetic coding sequence

SEQ ID NO: 8668 - protein, 32 aa, Artificial Sequence
  Description of Artificial Sequence: Synthetic coding sequence
MLRGTMTAWRGMRPEVTLACLLLATAGCFADL

SEQ ID NO: 8669 - protein, 1114 aa, Artificial Sequence; identical to SEQ ID NO: 8663
  Description of Artificial Sequence: Synthetic coding sequence

SEQ ID NO: 8670 - protein, 208 aa, Artificial Sequence
  Description of Artificial Sequence: Synthetic coding sequence
MRYACSSSEDWPPPLDISSDGDVDATVLRELYPDSPPGVSLSRLRWSAMMYTGSFTYWVRSMLSRHKLDAILGRLGYTATLESEFSLVQAISKENVKQMVFKIFLVRVSCEAVLRTAGTRMLEPGTEKLARTHSRHSSEKRLVKPCSCLEGVQPGPGSGGPQQGPSEGVGSETALAEGTAGQRSLPMALSPSEVSTAPNSLPSGSPVL

SEQ ID NO: 8671 - protein, 250 aa, Artificial Sequence
  Description of Artificial Sequence: Synthetic coding sequence
ARYNRTSYFYPTFSESSEHSHLLVSPVLVASAVIGVVIILSCITIIVGSIRRDRQARLQRHRHRHHRHHHHHHHHRRRRHREYEHGYVSDEHTYSRSSRRMRYACSSSEDWPPPLDISSDGDVDATVLRELYPDSPPGYEECVGPGATQLYVPTDAPPPYSLTDSCPTLDGTSDSGSGHSPGRHQQEQRTPAQGGLHTVSMDTLPPYEAVCGAGPPSGLLPLPGPDPGPRGSQGSPTPTRAPASGPERIV

SEQ ID NO: 8672 - protein, 259 aa, Artificial Sequence
  Description of Artificial Sequence: Synthetic coding sequence
MSFKRPCPLARYNRTSYFYPTFSESSEHSHLLVSPVLVASAVIGVVIILSCITIIVGSIRRDRQARLQRHRHRHHRHHHHHHHHRRRRHREYEHGYVSDEHTYSRSSRRMRYACSSSEDWPPPLDISSDGDVDATVLRELYPDSPPGYEECVGPGATQLYVPTDAPPPYSLTDSCPTLDGTSDSGSGHSPGRHQQEQRTPAQGGLHTVSMDTLPPYEAVCGAGPPSGLLPLPGPDPGPRGSQGSPTPTRAPASGPERIV

SEQ ID NO: 8673 - protein, 127 aa, Artificial Sequence [sequence omitted]

SEQ ID NO: 8674 - protein, 127 aa, Artificial Sequence [sequence omitted]

SEQ ID NO: 8675 - protein, 105 aa, Artificial Sequence
  Description of Artificial Sequence: Synthetic coding sequence
MSAAGARGLRATYHRLLDKVELMLPEKLRPLYNHPAGPRTVFFWAPIMKWGLVCAGLADMARPAEKLSTAQSAVLMATGFIWSRYSLVIIPKNWSLFAVNFFVGA

SEQ ID NO: 8676 - protein, 109 aa, Artificial Sequence
  Description of Artificial Sequence: Synthetic coding sequence
MAGALVRKAADYVRSKDFRDYLMSKHFWGPVANWGLPIAAINDMKKSPEIISGRMTFALCCYSLTFMRFAYKVQPRNWLLFACHATNEVAQLIQGGRLIKHEMTKTASA

SEQ ID NO: 8677 - protein, 109 aa, Artificial Sequence
  Description of Artificial Sequence: Synthetic coding sequence
MAGALVRKAADYVRSKDFRDYLMSTHFWGPVANWGLPIAAINDMKKSPEIISGRMTFALCCYSLTFMRFAYKVQPRNWLLFACHATNEVAQLIQGGRLIKHEMTKTASA

SEQ ID NO: 8678 - protein, 66 aa, Artificial Sequence
  Description of Artificial Sequence: Synthetic coding sequence
MKKSPEIISGRMTFALCCYSLTFMRFAYKVQPRNWLLFACHATNEVAQLIQGGRLIKHEMTKTASA

SEQ ID NO: 8679 - protein, 412 aa, Artificial Sequence
  Description of Artificial Sequence: Synthetic coding sequence
MILASVLRSGPGGGLPLRPLLGPALALRARSTSATDTHHVEMARERSKTVTSFYNQSAIDAAAEKPSVRLTPTMMLYAGRSQDGSHLLKSARYLQQELPVRIAHRIKGFRCLPFIIGCNPTILHVHELYIRAFQKLTDFPPIKDQADEAQYCQLVRQLLDDHKDVVTLLAEGLRESRKHIEDEKLVRYFLDKTLTSRLGIRMLATHHLALHEDKPDFVGIICTRLSPKKIIEKWVDFARRLCEHKYGNAPRVRINGHVAARFPFIPMPLDYILPELLKNAMRATMESHLDTPYNVPDVVITIANNDVDLIIRISDRGGGIAHKDLDRVMDYHFTTAEASTQDPRISPLFGHLDMHSGAQSGPMHGFGFGLPTSRAYAEYLGGSLQLQSLQGIGTDVYLRLRHIDGREESFRI

SEQ ID NO: 8680 - protein, 335 aa, Artificial Sequence
  Description of Artificial Sequence: Synthetic coding sequence
MILASVLRSGPGGGLPLRPLLGPALALRARSTSATDTHHVEMARERSKTVTSFYNQSAIDAAAEKPSVRLTPTMMLYAGRSQDGSHLLKSARYLQQELPVRIAHRIKGFRCLPFIIGCNPTILHVHELYIRAFQKLTDFPPIKDQADEAQYCQLVRQLLDDHKDVVTLLAEGLRESRKHIEDEKLVRYFLDKTLTSRLGIRMLATHHLALHEDKPDFVGIICTRLSPKKIIEKWVDFARRLCEHKYGNAPRVRINGHVAARFPFIPMPLDYILPELLKNAMRISDRGGGIAHKDLDRVMDYHFTTAEASTQDPRISPLFGHLDMHSGAQSGPMHG

SEQ ID NO: 8681 - protein, 365 aa, Artificial Sequence
  Description of Artificial Sequence: Synthetic coding sequence
MILASVLRSGPGGGLPLRPLLGPALALRARSTSATDTHHVEMARERSKTVTSFYNQSAIDAAAEKPSVRLTPTMMLYAGRSQDGSHLLKSARYLQQELPVRIAHRIKGFRCLPFIIGCNPTILHVHELYIRAFQKLTDFPPIKDQADEAQYCQLVRQLLDDHKDVVTLLAEGLRESRKHIEDEKLVRYFLDKTLTSRLGIRMLATHHLALHEDKPDFVGIICTRLSPKKIIEKWVDFARRLCEHKYGNAPRVRINGHVAARFPFIPMPLDYILPELLKNAMRATMESHLDTPYNVPDVVITIANNDVDLIIRISDRGGGIAHKDLDRVMDYHFTTAEASTQDPRISPLFGHLDMHSGAQSGPMHG

SEQ ID NO: 8682 - protein, 412 aa, Artificial Sequence; identical to SEQ ID NO: 8679
  Description of Artificial Sequence: Synthetic coding sequence

SEQ ID NO: 8683 - protein, 251 aa, Artificial Sequence
  Description of Artificial Sequence: Synthetic coding sequence
MGARASGGPLARAGLLLLLLLLLLLGLLAPGAQGARGRGGAEKNSYRRTVNTFSQSVSSLFGEDNVRAAQKFLARLTERFVLGVDMFVETLWKVWTELLDVLGLDVSNLSQYFSPASVSSSPARALLLVGVVLLAYWFLSLTLGFTFSVLHVVFGRFFWIVRVVLFSMSCVYILHKYEGEPENAVLPLCFVVAVYFMTGPMGFYWRSSPSGPSNPSNPSVEEKLEHLEKQVRLLNIRLNRVLESLDRSKDK

SEQ ID NO: 8684 - protein, 411 aa, Artificial Sequence
  Description of Artificial Sequence: Synthetic coding sequence
MTHWFHRNPLKATAPVSFNYYGVVTGPSASKICNDLRSSRARLLELFTDLSCNPEMMKNAADSYFSLLQGFINSLDESTQESKLRYIQNFKWTDTLQGQVPSAQQDAVFELISMGFNVALWYTKYASRLAGKENITEDEAKEVHRSLKIAAGIFKHLKESHLPKLITPAEKGRDLESRLIEAYVIQCQAEAQEVTIARAIELKHAPGLIAALAYETANFYQKADHTLSSLEPAYSAKWRKYLHLKMCFYTAYAYCYHGETLLASDKCGEAIRSLQEAEKLYAKAEALCKEYGETKGPGPTVKPSGHLFFRKLGNLVKNTLEKCQRENGFIYFQKIPTEAPQLELKANYGLVEPIPFEFPPTSVQWTPETLAAFDLTKRPKDDSTKPKPEEEVKPVKEPDIKPQKDTGCYIS

SEQ ID NO: 8685 - protein, 215 aa, Artificial Sequence
  Description of Artificial Sequence: Synthetic coding sequence
MTHWFHRNPLKATAPVSFNYYGVVTGPSASKICNDLRSSRARLLELFTDLSCNPEMMKNAADSYFSLLQGFINSLDESTQESKLRYIQNFKWTDTLQGQVPSAQQDAVFELISMGFNVALWYTKYASRLAGKENITEDEAKEVHRSLKIAAGIFKHLKESHLPKLITPAEKGRDLESRLIEAYVIQCQAEAQEVTIARAIELKHAPGLIAALAYE

SEQ ID NO: 8686 - protein, 338 aa, Artificial Sequence
  Description of Artificial Sequence: Synthetic coding sequence
MTHWFHRNPLKATAPVSFNYYGVVTGPSASKICNDLRSSRARLLELFTDLSCNPEMMKNAADSYFSLLQGFINSLDESTQESKLRYIQNFKWTDTLQGQVPSAQQDAVFELISMGFNVALWYTKYASRLAGKENITEDEAKEVHRSLKIAAGIFKHLKESHLPKLITPAEKGRDLESRLIEAYVIQCQAEAQEVTIARAIELKHAPGLIAALAYETANFYQKADHTLSSLEPAYSAKWRKYLHLKMCFYTAYAYCYHGETLLASDKCGEAIRSLQEAEKLYAKAEALCKEYGETKGPGPTVKPSGHLFFRKLGNLVKNTLEKCQRENGFILNPNQKKK

SEQ ID NO: 8687 - protein, 379 aa, Artificial Sequence
  Description of Artificial Sequence: Synthetic coding sequence
MTHWFHRNPLKATAPVSFNYYGVVTGPSASKICNDLRSSRARLLELFTDLSCNPEMMKNAADSYFSLLQGFINSLDESTQESKLRYIQNFKWTDTLQGQVPSITEDEAKEVHRSLKIAAGIFKHLKESHLPKLITPAEKGRDLESRLIEAYVIQCQAEAQEVTIARAIELKHAPGLIAALAYETANFYQKADHTLSSLEPAYSAKWRKYLHLKMCFYTAYAYCYHGETLLASDKCGEAIRSLQEAEKLYAKAEALCKEYGETKGPGPTVKPSGHLFFRKLGNLVKNTLEKCQRENGFIYFQKIPTEAPQLELKANYGLVEPIPFEFPPTSVQWTPETLAAFDLTKRPKDDSTKPKPEEEVKPVKEPDIKPQKDTGCYIS

SEQ ID NO: 8688 - protein, 951 aa, Artificial Sequence
  Description of Artificial Sequence: Synthetic coding sequence
MATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASGAPTLSRLLEAGPTQFTTPLASFTTVASEPPVKLVPPPVESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDSVPMGSPAFLLSLFDGGTRGRRCAIEADMKMKK

SEQ ID NO: 8689 - protein, 757 aa, Artificial Sequence
  Description of Artificial Sequence: Synthetic coding sequence
LAKKITLKKKLEEEEAEVKRKATDAAYQARQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDGGTRGRRCAIEADMKMKK

SEQ ID NO: 8690 - protein, 1235 aa, Artificial Sequence
  Description of Artificial Sequence: Synthetic coding sequence
MATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVNESEMAVASGHLNSTGVLLEVGGVLPMIHGGEIQQTPNTVAASPAASGAPTLSRLLEAGPTQFTTPLASFTTVASEPPVKLVPPPVESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDSVPMGSPAFLLSLFMGHEWVWLDSEQDHPNDSELSNDCRSLFSSWDSSLDLDVGNWRETEDPEAEELEESSPEREPSELLVGDGGSEESQEAARKASHQNLLHFLSEVAYLMEPLCISSNESSEGCCPPSGTRQEGREIKASEGERELCRETEELSAKGDPLVAEKPLGENGKPEVASAPSVICTVQGLLTESEEGEAQQESKGEDQGEVYVSEMEDQPPSGECDDAFNIKETPLVDTLFSHATSSKLTDLSQDDPVQDHLLFKKTLLPVWKMIASHRFSSPFLKPVSERQAPGYKDVVKRPMDLTSLKRNLSKGRIRTMAQFLRDLMLMFQNAVMYNDSDHHVYHMAVEMRQEVLEQIQVLNIWLDKRKGSSSLEGEPANPVDDGKPVF

SEQ ID NO: 8691 - protein, 866 aa, Artificial Sequence
  Description of Artificial Sequence: Synthetic coding sequence
MATGTGKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDGGTRGRRCAIEADMKMKK

SEQ ID NO: 8692 - protein, 861 aa, Artificial Sequence
  Description of Artificial Sequence: Synthetic coding sequence
GKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDGGTRGRRCAIEADMKMKK

SEQ ID NO: 8693 - protein, 892 aa, Artificial Sequence
  Description of Artificial Sequence: Synthetic coding sequence
GKHKLLSTGPTEPWSIREKLCLASSVMRSGDQNWVSVSRAIKPFAEPGRPPDWFSQKHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVTPGTLPSTPVTSFPGIPDTLPPGSAPLEAPMTPVTDDSPQKKMLGQKATPPPSPLLSELLKKGSLLPTSPRLVNESEMAVASGHLNSTGVLLEVGGVLPMIHGGEIQQTPNTVAASPAASESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDGGTRGRRCAIEADMKMKK

SEQ ID NO: 8694 - protein, 837 aa, Artificial Sequence
  Description of Artificial Sequence: Synthetic coding sequence
MVHPREAMFSIFCHEKWRSKLHCASQYSELLETTETPKRKRGEKGEVVETVEDVIVRKLTAERVEELKKVIKETQERYRRLKRDAELIQAGHMDSRLDELCNDIATKKKLEEEEAEVKRKATDAAYQARQAVKTPPRRLPTVMVRSPIDSASPGGDYPLGDLTPTTMEEATSGVNESEMAVASGHLNSTGVLLEVGGVLPMIHGGEIQQTPNTVAASPAASGAPTLSRLLEAGPTQFTTPLASFTTVASEPPVKLVPPPVESVSQATIVMMPALPAPSSAPAVSTTESVAPVSQPDNCVPMEAVGDPHTVTVSMDSSEISMIINSIKEECFRSGVAEAPVGSKAPSIDGKEELDLAEKMDIAVSYTGEELDFETVGDIIAIIEDKVDDHPEVLDVAAVEAALSFCEENDDPQSLPGPWEHPIQQERDKPVPLPAPEMTVKQERLDFEETENKGIHELVDIREPSAEIKVEPAEPEPVISGAEIVAGVVPATSMEPPELRSQDLDEELGSTAAGEIVEADVAIGKGDETPLTNVKTEASPESMLSPSHGSNPIEDPLEAETQHKFEMSDSLKEESGTIFGSQIKDAPGEDEEEDGVSEAASLEEPKEEDQGEGYLSEMDNEPPVSESDDGFSIHNATLQSHTLADSIPSSPASSQFSVCSEDQEAIQAQKIWKKAIMLVWRAAANHRYANVFLQPVTDDIAPGYHSIVQRPMDLSTIKKNIENGLIRSTAEFQRDIMLMFQNAVMYNSSDHDVYHMAVEMQRDVLEQIQQFLATQLIMQTSESGISAKSLRGRDSTRKQDASEKDSVPMGSPAFLLSLFDGGTRGRRCAIEADMKMKK

SEQ ID NO: 8695 - protein, 1104 aa, Artificial Sequence
  Description of Artificial Sequence: Synthetic coding sequence
MARRGKKPVVRTLEDLTLDSGYGGAADSVRSSNLSLCCSDSHPASPYGGSCWPPLADSMHSRHNSFDTVNTALVEDSEGLDCAGQHCSRLLPDLDEVPWTLQELEALLLRSRDPRAGPAVPGGLPKDALAKLSTLVSRALVRIAKEAQRLSLRFAKCTKYEIQSAMEIVLSWGLAAHCTAAALAALSLYNMSSAGGDRLGRGKSARCGLTFSVGRVYRWMVDSRVALRIHEHAAIYLTACMESLFRDIYSRVVASGVPRSCSGPGSGSGSGPGPSSGPGAAPAADKEREAPGGGAASGGACSAASSASGGSSCCAPPAAAAAAVPPAAAANHHHHHHHALHEAPKFTVETLEHTVNNDSEIWGLLQPYQHLICGKNASGVLCLPDSLNLHRDPQRSNKPGELPMFSQSELRTIEQSLLATRVGSIAELSDLVSRAMHHLQPLNAKHHGNGTPLHHKQGALYWEPEALYTLCYFMHCPQMEWENPNVEPSKVNLQVERPFLVLPPLMEWIRVAVAHAGHRRSFSMDSDDVRQAARLLLPGVDCEPRQLRADDCFCASRKLDAVAIEAKFKQDLGFRMLNCGRTDLVKQAVSLLGPDGINTMSEQGMTPLMYACVRGDEAMVQMLLDAGADLNVEVVSTPHKYPSVHPETRHWTALTFAVLHGHIPVVQLLLDAGAKVEGSVEHGEENYSETPLQLAAAVGNFELVSLLLERGADPLIGTMYRNGISTTPQGDMNSFSQAAAHGHRNVFRKLLAQPEKEKSDILSLEEILAEGTDLAETAPPPLCASRNSKAKLRALREAMYHSAEHGYVDVTIDIRSIGVPWTLHTWLESLRIAFQQHRRPLIQCLLKEFKTIQEEEYTEELVTQGLPLMFEILKASKNEVISQQLCVIFTHCYGPYPIPKLTEIKRKQTSRLDPHFLNNKEMSDVTFLVEGRPFYAHKVLLFTASPRFKALLSSKPTNDGTCIEIGYVKYSIFQLVMQYLYYGGPESLLIKNNEIMELLSAAKFFQLEALQRHCEIICAKSINTDNCVDIYNHAKFLGVTELSAYCEGYFLKNMMVLIENEAFKQLLYDKNGEGTGQDVLQDLQRTLAIRIQSIHLSSSKGSVV

SEQ ID NO: 8696 - protein, 641 aa, Artificial Sequence
  Description of Artificial Sequence: Synthetic coding sequence
MRKLRPKDSREPAPGSPVRSGCLQRLSHYSGIQRPFLVLPPLMEWIRVAVAHAGHRRSFSMDSDDVRQAARLLLPGVDCEPRQLRADDCFCASRKLDAVAIEAKFKQDLGFRMLNCGRTDLVKQAVSLLGPDGINTMSEQGMTPLMYACVRGDEAMVQMLLDAGADLNVEVVSTPHKYPSVHPETRHWTALTFAVLHGHIPVVQLLLDAGAKVEGSVEHGEENYSETPLQLAAAVGNFELVSLLLERGADPLIGTMYRNGISTTPQGDMNSFSQAAAHGHRNVFRKLLAQPEKEKSDILSLEEILAEGTDLAETAPPPLCASRNSKAKLRALREAMYHSAEHGYVDVTIDIRSIGVPWTLHTWLESLRIAFQQHRRPLIQCLLKEFKTIQEEEYTEELVTQGLPLMFEILKASKNEVISQQLCVIFTHCYGPYPIPKLTEIKRKQTSRLDPHFLNNKEMSDVTFLVEGRPFYAHKVLLFTASPRFKALLSSKPTNDGTCIEIGYVKYSIFQLVMQYLYYGGPESLLIKNNEIMELLSAAKFFQLEALQRHCEIICAKSINTDNCVDIYNHAKFLGVTELSAYCEGYFLKNMMVLIENEAFKQLLYDKNGEGTGQDVLQDLQRTLAIRIQSIHLSSSKGSVV

SEQ ID NO: 8697 - protein, 985 aa, Artificial Sequence
  Description of Artificial Sequence: Synthetic coding sequence
MARRGKKPVVRTLEDLTLDSGYGGAADSVRSSNLSLCCSDSHPASPYGGSCWPPLADSMHSRHNSFDTVNTALVEDSEGLDCAGQHCSRLLPDLDEVPWTLQELEALLLRSRDPRAGPAVPGGLPKDALAKLSTLVSRALVRIAKEAQRLSLRFAKCTKYEIQSAMEIVLSWGLAAHCTAAALAALSLYNMSSAGGDRLGRGKSARCGLTFSVGRVYRWMVDSRVALRIHEHAAIYLTACMESLFRDIYSRVVASGVPRSCSGPGSGSGSGPGPSSGPGAAPAADKEREAPGGGAASGGACSAASSASGGSSCCAPPAAAAAAVPPAAAANHHHHHHHALHEAPKFTVETLEHTVNNDSEIWGLLQPYQHLICGKNASGVLCLPDSLNLHRDPQRSNKPGELPMFSQSELRTIEQSLLATRVGSIAELSDLVSRAMHHLQPLNAKHHGNGTPLHHKQGALYWEPEALYTLCYFMHCPQMEWENPNVEPSKVNLQVERPFLVLPPLMEWIRVAVAHAGHRRSFSMDSDDVRQAARLLLPGVDCEPRQLRADDCFCASRKLDAVAIEAKFKQDLGFRMLNCGRTDLVKQAVSLLGPDGINTMSEQGMTPLMYACVRGDEAMVQMLLDAGADLNVEVVSTPHKYPSVHPETRHWTALTFAVLHGHIPVVQLLLDAGAKVEGSVEHGEENYSETPLQLAAAVGVPWTLHTWLESLRIAFQQHRRPLIQCLLKEFKTIQEEEYTEELVTQGLPLMFEILKASKNEVISQQLCVIFTHCYGPYPIPKLTEIKRKQTSRLDPHFLNNKEMSDVTFLVEGRPFYAHKVLLFTASPRFKALLSSKPTNDGTCIEIGYVKYSIFQLVMQYLYYGGPESLLIKNNEIMELLSAAKFFQLEALQRHCEIICAKSINTDNCVDIYNHAKFLGVTELSAYCEGYFLKNMMVLIENEAFKQLLYDKNGEGTGQDVLQDLQRTLAIRIQSIHLSSSKGSVV

SEQ ID NO: 8698 - protein, 1007 aa, Artificial Sequence
  Description of Artificial Sequence: Synthetic coding sequence
MARRGKKPVVRTLEDLTLDSGYGGAADSVRSSNLSLCCSDSHPASPYGGSCWPPLADSMHSRHNSFDTVNTALVEDSEGLDCAGQHCSRLLPDLDEVPWTLQELEALLLRSRDPRAGPAVPGGLPKDALAKLSTLVSRALVRIAKEAQRLSLRFAKCTKYEIQSAMEIVLSWGLAAHCTAAALAALSLYNMSSAGGDRLGRGKSARCGLTFSVGRVYRWMVDSRVALRIHEHAAIYLTACMESLFRDIYSRVVASGVPRSCSGPGSGSGSGPGPSSGPGAAPAADKEREAPGGGAASGGACSAASSASGGSSCCAPPAAAAAAVPPAAAANHHHHHHHALHEAPKFTVETLEHTVNNDSEIWGLLQPYQHLICGKNASGVLCLPDSLNLHRDPQRSNKPGELPMFSQSELRTIEQSLLATRVGSIAELSDLVSRAMHHLQPLNAKHHGNGTPLHHKQGALYWEPEALYTLCYFMHCPQMEWENPNVEPSKVNLQVERPFLVLPPLMEWIRVAVAHAGHRRSFSMDSDDVRQAARLLLPGVDCEPRQLRADDCFCASRKLDAVAIEAKFKQDLGFRMLNCGRTDLVKQAVSLLGPDGINTMSEQGMTPLMYACVRGDEAMVQMLLDAGADLNVEVVSTPHKYPSVHPETRHWTALTFAVLHGHIPVVQLLLDAGAKVEGSVEHGEENYSETPLQLAAAVGNFELVSLLLERGADPLIGTMYRNGISTTPQGDMNSFSQAAAHGHRNVFRKLLAQPEKEKSDILSLEEILAEGTDLAETAPPPLCASRNSKAKLRALREAMYHSAEHGYVDVTIDIRSIGVPWTLHTWLESLRIAFQQHRRPLIQCLLKEFKTIQEEEYTEELVTQGLPLMFEILKASKNEVISQQLCVIFTHCYGPYPIPKLTEIKRKQTSRLDPHFLNNKEMSDVTFLVEGRPFYAHKVLLFTASPRFKALLSSKPTNDGTCIEIGYVKYSIFQLVMQYLYYGGPESLLIKNNEIMEVRDPLWCWLS

SEQ ID NO: 8699 - protein, 183 aa, Artificial Sequence
  Description of Artificial Sequence: Synthetic coding sequence
MSDVTFLVEGRPFYAHKVLLFTASPRFKALLSSKPTNDGTCIEIGYVKYSIFQLVMQYLYYGGPESLLIKNNEIMELLSAAKFFQLEALQRHCEIICAKSINTDNCVDIYNHAKFLGVTELSAYCEGYFLKNMMVLIENEAFKQLLYDKNGEGTGQDVLQDLQRTLAIRIQSIHLSSSKGSVV

SEQ ID NO: 8700 - protein, 347 aa, Artificial Sequence
  Description of Artificial Sequence: Synthetic coding sequence
MALMLSLVLSLLKLGSGQWQVFGPDKPVQALVGEDAAFSCFLSPKTNAEAMEVRFFRGQFSSVVHLYRDGKDQPFMQMPQYQGRTKLVKDSIAEGRISLRLENITVLDAGLYGCRISSQSYYQKAIWELQVSALGSVPLISITGYVDRDIQLLCQSSGWFPRPTAKWKGPQGQDLSTDSRTNRDMHGLFDVEISLTVQENAGSISCSMRHAHLSREVESRVQIGDTFFEPISWHLATKVLGILCCGLFFGIVGLKIFFSKFQCKREREAWAGALFMVPAGTGSEMLPHPAASLLLVLASRGPGPKKENPGGTGLEKKARTGRIERRPETRSGGDSGSRDGSPEALRF

SEQ ID NO: 8701 - protein, 500 aa, Artificial Sequence
  Description of Artificial Sequence: Synthetic coding sequence
MALMLSLVLSLLKLGSGQWQVFGPDKPVQALVGEDAAFSCFLSPKTNAEAMEVRFFRGQFSSVVHLYRDGKDQPFMQMPQYQGRTKLVKDSIAEGRISLRLENITVLDAGLYGCRISSQSYYQKAIWELQVSALGSVPLISITGYVDRDIQLLCQSSGWFPRPTAKWKGPQGQDLSTDSRTNRDMHGLFDVEISLTVQENAGSISCSMRHAHLSREVESRVQIGDTFFEPISWHLATKVLGILCCGLFFGIVGLKIFFSKFQWKIQAELDWRRKHGQAELRDARKHAVEVTLDPETAHPKLCVSDLKTVTHRKAPQEVPHSEKRFTRKSVVASQSFQAGKHYWEVDGGHNKRWRVGVCRDDVDRRKEYVTLSPDHGYWVLRLNGEHLYFTLNPRFISVFPRTPPTKIGVFLDYECGTISFFNINDQSLIYTLTCRFEGLLRPYIEYPSYNEQNGTPIVICPVTQESEKEASWQRASAIPETSNSESSSQATTPFLPRGEM

SEQ ID NO: 8702 - protein, 316 aa, Artificial Sequence
  Description of Artificial Sequence: Synthetic coding sequence
MHGLFDVEISLTVQENAGSISCSMRHAHLSREVESRVQIGDTFFEPISWHLATKVLGILCCGLFFGIVGLKIFFSKFQWKIQAELDWRRKHGQAELRDARKHAVEVTLDPETAHPKLCVSDLKTVTHRKAPQEVPHSEKRFTRKSVVASQSFQAGKHYWEVDGGHNKRWRVGVCRDDVDRRKEYVTLSPDHGYWVLRLNGEHLYFTLNPRFISVFPRTPPTKIGVFLDYECGTISFFNINDQSLIYTLTCRFEGLLRPYIEYPSYNEQNGTPIVICPVTQESEKEASWQRASAIPETSNSESSSQATTPFLPRGEM

SEQ ID NO: 8703 - protein, 375 aa, Artificial Sequence
  Description of Artificial Sequence: Synthetic coding sequence
MWTWFVKSLGSVPLISITGYVDRDIQLLCQSSGWFPRPTAKWKGPQGQDLSTDSRTNRDMHGLFDVEISLTVQENAGSISCSMRHAHLSREVESRVQIGDTFFEPISWHLATKVLGILCCGLFFGIVGLKIFFSKFQWKIQAELDWRRKHGQAELRDARKHAVEVTLDPETAHPKLCVSDLKTVTHRKAPQEVPHSEKRFTRKSVVASQSFQAGKHYWEVDGGHNKRWRVGVCRDDVDRRKEYVTLSPDHGYWVLRLNGEHLYFTLNPRFISVFPRTPPTKIGVFLDYECGTISFFNINDQSLIYTLTCRFEGLLRPYIEYPSYNEQNGTPIVICPVTQESEKEASWQRASAIPETSNSESSSQATTPFLPRGEM

SEQ ID NO: 8704 - protein, 340 aa, Artificial Sequence
  Description of Artificial Sequence: Synthetic coding sequence
MALMLSLVLSLLKLGSGQWQVFGPDKPVQALVGEDAAFSCFLSPKTNAEAMEVRFFRGQFSSVVHLYRDGKDQPFMQMPQYQGRTKLVKDSIAEGRISLRLENITVLDAGLYGCRISSQSYYQKAIWELQVSALGSVPLISITGYVDRDIQLLCQSSGWFPRPTAKWKGPQGQDLSTDSRTNRDMHGLFDVEISLTVQENAGSISCSMRHAHLSREVESRVQIGDTFFEPISWHLATKVLGILCCGLFFGIVGLKIFFSKFQCKREREAWAGALFMVPAGTGSEMLPHPAASLLLVLASRGPGPKKLEKKARTGRIERRPETRSGGDSGSRDGSPEALRF

SEQ ID NO: 8705 - protein, 384 aa, Artificial Sequence
  Description of Artificial Sequence: Synthetic coding sequence
MALMLSLVLSLLKLGSALGSVPLISITGYVDRDIQLLCQSSGWFPRPTAKWKGPQGQDLSTDSRTNRDMHGLFDVEISLTVQENAGSISCSMRHAHLSREVESRVQIGDTFFEPISWHLATKVLGILCCGLFFGIVGLKIFFSKFQWKIQAELDWRRKHGQAELRDARKHAVEVTLDPETAHPKLCVSDLKTVTHRKAPQEVPHSEKRFTRKSVVASQSFQAGKHYWEVDGGHNKRWRVGVCRDDVDRRKEYVTLSPDHGYWVLRLNGEHLYFTLNPRFISVFPRTPPTKIGVFLDYECGTISFFNINDQSLIYTLTCRFEGLLRPYIEYPSYNEQNGTPIVICPVTQESEKEASWQRASAIPETSNSESSSQATTPFLPRGEM

SEQ ID NO: 8706 - protein, 535 aa, Artificial Sequence
  Description of Artificial Sequence: Synthetic coding sequence
MVDLSVSPDSLKPVSLTSSLVFLMHLLLLQPGEPSSEVKVLGPEYPILALVGEEVEFPCHLWPQLDAQQMEIRWFRSQTFNVVHLYQEQQELPGRQMPAFRNRTKLVKDDIAYGSVVLQLHSIIPSDKGTYGCRFHSDNFSGEALWELEVAGLGSDPHLSLEGFKEGGIQLRLRSSGWYPKPKVQWRDHQGQCLPPEFEAIVWDAQDLFSLETSVVVRAGALSNVSVSIQNLLLSQKKELVVQIADVFVPGASAWKSAFVATLPLLLVLAALALGVLRKQRRSREKLRKQAEKRQEKLTAELEKLQTELDWRRAEGQAEWRAAQKYAVDVTLDPASAHPSLEVSEDGKSVSSRGAPPGPAPGHPQRFSEQTCALSLERFSAGRHYWEVHVGRRSRWFLGACLAAVPRAGPARLSPAAGYWVLGLWNGCEYFVLAPHRVALTLRVPPRRLGVFLDYEAGELSFFNVSDGSHIFTFHDTFSGALCAYFRPRAHDGGEHPDPLTICPLPVRGTGVPEENDSDTWLQPYEPADPALDWW

SEQ ID NO: 8707 - protein, 344 aa, Artificial Sequence
  Description of Artificial Sequence: Synthetic coding sequence
MVDLSVSPDSLKPVSLTSSLVFLMHLLLLQPGEPSSEVKVLGPEYPILALVGEEVEFPCHLWPQLDAQQMEIRWFRSQTFNVVHLYQEQQELPGRQMPAFRNRTKLVKDDIAYGSVVLQLHSIIPSDKGTYGCRFHSDNFSGEALWELEVAGLGSDPHLSLEGFKEGGIQLRLRSSGWYPKPKVQWRDHQGQCLPPEFEAIVWDAQDLFSLETSVVVRAGALSNVSVSIQNLLLSQKKELVVQIADVFVPGASAWKSAFVATLPLLLVLAALALGVLRKQRRSREKLRKQAEKRQEKLTAELEKLQTELDWRRAEGQAECFVLASHPPGEGIQAASNSTTTLNA

SEQ ID NO: 8708 - protein, 536 aa, Artificial Sequence
  Description of Artificial Sequence: Synthetic coding sequence
MVDLSVSPDSLKPVSLTSSLVFLMHLLLLQPGEPSSEVKVLGPEYPILALVGEEVEFPCHLWPQLDAQQMEIRWFRSQTFNVVHLYQEQQELPGRQMPAFRNRTKLVKDDIAYGSVVLQLHSIIPSDKGTYGCRFHSDNFSGEALWELEVAGLGSDPHLSLEGFKEGGIQLRLRSSGWYPKPKVQWRDHQGQCLPPEFEAIVWDAQDLFSLETSVVVRAGALSNVSVSIQNLLLSQKKELVVQIADVFVPGASAWKSAFVATLPLLLVLAALALGVLRKQRRSREKLRKQAEKRQGTEKTAQLPPNQVASDWRRAEGQAEWRAAQKYAVDVTLDPASAHPSLEVSEDGKSVSSRGAPPGPAPGHPQRFSEQTCALSLERFSAGRHYWEVHVGRRSRWFLGACLAAVPRAGPARLSPAAGYWVLGLWNGCEYFVLAPHRVALTLRVPPRRLGVFLDYEAGELSFFNVSDGSHIFTFHDTFSGALCAYFRPRAHDGGEHPDPLTICPLPVRGTGVPEENDSDTWLQPYEPADPALDWW

SEQ ID NO: 8709 - protein, 344 aa, Artificial Sequence
  Description of Artificial Sequence: Synthetic coding sequence
MVDLSVSPDSLKPVSLTSSLVFLMHLLLLQPGEPSSEVKVLGPEYPILALVGEEVEFPCHLWPQLDAQQMEIRWFRSQTFNVVHLYQEQQELPGRQMPAFRNRTKLVKDDIAYGSVVLQLHSIIPSDKGTYGCRFHSDNFSGEALWELEVAGLGSDPHLSLEGFKEGGIQLRLRSSGWYPKPKVQWRDHQGQCLPPEFEAIVWDAQDLFSLETSVVVRAGALSNVSVSIQNLLLSQKKELVVQIADVFVPGASAWKSAFVATLPLLLVLAALALGVLRKQRRSREKLRKQAEKRQARYDAQAGPLLVASDWRRAEGQAECFVLASHPPGEGIQAASNSTTTLNA

SEQ ID NO: 8710 - protein, 1223 aa, Artificial Sequence
  Description of Artificial Sequence: Synthetic coding sequence
MRRLAAEELGVVTMQRIFNSFVYTEKISNGESEVQQLAKKIREKFNRYLDVVNRNKQVVEASYTAHLTSPLTAIQDCCTIPPSMMEFDGNFNTNVSRTISCDRLSTTVNSRAFNPGRDLNSVLADNLKSNPGIKWQYFSSEEGIFTVFPAHKFRCKGSYEHRSRPIYVSTVRPQSKHIVVILDHGASVTDTQLQIAKDAAQVILSAIDEHDKISVLTVADTVRTCSLDQCYKTFLSPATSETKRKMSTFVSSVKSSDSPTQHAVGFQKAFQLIRSTNNNTKFQANTDMVIIYLSAGITSKDSSEEDKKATLQVINEENSFLNNSVMILTYALMNDGVTGLKELAFLRDLAEQNSGKYGVPDRMALPVIKGSMMVLNQLSNLETTVGRFYTNLPNRMIDEAVFSLPFSDEMGDGLIMTVSKPCYFGNLLLGIVGVDVNLAYILEDVTYYQDSLASYTFLIDDKGYTLMHPSLTRPYLLSEPPLHTDIIHYENIPKFELVRQNILSLPLGSQIIAVPVNSSLSWHINKLRETGKEAYNVSYAWKMVQDTSFILCIVVIQPEIPVKQLKNLNTVPSSKLLYHRLDLLGQPSACLHFKQLATLESPTIMLSAGSFSSPYEHLSQPETKRMVEHYTAYLSDNTRLIANPGLKFSVRNEVMATSHVTDEWMTQMEMSSLNTYIVRRYIATPNGVLRIYPGSLMDKAFDPTRRQWYLHAVANPGLISLTGPYLDVGGAGYVVTISHTIHSSSTQLSSGHTVAVMGIDFTLRYFYKVLMDLLPVCNQDGGNKIRCFIMEDRGYLVAHPTLIDPKGHAPVEQQHITHKEPLVANDILNHPNFVKKNLCNSFSDRTVQRFYKFNTSLAGDLTNLVHGSHCSKYRLARIPGTNAFVGIVNETCDSLAFCACSMVDRLCLNCHRMEQNECECPCECPLEVNECTGNLTNAENRNPSCEVHQEPVTYTAIDPGLQDALHQCVNSRCSQRLESGDCFGVLDCEWCMVDSDGKTHLDKPYCAPQKECFGGIVGAKSPYVDDMGAIGDEVITLNMIKSAPVGPVAGGIMGCIMVLVLAVYAYRHQIHRRSHQHMSPLAAQEMSVRMSNLENDRDERDDDSHEDRGIISNTRFIAAVIERHAHSPERRRRYWGRSGTESDHGYSTMSPQEDSENPPCNNDPLSAGVDVGNHDEDLDLDTPPQTAALLSHKFHHYRSHHPTLHHSHHLQAAVTVHTVDAEC

SEQ ID NO: 8711 - protein, 1274 aa, Artificial Sequence
  Description of Artificial Sequence: Synthetic coding sequence
MARQPEEEETAVARARRPPLWLLCLVACWLLGAGAEADFSILDEAQVLASQMRRLAAEELGVVTMQRIFNSFVYTEKISNGESEVQQLAKKIREKFNRYLDVVNRNKQVVEASYTAHLTSPLTAIQDCCTIPPSMMEFDGNFNTNVSRTISCDRLSTTVNSRAFNPGRDLNSVLADNLKSNPGIKWQYFSSEEGIFTVFPAHKFRCKGSYEHRSRPIYVSTVRPQSKHIVVILDHGASVTDTQLQIAKDAAQVILSAIDEHDKISVLTVADTVRTCSLDQCYKTFLSPATSETKRKMSTFVSSVKSSDSPTQHAVGFQKAFQLIRSTNNNTKFQANTDMVIIYLSAGITSKDSSEEDKKATLQVINEENSFLNNSVMILTYALMNDGVTGLKELAFLRDLAEQNSGKYGVPDRMALPVIKGSMMVLNQLSNLETTVGRFYTNLPNRMIDEAVFSLPFSDEMGDGLIMTVSKPCYFGNLLLGIVGVDVNLAYILEDVTYYQDSLASYTFLIDDKGYTLMHPSLTRPYLLSEPPLHTDIIHYENIPKFELVRQNILSLPLGSQIIAVPVNSSLSWHINKLRETGKEAYNVSYAWKMVQDTSFILCIVVIQPEIPVKQLKNLNTVPSSKLLYHRLDLLGQPSACLHFKQLATLESPTIMLSAGSFSSPYEHLSQPETKRMVEHYTAYLSDNTRLIANPGLKFSVRNEVMATSHVTDEWMTQMEMSSLNTYIVRRYIATPNGVLRIYPGSLMDKAFDPTRRQWYLHAVANPGLISLTGPYLDVGGAGYVVTISHTIHSSSTQLSSGHTVAVMGIDFTLRYFYKVLMDLLPVCNQDGGNKIRCFIMEDRGYLVAHPTLIDPKGHAPVEQQHITHKEPLVANDILNHPNFVKKNLCNSFSDRTVQRFYKFNTSLAGDLTNLVHGSHCSKYRLARIPGTNAFVGIVNETCDSLAFCACSMVDRLCLNCHRMEQNECECPCECPLEVNECTGNLTNAENRNPSCEVHQEPVTYTAIDPGLQDALHQCVNSRCSQRLESGDCFGVLDCEWCMVDSDGKTHLDKPYCAPQKECFGGIVGAKSPYVDDMGAIGDEVITLNMIKSAPVGPVAGGIMGCIMVLVLAVYAYRHQIHRRSHQHMSPLAAQEMSVRMSNLENDRDERDDDSHEDRGIISNTRFIAAVIERHAHSPERRRRYWGRSGTESDHGYSTMSPQEDSENPPCNNDPLSAGVDVGNHDEDLDLDTPPQTAALLSHKFHHYRSHHPTLHHSHHLQAAVTVHTVDAEC

SEQ ID NO: 8712 - protein, 819 aa, Artificial Sequence
  Description of Artificial Sequence: Synthetic coding sequence
MWGLVRLLLAWLGGWGCMGRLAAPARAWAGSREHPGPALLRTRRSWVWNQFFVIEEYAGPEPVLIGKLHSDVDRGEGRTKYLLTGEGAGTVFVIDEATGNIHVTKSLDREEKAQYVLLAQAVDRASNRPLEPPSEFIIKVQDINDNPPIFPLGPYHATVPEMSNVGTSVIQVTAHDADDPSYGNSAKLVYTVLDGLPFFSVDPQTGVVRTAIPNMDRETQEEFLVVIQAKDMGGHMGGLSGSTTVTVTLSDVNDNPPKFPQSLYQFSVVETAGPGTLVGRLRAQDPDLGDNALMAYSILDGEGSEAFSISTDLQGRDGLLTVRKPLDFESQRSYSFRVEATNTLIDPAYLRRGPFKDVASVRVAVQDAPEPPAFTQAAYHLTVPENKAPGTLVGQISAADLDSPASPIRYSILPHSDPERCFSIQPEEGTIHTAAPLDREARAWHNLTVLATELGWSWGPERGWVPLLVAEWSAPAAPPQRSPVGSAVGIPQDSSAQASRVQVAIQTLDENDNAPQLAEPYDTFVCDSAAPGQLIQVIRALDRDEVGNSSHVSFQGPLGPDANFTVQDNRDGSASLLLPSRPAPPRHAPYLVPIELWDWGQPALSSTATVTVSVCRCQPDGSVASCWPEAHLSAAGLSTGALLAIITCVGALLALVVLFVALRRQKQEALMVLEEEDVRENIITYDDEGGGEEDTEAFDITALQNPDGAAPPAPGPPARRDVLPRARVSRQPRPPGPADVAQLLALRLREADEDPGVPPYDSVQVYGYEGRGSSCGSLSSLGSGSEAGGAPGPAEPLDDWGPLFRTLAELYGAKEPPAP

SEQ ID NO: 8713 - protein, 819 aa, Artificial Sequence; identical to SEQ ID NO: 8712
  Description of Artificial Sequence: Synthetic coding sequence

SEQ ID NO: 8714 - protein, 314 aa, Artificial Sequence
  Description of Artificial Sequence: Synthetic coding sequence
MWGLVRLLLAWLGGWGCMGRLAAPARAWAGSREHPGPALLRTRRSWVWNQFFVIEEYAGPEPVLIGKLHSDVDRGEGRTKYLLTGEGAGTVFVIDEATGNIHVTKSLDREEKAQYVLLAQAVDRASNRPLEPPSEFIIKIITCVGALLALVVLFVALRRQKQEALMVLEEEDVRENIITYDDEGGGEEDTEAFDITALQNPDGAAPPAPGPPARRDVLPRARVSRQPRPPGPADVAQLLALRLREADEDPGVPPYDSVQVYGYEGRGSSCGSLSSLGSGSEAGGAPGPAEPLDDWGPLFRTLAELYGAKEPPAP

SEQ ID NO: 8715 - protein, 781 aa, Artificial Sequence
  Description of Artificial Sequence: Synthetic coding sequence
MWGLVRLLLAWLGGWGCMGRLAAPARAWAGSREHPGPALLRTRRSWVWNQFFVIEEYAGPEPVLIGKLHSDVDRGEGRTKYLLTGEGAGTVFVIDEATGNIHVTKSLDREEKAQYVLLAQAVDRASNRPLEPPSEFIIKVQDINDNPPIFPLGPYHATVPEMSNVGTSVIQVTAHDADDPSYGNSAKLVYTVLDGLPFFSVDPQTGVVRTAIPNMDRETQEEFLVVIQAKDMGGHMGGLSGSTTVTVTLSDVNDNPPKFPQSLYQFSVVETAGPGTLVGRLRAQDPDLGDNALMAYSILDGEGSEAFSISTDLQGRDGLLTVRKPLDFESQRSYSFRVEATNTLIDPAYLRRGPFKDVASVRVAVQDAPEPPAFTQAAYHLTVPENKAPGTLVGQISAADLDSPASPIRYSILPHSDPERCFSIQPEEGTIHTAAPLDREARAWHNLTVLATELDSSAQASRVQVAIQTLDENDNAPQLAEPYDTFVCDSAAPGQLIQVIRALDRDEVGNSSHVSFQGPLGPDANFTVQDNRDGSASLLLPSRPAPPRHAPYLVPIELWDWGQPALSSTATVTVSVCRCQPDGSVASCWPEAHLSAAGLSTGALLAIITCVGALLALVVLFVALRRQKQEALMVLEEEDVRENIITYDDEGGGEEDTEAFDITALQNPDGAAPPAPGPPARRDVLPRARVSRQPRPPGPADVAQLLALRLREADEDPGVPPYDSVQVYGYEGRGSSCGSLSSLGSGSEAGGAPGPAEPLDDWGPLFRTLAELYGAKEPPAP

SEQ ID NO: 8716 - protein, 781 aa, Artificial Sequence; identical to SEQ ID NO: 8715
  Description of Artificial Sequence: Synthetic coding sequence

SEQ ID NO: 8717 - protein, 852 aa, Artificial Sequence
  Description of Artificial Sequence: Synthetic coding sequence
MAMRSGRHPSLLLLLVLLLWLLQVSIIDSVQQETDDLTKQTKEKIYQPLRRSKRRWVITTLELEEEDPGPFPKLIGELFNNMSYNMSLMYLISGPGVDEYPEIGLFSLEDHENGRIYVHRPVDREMTPSFTVYFDVVERSTGKIVDTSLIFNIRISDVNDHAPQFPEKEFNITVQENQSAGQPIFQMLAVDLDEENTPNSQVLYFLISQTPLLKESGFRVDRLSGEIRLSGCLDYETAPQFTLLIRARDCGEPSLSSTTTVHVDVQEGNNHRPAFTQENYKVQIPEGRASQGVLRLLVQDRDSPFTSAWRAKFNILHGNEEGHFDISTDPETNEGILNVIKPLDYETRPAQSLIIVVENEERLVFCERGKLQPPRKAAASATVSVQVTDANDPPAFHPQSFIVNKEEGARPGTLLGTFNAMDPDSQIRYELVHDPANWVSVDKNSGVVITVEPIDRESPHVNNSFYVIIIHAVDDGFPPQTATGTLMLFLSDINDNVPTLRPRSRYMEVCESAVHEPLHIEAEDPDLEPFSDPFTFELDNTWGNAEDTWKLGRNWGQSVELLTLRSLPRGNYLVPLFIGDKQGLSQKQTVHVRICPCASGLTCVELADAEVGLHVGALFPVCAAFVALAVALLFLLRCYFVLEPKRHGCSVSNDEGHQTLVMYNAESKGTSAQTWSDVEGQRPALLICTAAAGPTQGVKAYPDATMHRQLLAPVEGRMAETLNQSKERNRFSLSRGCIIPQGRATAGRGLPQDIYKEMMPRRLTQTGKRKHGALARTPSFKKVVYDHKEDEENKAGRKQRSHLFKVMQLRNEQGGVRVQSAHSPSPLNKKACFPGDYRGESAGGHNCRAVSG

SEQ ID NO: 8718 - protein, 124 aa, Artificial Sequence
  Description of Artificial Sequence: Synthetic coding sequence
MKPLIWTWSDVEGQRPALLICTAAAGPTQGVKAYPDATMHRQLLAPVEGRMAETLNQKLHVANVLEDDPGYLPHVYSEEGECGGAPSLSSLASLEQELQPDLLDSLGSKATPFEEIYSESGVPS

SEQ ID NO: 8719 - protein, 832 aa, Artificial Sequence
  Description of Artificial Sequence: Synthetic coding sequence
MAMRSGRHPSLLLLLVLLLWLLQVSIIDSVQQETDDLTKQTKEKIYQPLRRSKRRWVITTLELEEEDPGPFPKLIGELFNNMSYNMSLMYLISGPGVDEYPEIGLFSLEDHENGRIYVHRPVDREMTPSFTVYFDVVERSTGKIVDTSLIFNIRISDVNDHAPQFPEKEFNITVQENQSAGQPIFQMLAVDLDEENTPNSQVLYFLISQTPLLKESGFRVDRLSGEIRLSGCLDYETAPQFTLLIRARDCGEPSLSSTTTVHVDVQEGNNHRPAFTQENYKVQIPEGRASQGVLRLLVQDRDSPFTSAWRAKFNILHGNEEGHFDISTDPETNEGILNVIKPLDYETRPAQSLIIVVENEERLVFCERGKLQPPRKAAASATVSVQVTDANDPPAFHPQSFIVNKEEGARPGTLLGTFNAMDPDSQIRYELVHDPANWVSVDKNSGVVITVEPIDRESPHVNNSFYVIIIHAVDDGFPPQTATGTLMLFLSDINDNVPTLRPRSRYMEVCESAVHEPLHIEAEDPDLEPFSDPFTFELDNTWGNAEDTWKLGRNWGQSVELLTLRSLPRGNYLVPLFIGDKQGLSQKQTVHVRICPCASGLTCVELADAEVGLHVGALFPVCAAFVALAVALLFLLRCYFVLEPKRHGCSVSNDEGHQTLVMYNAESKGTSAQTWSDVEGQRPALLICTAAAGPTQGVKDLEEVPPSAASQSAQARCALGSWGYGKPFEPRSVKNIHSTPAYPDATMHRQLLAPVEGRMAETLNQKLHVANVLEDDPGYLPHVYSEEGECGGAPSLSSLASLEQELQPDLLDSLGSKATPFEEIYSESGVPS

SEQ ID NO: 8720 - protein, 165 aa, Artificial Sequence
  Description of Artificial Sequence: Synthetic coding sequence
MKPLIWTWSDVEGQRPALLICTAAAGPTQGVKDLEEVPPSAASQSAQARCALGSWGYGKPFEPRSVKNIHSTPAYPDATMHRQLLAPVEGRMAETLNQKLHVANVLEDDPGYLPHVYSEEGECGGAPSLSSLASLEQELQPDLLDSLGSKATPFEEIYSESGVPS

SEQ ID NO: 8721 - protein, 444 aa, Artificial Sequence
  Description of Artificial Sequence: Synthetic coding sequence
  MOD_RES (1)..(1): Any amino acid
XRPGTLLGTFNAMDPDSQIRYELVHDPANWVSVDKNSGVVITVEPIDRESPHVNNSFYVIIIHAVDDGFPPQTATGTLMLFLSDINDNVPTLRPRSRYMEVCESAVHEPLHIEAEDPDLEPFSDPFTFELDNTWGNAEDTWKLGRNWGQSVELLTLRSLPRGNYLVPLFIGDKQGLSQKQTVHVRICPCASGLTCVELADAEVGLHVGALFPVCAAFVALAVALLFLLRCYFVLEPKRHGCSVSNDEGHQTLVMYNAESKGTSAQTWSDVEGQRPALLICTAAAGPTQGVKAYPDATMHRQLLAPVEGRMAETLNQSKERNRFSLSRGCIIPQGRATAGRGLPQDIYKEMMPRRLTQTGKRKHGALARTPSFKKVVYDHKEDEENKAGRKQRSHLFKVMQLRNEQGGVRVQSAHSPSPLNKKACFPGDYRGESAGGHNCRAVSG

SEQ ID NO: 8722 - protein, 1310 aa, Artificial Sequence
  Description of Artificial Sequence: Synthetic coding sequence
MAQLWLSCFLLPALVVSVAANVAPKFLANMTSVILPEDLPVGAQAFWLVAEDQDNDPLTYGMSGPNAYFFAVTPKTGEVKLASALDYETLYTFKVTISVSDPYIQVQREMLVIVEDRNDNAPVFQNTAFSTSINETLPVGSVVFSVLAVDKDMGSAGMVVYSIEKVIPSTGDSEHLFRILANGSIVLNGSLSYNNKSAFYQLELKACDLGGMYHNTFTIQCSLPVFLSISVVDQPDLDPQFVREFYSASVAEDAAKGTSVLTVEAVDGDKGINDPVIYSISYSTRPGWFDIGADGVIRVNGSLDREQLLEADEEVQLQVTATETHLNIYGQEAKVSIWVTVRVMDVNDHKPEFYNCSLPACTFTPEEAQVNFTGYVDEHASPRIPIDDLTMVVYDPDKGSNGTFLLSLGGPDAEAFSVSPERAVGSASVQVLVRVSALVDYERQTAMAVQVVATDSVSQNFSVAMVTIHLRDINDHRPTFPQSLYVLTVPEHSATGSVVTDSIHATDPDTGAWGQITYSLLPGNGADLFQVDPVSGTVTVRNGELLDRESQAVYYLTLQATDGGNLSSSTTLQIHLLDINDNAPVVSGSYNIFVQEEEGNVSVTIQAHDNDEPGTNNSRLLFNLLPGPYSHNFSLDPDTGLLRNLGPLDREAIDPALEGRIVLTVLVSDCGEPVLGTKVNVTITVEDINDNLPIFNQSSYNFTVKEEDPGVLVGVVKAWDADQTEANNRISFSLSGSGANYFMIRGLVLGAGWAEGYLRLPPDVSLDYETQPVFNLTVSAENPDPQGGETIVDVCVNVKDVNDNPPTLDVASLRGIRVAENGSQHGQVAVVVASDVDTSAQLEIQLVNILCTKAGVDVGSLCWGWFSVAANGSVYINQSKAIDYEACDLVTLVVRACDLATDPGFQAYSNNGSLLITIEDVNDNAPYFLPENKTFVIIPELVLPNREVASVRARDDDSGNNGVILFSILRVDFISKDGATIPFQGVFSIFTSSEADVFAGSIQPVTSLDSTLQGTYQVTVQARDRPSLGPFLEATTTLNLFTVDQSYRSRLQFSTPKEEVGANRQAINAALTQATRTTVYIVDIQDIDSAARARPHSYLDAYFVFPNGSALTLDELSVMIRNDQDSLTQLLQLGLVVLGSQESQESDLSKQLISVIIGLGVALLLVLVIMTMAFVCVRKSYNRKLQAMKAAKEARKTAAGVMPSAPAIPGTNMYNTERANPMLNLPNKDLGLEYLSPSNDLDSVSVNSLDDNSVDVDKNSQEIKEHRPPHTPPEPDPEPLSVVLLGRQAGASGQLEGPSYTNAGLDTTDL

SEQ ID NO: 8723 - protein, 1310 aa, Artificial Sequence; identical to SEQ ID NO: 8722
  Description of Artificial Sequence: Synthetic coding sequence

SEQ ID NO: 8724 - protein, 1310 aa, Artificial Sequence; identical to SEQ ID NO: 8722
  Description of Artificial Sequence: Synthetic coding sequence

SEQ ID NO: 8725 - protein, 885 aa, Artificial Sequence
  Description of Artificial Sequence: Synthetic coding sequence
MQEAIILLALLGAMSGGEALHLILLPATGNVAENSPPGTSVHKFSVKLSASLSPVIPGFPQIVNSNPLTEAFRVNWLSGTYFEVVTTGMEQLDFETGPNIFDLQIYVKDEVGVTDLQVLTVQVTDVNEPPQFQGNLAEGLHLYIVERANPGFIYQVEAFDPEDTSRNIPLSYFLISPPKSFRMSANGTLFSTTELDFEAGHRSFHLIVEVRDSGGLKASTELQVNIVNLNDEVPRFTSPTRVYTVLEELSPGTIVANITAEDPDDEGFPSHLLYSITTVSKYFMINQLTGTIQVAQRIDRDAGELRQNPTISLEVLVKDRPYGGQENRIQITFIVEDVNDNPATCQKFTFSIMVPERTAKGTLLLDLNKFCFDDDSEAPNNRFNFTMPSGVGSGSRFLQDPAGSGKIVLIGDLDYENPSNLAAGNKYTVIIQVQDVAPPYYKNNVYVYILTSPENEFPLIFDRPSYVFDVSERRPARTRVGQVRATDKDLPQSSLLYSISTGGASLQYPNVFWINPKTGELQLVTKVDCETTPIYILRIQATNNEDTSSVTVTVNILEENDEKPICTPNSYFLALPVDLKVGTNIQNFKLTCTDLDSSPRSFRYSIGPGNVNNHFTFSPNAGSNVTRLLLTSRFDYAGGFDKIWDYKLLVYVTDDNLMSDRKKAEALVETGTVTLSIKVIPHPTTIITTTPRPRVTYQVLRKNVYSPSAWYVPFVITLGSILLLGLLVYLVVLLAKAIHRHCPCKTGKNKEPLTKKGETKTAERDVVVETIQMNTIFDGEAIDPVTGETYEFNSKTGARKWKDPLTQMPKWKESSHQGAAPRRVTAGEGMGSLRSANWEEDELSGKAWAEDAGLGSRNEGGKLGNPKNRNPAFMNRAYPKPHPGK

SEQ ID NO: 8726 - protein, 199 aa, Artificial Sequence
  Description of Artificial Sequence: Synthetic coding sequence
MVLLRLLVFLFAPVVSDLCSLPCFINVSESQGPGTVLQFLSFNCSSYTPTPTLELLNVQPPTTFFNPPSLARWQGTYVGKLTLSSSAQLDALMVNHYKVQLKFTCGNHVMEGSLSVDVQRDLSHIQCAGQFASPGEARGSRQGGGRHGLSRSSLTSTLASWGNDSGARDSHTWGSAVHSAPPRPRTPRSAGKPRTWDGG

SEQ ID NO: 8727 - protein, 788 aa, Artificial Sequence
  Description of Artificial Sequence: Synthetic coding sequence
MVLLRLLVFLFAPVVSDLCSLPCFINVSESQGPGTVLQFLSFNCSSYTPTPTLELLNVQPPTTFFNPPSLARWQGTYVGKLTLSSSAQLDALMVNHYKVQLKFTCGNHVMEGSLSVDVQRDLSHIQCAGQFASPAGEMIQVPETVTPGARLYTLLLPGLELHGAQMSIISAQDLPHFPGPFSINEQGWLQAPSQGLLGQAQKVFQLQISVSFGQRQSCQGMVIVKVLPVPSSQVSFLEQAQNITIPENLAPGSEVVQVQARGVDLRYEILSPVPSPLFSIGRADGVVRTTTPLELARTSGTAVSRLQVKAFEQGQLWASAKLNLTMNVQLVNLWPPRCLPALLVSQIPETAPVGTVLNTLTCEDPDSVGATLDYKLWFRSSSNPASLCLYDRVLEVNATLDCDTPGACFQHAASILVLDGGQPQMTTEVPVLVMVTPINEFSPACAPRTFRVQEDAAPHTLLGSVVGTDMDYPHDNIEYYTSGGPTTFAVDRLSGEVHLLGPLDYEQQRLYRLTVLVIDHGQDQNPNHHLSGSCTITIEVEDVNDHAPECEPPFQELTIYAPLGRSVEVTKMSCQIPQEPQRLIYSYSIVGGNSQNRFILQGAILVHSDLVLGPFWPEQPRTYELLICVADAGPSTPHLSTTATIIVHLVPRRASTVATSTHRTTVPSTMTPMLVTDTEAFWQPQPWFVVVLTATGALLLLALGWLLGRLLQGLAQLLQAPSKPAQALLLNSIQGTEGSIEGFLEAPKMEMSQAPSSVMSLHFDGRAQDSRTGRDYLFNTHTGARRWL

SEQ ID NO: 8728 - protein, 227 aa, Artificial Sequence
  Description of Artificial Sequence: Synthetic coding sequence
MGNCVKYPLRNLSRKMCQEEQTSYMVVQTSEEGLAADAELPGPLLMLAQNCAVMHNLLGPACIFLRKGFAENRQPDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 8729 - protein, 370 aa, Artificial Sequence
  Description of Artificial Sequence: Synthetic coding sequence
MGGGDGAAFKRPGDGARLQRVLGLGSRREPRSLPAGGPAPRRTAPPPPGHASAGPAAMSSHIAKSESKTSLLKAAAAAASGGSRAPRHGPARDPGLPSRRLPGSCPATPQSSGDPSSRRPLCRPAPREEGARGSQRVLPQAHCRPREALPAAASRPSPSSPLPPARGRDGEERGLSPALGLRGSLRARGRGDSVPAAASEADPFLHRLRPMLSSAFGQDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 8730 - protein, 167 aa, Artificial Sequence
  Description of Artificial Sequence: Synthetic coding sequence
MGNCVKYPLRNLSRKDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 8731 - protein, 215 aa, Artificial Sequence
  Description of Artificial Sequence: Synthetic coding sequence
MPFHPVTAALMYRGIYTVPNLLSEQRPVDIPEDELEEIREAFKVFDRDGNGFISKQELGTAMRSLGYMPNEVELEVIIQRLDMDGDGQVDFEEFVTLLGPKLSTSGIPEKFHGTDFDTVFWKCDMQKLTVDELKRLLYDTFCEHLSMKDIENIIMTEEESHLGTAEECPVDVETCSNQQIRQTCVRKSLICAFAIAFIISVMLIAANQVLRSGMK

SEQ ID NO: 8732 - protein, 1110 aa, Artificial Sequence
  Description of Artificial Sequence: Synthetic coding sequence
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVRLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASFNSNAQDVSCFQHLVQANVRNKKVLKDAVNNITAKGITDYKKGFSFAFEQLLNYNVSRANCNKIIMLFTDGGEERAQEIFNKYNKDKKVRVFTFSVGQHNYDRGPIQWMACENKGYYYEIPSIGAIRINTQEYLDVLGRPMVLAGDKAKQVQWTNVYLDALELGLVITGTLPVFNITGQFENKTNLKNQLILGVMGVDVSLEDIKRLTPRFTLCPNGYYFAIDPNGYVLLHPNLQPKPIGVGIPTINLRKRRPNIQNPKSQEPVTLDFLDAELENDIKVEIRNKMIDGESGEKTFRTLVKSQDERYIDKGNRTYTWTPVNGTDYSLALVLPTYSFYYIKAKLEETITQARCKYCERSDSETLKPDNFEESGYTFIAPRDYCNDLKISDNNTEFLLNFNEFIDRKTPNNPSCNADLINRVLLDAGFTNELVQNYWSKQKNIKGVKARFVVTDGGITRVYPKEAGENWQENPETYEDSFYKRSLDNDNYVFTAPYFNKSGPGAYESGIMVSKAVEIYIQGKLLKPAVVGIKIDVNSWIENFTKTSIRDPCAGPVCDCKRNSDVMDCVILDDGGFLLMANHDDYTNQIGRFFGEIDPSLMRHLVNISVYAFNKSYDYQSVCEPGAAPKQGAGHRSAYVPSVADILQIGWWATAAAWSILQQFLLSLTFPRLLEAVEMEDDDFTASLSKQSCITEQTQYFFDNDSKSFSGVLDCGNCSRIFHGEKLMNTNLIFIMVESKGTCPCDTRLLIQAEQTSDGPNPCDMVKQPRYRKGPDVCFDNNVLEDYTDCGGVSGLNPSLWYIIGIQFLLLWLVSGSTHRLL

SEQ ID NO: 8733 - protein, 1103 aa, Artificial Sequence
  Description of Artificial Sequence: Synthetic coding sequence
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVRLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASFNSNAQDVSCFQHLVQANVRNKKVLKDAVNNITAKGITDYKKGFSFAFEQLLNYNVSRANCNKIIMLFTDGGEERAQEIFNKYNKDKKVRVFTFSVGQHNYDRGPIQWMACENKGYYYEIPSIGAIRINTQEYLDVLGRPMVLAGDKAKQVQWTNVYLDALELGLVITGTLPVFNITGQFENKTNLKNQLILGVMGVDVSLEDIKRLTPRFTLCPNGYYFAIDPNGYVLLHPNLQPKPIGVGIPTINLRKRRPNIQNPKSQEPVTLDFLDAELENDIKVEIRNKMIDGESGEKTFRTLVKSQDERYIDKGNRTYTWTPVNGTDYSLALVLPTYSFYYIKAKLEETITQARYSETLKPDNFEESGYTFIAPRDYCNDLKISDNNTEFLLNFNEFIDRKTPNNPSCNADLINRVLLDAGFTNELVQNYWSKQKNIKGVKARFVVTDGGITRVYPKEAGENWQENPETYEDSFYKRSLDNDNYVFTAPYFNKSGPGAYESGIMVSKAVEIYIQGKLLKPAVVGIKIDVNSWIENFTKTSIRDPCAGPVCDCKRNSDVMDCVILDDGGFLLMANHDDYTNQIGRFFGEIDPSLMRHLVNISVYAFNKSYDYQSVCEPGAAPKQGAGHRSAYVPSVADILQIGWWATAAAWSILQQFLLSLTFPRLLEAVEMEDDDFTASLSKQSCITEQTQYFFDNDSKSFSGVLDCGNCSRIFHGEKLMNTNLIFIMVESKGTCPCDTRLLIQAEQTSDGPNPCDMVKQPRYRKGPDVCFDNNVLEDYTDCGGVSGLNPSLWYIIGIQFLLLWLVSGSTHRLL

SEQ ID NO: 8734 - protein, 1091 aa, Artificial Sequence
  Description of Artificial Sequence: Synthetic coding sequence
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVRLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASFNSNAQDVSCFQHLVQANVRNKKVLKDAVNNITAKGITDYKKGFSFAFEQLLNYNVSRANCNKIIMLFTDGGEERAQEIFNKYNKDKKVRVFTFSVGQHNYDRGPIQWMACENKGYYYEIPSIGAIRINTQEYLDVLGRPMVLAGDKAKQVQWTNVYLDALELGLVITGTLPVFNITGQFENKTNLKNQLILGVMGVDVSLEDIKRLTPRFTLCPNGYYFAIDPNGYVLLHPNLQPKNPKSQEPVTLDFLDAELENDIKVEIRNKMIDGESGEKTFRTLVKSQDERYIDKGNRTYTWTPVNGTDYSLALVLPTYSFYYIKAKLEETITQARSKKGKMKDSETLKPDNFEESGYTFIAPRDYCNDLKISDNNTEFLLNFNEFIDRKTPNNPSCNADLINRVLLDAGFTNELVQNYWSKQKNIKGVKARFVVTDGGITRVYPKEAGENWQENPETYEDSFYKRSLDNDNYVFTAPYFNKSGPGAYESGIMVSKAVEIYIQGKLLKPAVVGIKIDVNSWIENFTKTSIRDPCAGPVCDCKRNSDVMDCVILDDGGFLLMANHDDYTNQIGRFFGEIDPSLMRHLVNISVYAFNKSYDYQSVCEPGAAPKQGAGHRSAYVPSVADILQIGWWATAAAWSILQQFLLSLTFPRLLEAVEMEDDDFTASLSKQSCITEQTQYFFDNDSKSFSGVLDCGNCSRIFHGEKLMNTNLIFIMVESKGTCPCDTRLLIQAEQTSDGPNPCDMVKQPRYRKGPDVCFDNNVLEDYTDCGGVSGLNPSLWYIIGIQFLLLWLVSGSTHRLL

SEQ ID NO: 8735 - protein, 303 aa, Artificial Sequence
  Description of Artificial Sequence: Synthetic coding sequence
MVGLPEFIPKIVGIKIDVNSWIENFTKTSIRDPCAGPVCDCKRNSDVMDCVILDDGGFLLMANHDDYTNQIGRFFGEIDPSLMRHLVNISVYAFNKSYDYQSVCEPGAAPKQGAGHRSAYVPSVADILQIGWWATAAAWSILQQFLLSLTFPRLLEAVEMEDDDFTASLSKQSCITEQTQYFFDNDSKSFSGVLDCGNCSRIFHGEKLMNTNLIFIMVESKGTCPCDTRLLIQAEQTSDGPNPCDMVKQPRYRKGPDVCFDNNVLEDYTDCGGVSGLNPSLWYIIGIQFLLLWLVSGSTHRLL

SEQ ID NO: 8736 - protein, 327 aa, Artificial Sequence
  Description of Artificial Sequence: Synthetic coding sequence
MVRCDRGLQMLLTTAGAFAAFSLMAIAIGTDYWLYSSAHICNGTNLTMDDGPPPRRARGDLTHSGLWRVCCIEGIYKGHCFRINHFPEDNDYDHDSSEYLLRIVRASSVFPILSTILLLLGGLCIGAGRIYSRKNNIVLSAGILFVAAGLSNIIGIIVYISSNTGDPSDKRDEDKKNHYNYGWSFYFGALSFIVAETVGVLAVNIYIEKNKELRFKTKREFLKASSSSPYARMPSYRYRRRRSRSSSRSTEASPSRDVSPMGLKITGAIPMGELSMYTLSREPLKVTTAASYSPDQEASFLQVHDFFQQDLKEGFHVSMLNRRTTPV

SEQ ID NO: 8737 - protein, 2039 aa, Artificial Sequence
  Description of Artificial Sequence: Synthetic coding sequence
ERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWMQDAMGYELPWVYFVSLVIFGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRMHCCDMLDGGTFPPALGPRRAPPCLHQQLQGSLAGLREDTPCIVPGHASLCCSSRVGEWLPAGCTAPQHARCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 8738 - protein, 2173 aa, Artificial Sequence
  Description of Artificial Sequence: Synthetic coding sequence
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRERHVPMCEDLELRRDSGSAGTQAHCLLLRKANPSRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 8739 - protein, 2163 aa, Artificial Sequence
  Description of Artificial Sequence: Synthetic coding sequence
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNRGTPAGMLDQKKGKFAWFSHSTETHVSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 8740 - protein, 2250 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8741 - protein, 2343 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8742 - protein, 2171 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8743 - protein, 2377 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8744 - protein, 2261 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8745 - protein, 1555 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQVSPRLRGGAVVKEAGGGTGPCLVIPADSGGGGLHEEISPSHPLLSNHQHVAKPSPSHSAPKSGPMGSLAVLKDEETEAQRG

SEQ ID NO: 8746 - protein, 2266 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8747 - protein, 2243 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8748 - protein, 2306 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8749 - protein, 1753 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQLWAWSSLETWSVTRHTPVRAWAVMPPFGTLAWPS

SEQ ID NO: 8750 - protein, 2250 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQNFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8751 - protein, 1735 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQLWAWSSLETWSVTRHTPVRAWAVMPPFGTLAWPS

SEQ ID NO: 8752 - protein, 1765 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQLWAWSSLETWSVTRHTPVRAWAVMPPFGTLAWPS

SEQ ID NO: 8753 - protein, 2205 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8754 - protein, 1776 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQLWAWSSLETWSVTRHTPVRAWAVMPPFGTLAWPS

SEQ ID NO: 8755 - protein, 2366 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8756 - protein, 2332 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8757 - protein, 2277 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8758 - protein, 2194 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8759 - protein, 2298 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8760 - protein, 2232 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQNFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8761 - protein, 1758 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQLWAWSSLETWSVTRHTPVRAWAVMPPFGTLAWPS

SEQ ID NO: 8762 - protein, 1746 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTLWAWSSLETWSVTRHTPVRAWAVMPPFGTLAWPS

SEQ ID NO: 8763 - protein, 2273 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8764 - protein, 2287 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQNFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8765 - protein, 2239 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQNFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8766 - protein, 2291 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMADLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8767 - protein, 2259 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8768 - protein, 2227 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQNFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8769 - protein, 2284 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8770 - protein, 2314 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRKAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8771 - protein, 2321 aa, Artificial Sequence
  Description of Artificial Sequence: Synthetic coding sequence
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRSKEKQMAEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 8772 - protein, 344 aa, Artificial Sequence
  Description of Artificial Sequence: Synthetic coding sequence
MDKFRMLFQHFQSSSESVMNGICLLLAAVTVKLYSSFDFNCPCLVHYNALYGLGLLLTPPLALFLCGLLANRQSVVMVEEWRRPAGHRRKDPGIIRYMCSSVLQRALAAPLVWILLALLDGKCFVCAFSSSVDPEKFLDFANMTPSQVQLFLAKVPCKEDELVRDSPARKAVSRYLRCLSQAIGWSVTLLLIIAAFLARCLRPCFDQTVFLQRRYWSNYVDLEQKLFDETCCEHARDFAHRCVLHFFASMRSELQARGLRRGNAGRRLELPAVPEPPEGLDSGSGKAHLRAISSREQVDRLLSTWYSSKPPLDLAASPGLCGGGLSHRAPTLALGTRLSQHTDV

SEQ ID NO: 8773 - protein, 476 aa, Artificial Sequence [sequence omitted]

SEQ ID NO: 8774 - protein, 476 aa, Artificial Sequence [sequence omitted]

SEQ ID NO: 8775 - protein, 217 aa, Artificial Sequence
  Description of Artificial Sequence: Synthetic coding sequence
MVKLGCSFSGKPGKDPGDQDGAAMDSVPLISPLDISQLQPPLPDQVVIKTQTEYQLSSPDQQNFPDLEGQRLNCSHPEEGRRLPTARMIAFAMALLGCVLIMYKAIWYDQFTCPDGFLLRHKICTPLTLEMYYTEMDPERHRSILAAIGAYPLSRKHGTETPAAWGDGYRAAKEERKGPTQAGAAAAATEPPGKPSAKAEKEAARKAAGSAAPPPAQ

SEQ ID NO: 8776 - protein, 158 aa, Artificial Sequence
  Description of Artificial Sequence: Synthetic coding sequence
MVKLGCSFSGKPGKDPGDQDGAAMDSVPLISPLDISQLQPPLPDQVVIKTQTEYQLSSPDQQNFPDLEGQRLNCSHPEEGRRVTTPTPPTVGTQDRRRRWKAAGGAWVPSRPVWGPLALREERVAVSHPAQSWPHRLPCTHQAPSRGCRCRLTKQWRS

SEQ ID NO: 8777 - protein, 124 aa, Artificial Sequence
  Description of Artificial Sequence: Synthetic coding sequence
MVKLGCSFSGKPGKDPGDQDGAAMDSVPLISPLDISQLQPPLPDQVVIKTQTEYQLSSPDQQNFPDLEGQRLNCSHPEEGRRLPTARMIAFAMALLGCVLIMYKAIWYDQFTCPDGFLLRGPEF

SEQ ID NO: 8778 - protein, 124 aa, Artificial Sequence; identical to SEQ ID NO: 8777
  Description of Artificial Sequence: Synthetic coding sequence

SEQ ID NO: 8779 - protein, 610 aa, Artificial Sequence
  Description of Artificial Sequence: Synthetic coding sequence
MHFQAFWLCLGLLFISINAEFMDDDVETEDFEENSEEIDVNESELSSEIKYKTPQPIGEVYFAETFDSGRLAGWVLSKAKKDDMDEEISIYDGRWEIEELKENQVPGDRGLVLKSRAKHHAISAVLAKPFIFADKPLIVQYEVNFQDGIDCGGAYIKLLADTDDLILENFYDKTSYIIMFGPDKCGEDYKLHFIFRHKHPKTGVFEEKHAKPPDVDLKKFFTDRKTHLYTLVMNPDDTFEVLVDQTVVNKGSLLEDVVPPIKPPKEIEDPNDKKPEEWDERAKIPDPSAVKPEDWDESEPAQIEDSSVVKPAGWLDDEPKFIPDPNAEKPDDWNEDTDGEWEAPQILNPACRIGCGEWKPPMIDNPKYKGVWRPPLVDNPNYQGIWSPRKIPNPDYFEDDHPFLLTSFSALGLELWSMTSDIYFDNFIICSEKEVADHWAADGWRWKIMIANANKPGVLKQLMAAAEGHPWLWLIYLVTAGVPIALITSFCWPRKVKKKHKDTEYKKTDICIPQTKGVLEQEEKEEKAALEKPMDLEEEKKQNDGEMLEKEEESEPEEKSEEEIEIIEGQEESNQSNKSGSEDEMKEADESTGSGDGPIKSVRKRRVRKD

SEQ ID NO: 8780 - protein, 610 aa, Artificial Sequence; identical to SEQ ID NO: 8779
  Description of Artificial Sequence: Synthetic coding sequence

SEQ ID NO: 8781 - protein, 179 aa, Artificial Sequence
  Description of Artificial Sequence: Synthetic coding sequence
MHFQAFWLCLGLLFISINAEFMDDDVETEDFEENSEEIDVNESELSSEIKYKTPQPIGEVYFAETFDSGRLAGWVLSKAKKDDMDEEISIYDGRWEIEELKENQVPGDRGLVLKSRAKHHAISAVLAKPFIFADKPLIVQYEVNFQDGIDCGGAYIKLLADTDDLILENFYDKTSYIIM

SEQ ID NO: 8782 - protein, 610 aa, Artificial Sequence; identical to SEQ ID NO: 8779
  Description of Artificial Sequence: Synthetic coding sequence

SEQ ID NO: 8783 - protein, 527 aa, Artificial Sequence
  Description of Artificial Sequence: Synthetic coding sequence
MDEEISIYDGRWEIEELKENQVPGDRGLVLKSRAKHHAISAVLAKPFIFADKPLIVQYEVNFQDGIDCGGAYIKLLADTDDLILENFYDKTSYIIMFGPDKCGEDYKLHFIFRHKHPKTGVFEEKHAKPPDVDLKKFFTDRKTHLYTLVMNPDDTFEVLVDQTVVNKGSLLEDVVPPIKPPKEIEDPNDKKPEEWDERAKIPDPSAVKPEDWDESEPAQIEDSSVVKPAGWLDDEPKFIPDPNAEKPDDWNEDTDGEWEAPQILNPACRIGCGEWKPPMIDNPKYKGVWRPPLVDNPNYQGIWSPRKIPNPDYFEDDHPFLLTSFSALGLELWSMTSDIYFDNFIICSEKEVADHWAADGWRWKIMIANANKPGVLKQLMAAAEGHPWLWLIYLVTAGVPIALITSFCWPRKVKKKHKDTEYKKTDICIPQTKGVLEQEEKEEKAALEKPMDLEEEKKQNDGEMLEKEEESEPEEKSEEEIEIIEGQEESNQSNKSGSEDEMKEADESTGSGDGPIKSVRKRRVRKD

SEQ ID NO: 8784 - protein, 1249 aa, Artificial Sequence
  Description of Artificial Sequence: Synthetic coding sequence
MVEAAPPGPGPLRRTFLVPEIKSLDQYDFSRAKAAASLAWVLRAAFGGAEHVPPELWEPFYTDQYAQEHVKPPVTRLLLSAELYCRAWRQALPQLETPPNPSALLALLARRGTVPALPERPVREADLRHQPILMGAHLAVIDALMAAFAFEWTKTLPGPLALTSLEHKLLFWVDTTVRRLQEKTEQEAAQRASPAAPADGAAPAQPSIRYRKDRVVARRAPCFPTVTSLQDLASGAALAATIHCYCPQLLRLEEVCLKDPMSVADSLYNLQLVQDFCASRLPRGCPLSLEDLLYVPPPLKVNLVVMLAELFMCFEVLKPDFVQVKDLPDGHAASPRGTEASPPQNNSGSSSPVFTFRHPLLSSGGPQSPLRGSTGSLKSSPSMSHMEALGKAWNRQLSRPLSQAVSFSTPFGLDSDVDVVMGDPVLLRSVSSDSLGPPRPAPARTPTQPPPEPGDLPTIEEALQIIHSAEPRLLPDGAADGSFYLHSPEGPSKPSLASPYLPEGTSKPLSDRPTKAPVYMPHPETPSKPSPCLVGEASKPPAPSEGSPKAVASSPAATNSEVKMTSFAERKKQLVKAEAEAGAGSPTSTPAPPEALSSEMSELSARLEEKRRAIEAQKRRIEAIFAKHRQRLGKSAFLQVQPREASGEAEAEAEEADSGPVPGGERPAGEGQGEPTSRPKAVTFSPDLGPVPHEGLGEYNRAVSKLSAALSSLQRDMQRLTDQQQRLLAPPEAPGSAPPPAAWVIPGPTTGPKAASPSPARRVPATRRSPGPGPSQSPRSPKHTRPAELRLAPLTRVLTPPHDVDSLPHLRKFSPSQVPVQTRSSILLAEETPPEEPAARPGLIEIPLGSLADPAAEDEGDGSPAGAEDSLEEEASSEGEPRVGLGFFYKDEDKPEDEMAQKRASLLERQQRRAEEARRRKQWQEVEKEQRREEAARLAQEEAPGPAPLVSAVPMATPAPAARAPAEEEVGPRKGDFTRQEYERRAQLKLMDDLDKVLRPRAAGSGGPGRGGRRATRPRSGCCDDSALARSPARGLLGSRLSKIYSQSTLSLSTVANEAHNNLGVKRPTSRAPSPSGLMSPSRLPGSRERDWENGSNASSPASVPEYTGPRLYKEPSAKSNKFIIHNALSHCCLAGKVNEPQKNRILEEIEKSKANHFLILFRDSSCQFRALYTLSGETEELSRLAGYGPRTVTPAMVEGIYKYNSDRKRFTQIPAKTMSMSVDAFTIQGHLWQGKKPTTPKKGGGTPK

SEQ ID NO: 8785 - protein, 1276 aa, Artificial Sequence
  Description of Artificial Sequence: Synthetic coding sequence
MVEAAPPGPGPLRRTFLVPEIKSLDQYDFSRAKAAASLAWVLRAAFGGAEHVPPELWEPFYTDQYAQEHVKPPVTRLLLSAELYCRAWRQALPQLETPPNPSALLALLARRGTVPALPERPVREADLRHQPILMGAHLAVIDALMAAFAFEWTKTLPGPLALTSLEHKLLFWVDTTVRRLQEKTEQEAAQRASPAAPADGAAPAQPSCPTRWYWKLVPHAIAFCLKESGSKPPMIRYRKDRVVARRAPCFPTVTSLQDLASGAALAATIHCYCPQLLRLEEVCLKDPMSVADSLYNLQLVQDFCASRLPRGCPLSLEDLLYVPPPLKVNLVVMLAELFMCFEVLKPDFVQVKDLPDGHAASPRGTEASPPQNNSGSSSPVFTFRHPLLSSGGPQSPLRGSTGSLKSSPSMSHMEALGKAWNRQLSRPLSQAVSFSTPFGLDSDVDVVMGDPVLLRSVSSDSLGPPRPAPARTPTQPPPEPGDLPTIEEALQIIHSAEPRLLPDGAADGSFYLHSPEGPSKPSLASPYLPEGTSKPLSDRPTKAPVYMPHPETPSKPSPCLVGEASKPPAPSEGSPKAVASSPAATNSEVKMTSFAERKKQLVKAEAEAGAGSPTSTPAPPEALSSEMSELSARLEEKRRAIEAQKRRIEAIFAKHRQRLGKSAFLQVQPREASGEAEAEAEEADSGPVPGGERPAGEGQGEPTSRPKAVTFSPDLGPVPHEGLGEYNRAVSKLSAALSSLQRDMQRLTDQQQRLLAPPEAPGSAPPPAAWVIPGPTTGPKAASPSPARRVPATRRSPGPGPSQSPRSPKHTRPAELRLAPLTRVLTPPHDVDSLPHLRKFSPSQVPVQTRSSILLAEETPPEEPAARPGLIEIPLGSLADPAAEDEGDGSPAGAEDSLEEEASSEGEPRVGLGFFYKDEDKPEDEMAQKRASLLERQQRRAEEARRRKQWQEVEKEQRREEAARLAQEEAPGPAPLVSAVPMATPAPAARAPAEEEVGPRKGDFTRQEYERRAQLKLMDDLDKVLRPRAAGSGGPGRGGRRATRPRSGCCDDSALARSPARGLLGSRLSKIYSQSTLSLSTVANEAHNNLGVKRPTSRAPSPSGLMSPSRLPGSRERDWENGSNASSPASVPEYTGPRLYKEPSAKSNKFIIHNALSHCCLAGKVNEPQKNRILEEIEKSKANHFLILFRDSSCQFRALYTLSGETEELSRLAGYGPRTVTPAMVEGIYKYNSDRKRFTQIPAKTMSMSVDAFTIQGHLWQGKKPTTPKKGGGTPK

SEQ ID NO: 8786 - protein, 219 aa, Artificial Sequence
  Description of Artificial Sequence: Synthetic coding sequence
MPFHHVTAGLLYKGNYLNRSLSAGSDSEQLANISVEELDEIREAFRVLDRDGNGFISKQELGMAMRSLGYMPSEVELAIIMQRLDMDGDGQVDFDEFMTILGPKLVSSEGRDGFLGNTIDSIFWQFDMQRITLEELKHILYHAFRDHLTMKDIENIIINEEESLNETSGNCQTEFEGVHSQKQNRQTCVRKSLICAFAMAFIISVMLIAANQILRSGME

SEQ ID NO: 8787 - protein, 261 aa, Artificial Sequence
  Description of Artificial Sequence: Synthetic coding sequence
MRLPEQPGEGKPENEKKGDGGALGGGEEPPRSQAPDFPTWEKMPFHHVTAGLLYKGNYLNRSLSAGSDSEQLANISVEELDEIREAFRVLDRDGNGFISKQELGMAMRSLGYMPSEVELAIIMQRLDMDGDGQVDFDEFMTILGPKLVSSEGRDGFLGNTIDSIFWQFDMQRITLEELKHILYHAFRDHLTMKDIENIIINEEESLNETSGNCQTEFEGVHSQKQNRQTCVRKSLICAFAMAFIISVMLIAANQILRSGME

SEQ ID NO: 8788 - protein, 219 aa, Artificial Sequence; identical to SEQ ID NO: 8786
  Description of Artificial Sequence: Synthetic coding sequence

SEQ ID NO: 8789 - protein, 219 aa, Artificial Sequence; identical to SEQ ID NO: 8786
  Description of Artificial Sequence: Synthetic coding sequence

SEQ ID NO: 8790 - protein, 261 aa, Artificial Sequence; identical to SEQ ID NO: 8787
  Description of Artificial Sequence: Synthetic coding sequence

SEQ ID NO: 8791 - protein, 219 aa, Artificial Sequence; identical to SEQ ID NO: 8786
  Description of Artificial Sequence: Synthetic coding sequence

SEQ ID NO: 8792 - protein, 125 aa, Artificial Sequence
  Description of Artificial Sequence: Synthetic coding sequence
MPFHHVTAGLLYKGNYLNRSLSAGSDSEQLANISVEELDEIREAFRVLDRDGNGFISKQELGMAMRSLGYMPSEVELAIIMQRLDMDGDGQVDFDEFMTILGPKLVSSEGRDGFLGNTIDSIFWQ

SEQ ID NO: 8793 - protein, 248 aa, Artificial Sequence
  Description of Artificial Sequence: Synthetic coding sequence
MFLAKALLEGADRGLGEALGGLFGGGGQRREGGGRNIGGIVGGIVNFISEAAAAQYTPEPPPTQQHFTSVEASESEEVRRFRQQFTQLAGPDMEVGATDLMNILNKVLSKHKDLKTDGFSLDTCRSIVSVMDSDTTGKLGFEEFKYLWNNIKKWQCVYKQYDRDHSGSLGSSQLRGALQAAGFQLNEQLYQMIVRRYANEDGDMDFNNFISCLVRLDAMFRAFKSLDRDRDGLIQVSIKEWLQLTMYS

SEQ ID NO: 8794 - protein, 955 aa, Artificial Sequence
  Description of Artificial Sequence: Synthetic coding sequence
MLPGRLCWVPLLLALGVGSGSGGGGDSRQRRLLAAKVNKHKPWIETSYHGVITENNDTVILDPPLVALDKDAPVPFAGEICAFKIHGQELPFEAVVLNKTSGEGRLRAKSPIDCELQKEYTFIIQAYDCGAGPHETAWKKSHKAVVHIQVKDVNEFAPTFKEPAYKAVVTEGKIYDSILQVEAIDEDCSPQYSQICNYEIVTTDVPFAIDRNGNIRNTEKLSYDKQHQYEILVTAYDCGQKPAAQDTLVQVDVKPVCKPGWQDWTKRIEYQPGSGSMPLFPSIHLETCDGAVSSLQIVTELQTNYIGKGCDRETYSEKSLQKLCGASSGIIDLLPSPSAATNWTAGLLVDSSEMIFKFDGRQGAKVPDGIVPKNLTDQFTITMWMKHGPSPGVRAEKETILCNSDKTEMNRHHYALYVHNCRLVFLLRKDFDQADTFRPAEFHWKLDQICDKEWHYYVINVEFPVVTLYMDGATYEPYLVTNDWPIHPSHIAMQLTVGACWQGGEVTKPQFAQFFHGSLASLTIRPGKMESQKVISCLQACKEGLDINSLESLGQGIKYHFNPSQSILVMEGDDIGNINRALQKVSYINSRQFPTAGVRRLKVSSKVQCFGEDVCISIPEVDAYVMVLQAIEPRITLRGTDHFWRPAAQFESARGVTLFPDIKIVSTFAKTEAPGDVKTTDPKSEVLEEMLHNLDFCDILVIGGDLDPRQECLELNHSELHQRHLDATNSTAGYSIYGVGSMSRYEQVLHHIRYRNWRPASLEARRFRIKCSELNGRYTSNEFNLEVSILHEDQVSDKEHVNHLIVQPPFLQSVHHPESRSSIQHSSVVPSIATVVIIISVCMLVFVVAMGVYRVRIAHQHFIQETEAAKESEMDWDDSALTITVNPMEKHEGPGHGEDETEGEEEEEAEEEMSSSSGSDDSEEEEEEEGMGRGRHGQNGARQAQLEWDDSTLPY

SEQ ID NO: 8795 - protein, 956 aa, Artificial Sequence
  Description of Artificial Sequence: Synthetic coding sequence
MTLLLLPLLLASLLASCSCNKANKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTPFLIDNDGNIENTEKLQYSGERLYKFTVTAYDCGKKRAADDAEVEIQVKPTCKPSWQGWNKRIEYAPGAGSLALFPGIRLETCDEPLWNIQATIELQTSHVAKGCDRDNYSERALRKLCGAATGEVDLLPMPGPNANWTAGLSVHYSQDSSLIYWFNGTQAVQVPLGGPSGLGSGPQDSLSDHFTLSFWMKHGVTPNKGKKEEETIVCNTVQNEDGFSHYSLTVHGCRIAFLYWPLLESARPVKFLWKLEQVCDDEWHHYALNLEFPTVTLYTDGISFDPALIHDNGLIHPPRREPALMIGACWTEEKNKEKEKGDNSTDTTQGDPLSIHHYFHGYLAGFSVRSGRLESREVIECLYACREGLDYRDFESLGKGMKVHVNPSQSLLTLEGDDVETFNHALQHVAYMNTLRFATPGVRPLRLTTAVKCFSEESCVSIPEVEGYVVVLQPDAPQILLSGTAHFARPAVDFEGTNGVPLFPDLQITCSISHQVEAKKDESWQGTVTDTRMSDEIVHNLDGCEISLVGDDLDPERESLLLDTTSLQQRGLELTNTSAYLTIAGVESITVYEEILRQARYRLRHGAALYTRKFRLSCSEMNGRYSSNEFIVEVNVLHSMNRVAHPSHVLSSQQFLHRGHQPPPEMAGHSLASSHRNSMIPSAATLIIVVCVGFLVLMVVLGLVRIHSLHRRVSGAGGPPGASSDPKDPDLFWDDSALTIIVNPMESYQNRQSCVTGAVGGQQEDEDSSDSEVADSPSSDERRIIETPPHRY

SEQ ID NO: 8796 - protein, 968 aa, Artificial Sequence
  Description of Artificial Sequence: Synthetic coding sequence
MVLGCELSGSTRVVVGVEALLTGASSPLPGVGPANKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTPFLIDNDGNIENTEKLQYSGERLYKFTVTAYDCGKKRAADDAEVEIQVKPTCKPSWQGWNKRIEYAPGAGSLALFPGIRLETCDEPLWNIQATIELQTSHVAKGCDRDNYSERALRKLCGAATGEVDLLPMPGPNANWTAGLSVHYSQDSSLIYWFNGTQAVQVPLGGPSGLGSGPQDSLSDHFTLSFWMKHGVTPNKGKKEEETIVCNTVQNEDGFSHYSLTVHGCRIAFLYWPLLESARPVKFLWKLEQVCDDEWHHYALNLEFPTVTLYTDGISFDPALIHDNGLIHPPRREPALMIGACWTEEKNKEKEKGDNSTDTTQGDPLSIHHYFHGYLAGFSVRSGRLESREVIECLYACREGLDYRDFESLGKGMKVHVNPSQSLLTLEGDDVETFNHALQHVAYMNTLRFATPGVRPLRLTTAVKCFSEESCVSIPEVEGYVVVLQPDAPQILLSGTAHFARPAVDFEGTNGVPLFPDLQITCSISHQVEAKKDESWQGTVTDTRMSDEIVHNLDGCEISLVGDDLDPERESLLLDTTSLQQRGLELTNTSAYLTIAGVESITVYEEILRQARYRLRHGAALYTRKFRLSCSEMNGRYSSNEFIVEVNVLHSMNRVAHPSHVLSSQQFLHRGHQPPPEMAGHSLASSHRNSMIPSAATLIIVVCVGFLVLMVVLGLVRIHSLHRRVSGAGGPPGASSDPKDPDLFWDDSALTIIVNPMESYQNRQSCVTGAVGGQQEDEDSSDSEVADSPSSDERRIIETPPHRY

SEQ ID NO: 8797 - protein, 134 aa, Artificial Sequence
  Description of Artificial Sequence: Synthetic coding sequence
MTLLLLPLLLASLLASCSCNKANKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVR

SEQ ID NO: 8798 - protein, 473 aa, Artificial Sequence
  Description of Artificial Sequence: Synthetic coding sequence
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAAGGATAAAASGATSAPEGDAARAAKSDNVAPADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 8799 - protein, 501 aa, Artificial Sequence
  Description of Artificial Sequence: Synthetic coding sequence
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAAGGATAAAASGATSAPEGDAARAAKSDNVAPADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 8800 - protein, 470 aa, Artificial Sequence
  Description of Artificial Sequence: Synthetic coding sequence
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 8801 - protein, 519 aa, Artificial Sequence
  Description of Artificial Sequence: Synthetic coding sequence
MDAVLEPFPADRLFPGSSFLDLGDLNESDFLNNAHFPEHLDHFTENMEDFSNDLFSSFFDDPVLDEKSPLLDMELDSPTPGIQAEHSYSLSGDSAPQSPLVPIKMEDTTQDAEHGAWALGHKLCSIMVKQEQSPELPVDPLAAPSAMAAAAAMATTPLLGLSPLSRLPIPHQAPGEMTQLPVIKAEPLEVNQFLKVTPEDLVQMPPTPPSSHGSDSDGSQSPRSLPPSSPVRPMARSSTAISTSPLLTAPHKLQGTSGPLLLTEEEKRTLIAEGYPIPTKLPLTKAEEKALKRVRRKIKNKISAQESRRKKKEYVECLEKKVETFTSENNELWKKVETLENANRTLLQQLQKLQTLVTNKISRPYKMAATQTGTCLMVAALCFVLVLGSLVPCLPEFSSGSQTVKEDPLAADGVYTASQMPSRSLLFYDDGAGLWEDGRSTLLPMEPPDGWEINPGGPAEQRPRDHLQHDHLDSTHETTKYLSEAWPKDGGNGTSPDFSHSKEWFHDRDLGPNTTIKLS

SEQ ID NO: 8802 - protein, 431 aa, Artificial Sequence
  Description of Artificial Sequence: Synthetic coding sequence
MDAVLEPFPADRLFPGSSFLDLGDLNESDFLNNAHFPEHLDHFTENMEDFSNDLFSSFFDDPVLDEKSPLLDMELDSPTPGIQAEHSYSLSGDSAPQSPLVPIKMEDTTQEDLVQMPPTPPSSHGSDSDGSQSPRSLPPSSPVRPMARSSTAISTSPLLTAPHKLQGTSGPLLLTEEEKRTLIAEGYPIPTKLPLTKAEEKALKRVRRKIKNKISAQESRRKKKEYVECLEKKVETFTSENNELWKKVETLENANRTLLQQLQKLQTLVTNKISRPYKMAATQTGTCLMVAALCFVLVLGSLVPCLPEFSSGSQTVKEDPLAADGVYTASQMPSRSLLFYDDGAGLWEDGRSTLLPMEPPDGWEINPGGPAEQRPRDHLQHDHLDSTHETTKYLSEAWPKDGGNGTSPDFSHSKEWFHDRDLGPNTTIKLS

SEQ ID NO: 8803 - protein, 519 aa, Artificial Sequence; identical to SEQ ID NO: 8801
  Description of Artificial Sequence: Synthetic coding sequence

SEQ ID NO: 8804 - protein, 520 aa, Artificial Sequence
  Description of Artificial Sequence: Synthetic coding sequence
MEVLESGEQGVLQWDRKLSELSEPGDGEALMYHTHFSELLDEFSQNVLGQLLNDPFLSEKSVSMEVEPSPTSPAPLIQAEHSYSLCEEPRAQSPFTHITTSDSFNDDEVESEKWYLSTDFPSTSIKTEPVTDEPPPGLVPSVTLTITAISTPLEKEEPPLEMNTGVDSSCQTIIPKIKLEPHEVDQFLNFSPKEAPVDHLHLPPTPPSSHGSDSEGSLSPNPRLHPFSLPQTHSPSRAAPRAPSALSSSPLLTAPHKLQGSGPLVLTEEEKRTLIAEGYPIPTKLPLSKSEEKALKKIRRKIKNKISAQESRRKKKEYMDSLEKKVESCSTENLELRKKVEVLENTNRTLLQQLQKLQTLVMGKVSRTCKLAGTQTGTCLMVVVLCFAVAFGSFFQGYGPYPSATKMALPSQHSLQEPYTASVVRSRNLLIYEEHSPPEESSSPGSAGELGGWDRGSSLLRVSGLESRPDVDLPHFIISNETSLEKSVLLELQQHLVSAKLEGNETLKVVELDRRVNTTF

SEQ ID NO: 8805 - protein, 175 aa, Artificial Sequence [sequence omitted]

SEQ ID NO: 8806 - protein, 248 aa, Artificial Sequence
  Description of Artificial Sequence: Synthetic coding sequence
MEVLESGEQGVLQWDRKLSELSEPGDGEALMYHTHFSELLDEFSQNVLGQLLNDPFLSEKSVSMEVEPSPTSPAPLIQAEHSYSLCEEPRAQSPFTHITTSDSFNDDEVESEKWYLSTDFPSTSIKTEPVTDEPPPGLVPSVTLTITAISTPLEKEEPPLEMNTGVDSSCQTIIPKIKLEPHEVDQFLNFSPKEGLSALPVSLWVMDMVSGSTEREYGERAGMSLYHRCCSWLYEIALFLKNKNFASK

SEQ ID NO: 8807 - protein, 460 aa, Artificial Sequence
  Description of Artificial Sequence: Synthetic coding sequence
MEVLESGEQGVLQWDRKLSELSEPGDGEALMYHTHFSELLDEFSQNVLGQLLNDPFLSEKSVSMEVEPSPTSPAPLIQAEHSYSLCEEPRAQSPFTHITTSDSFNDDEVESEKWYLSTDFPSTSIKTEPVTDEPPPGLVPSVTLTITAISTPLEKEEPPLEMNTGVDSSCQTIIPKIKLEPHEVDQFLNFSPKEAPVDHLHLPPTPPSSHGSDSEGSLSPNPRLHPFSLPQTHSPSRAAPRAPSALSSSPLLTAPHKLQGSGPLVLTEEEKRTLIAEGYPIPTKLPLSKSEEKALKKIRRKIKNKISAQESRRKKKEYMDSLEKKVESCSTENLELRKKVEVLENTNRTLLQQLQKLQTLVMGKVSRTCKLAGTQTGTCLMVVVLCFAVAFGSFFQGYGPYPSATKMALPSQHSLQEPYTASVGKTACGKLGRVLFYFPRAGFLSLPKGIFCESPMFKKW

SEQ ID NO: 8808 - protein, 150 aa, Artificial Sequence
  Description of Artificial Sequence: Synthetic coding sequence
MEVLESGEQGVLQWDRKLSELSEPGDGEALMYHTHFSELLDEFSQNVLGQLLNDPFLSEKSVSMEVEPSPTSPAPLIQAEHSYSLCEEPRAQSPFTHITTSDSFNDDEVESEKWYLSTDFPSTSICHSDHHSHLHPVGKGGTSSGNEHWG

SEQ ID NO: 8809 - protein, 436 aa, Artificial Sequence [sequence omitted]

SEQ ID NO: 8810 - protein, 380 aa, Artificial Sequence
  Description of Artificial Sequence: Synthetic coding sequence
MVGFGANRRAGRLPSLVLVVLLVVIVVLAFNYWSISSRHVLLQEEVAELQGQVQRTEVARGRLEKRNSDLLLLVDTHKKQIDQKEADYGRLSSRLQAREGLGKRCEDDKVKLQNNISYQMADIHHLKEQLAELRQEFLRQEDQLQDYRKNNTYLVKRLEYESFQCGQQMKELRAQHEENIKKLADQFLEEQKQETQKIQSNDGKELDINNQVVPKNIPKVAENVADKNEEPSSNHIPHGKEQIKRGGDAGMPGIEENDLAKVDDLPPALRKPPISVSQHESHQAISHLPTGQPLSPNMPPDSHINHNGNPGTSKQNPSSPLQRLIPGSNLDSEPRIQTDILKQATKDRVSDFHKLKQNDEERELQMDPADYGKQHFNDVL

SEQ ID NO: 8811 - protein, 177 aa, Artificial Sequence
  Description of Artificial Sequence: Synthetic coding sequence
MVGFGANRRAGRLPSLVLVVLLVVIVVLAFNYWSISSRHVLLQEEVAELQGQVQRTEVARGRLEKRNSDLLLLVDTHKKQIDQKEADYGRLSSRLQAREGLGKRCEDDKVKLQNNISYQMADIHHLKEQLAELRQEFLRQEDQLQDYRKNNTYLVKRLEYESKRPKRFNQMMERNWI

SEQ ID NO: 8812 - protein, 415 aa, Artificial Sequence
  Description of Artificial Sequence: Synthetic coding sequence
MVVIVVLAFNYWSISSRHVLLQEEVAELQGQVQRTEVARGRLEKRNSDLLLLVDTHKKQIDQKEADYGRLSSRLQAREGLGKRCEDDKVKLQNNISYQMADIHHLKEQLAELRQEFLRQEDQLQDYRKNNTYLVKRLEYESFQCGQQMKELRAQHEENIKKLADQFLEEQKQETQKIQSNDGKELDINNQVVPKNIPKVAENVADKNEEPSSNHIPHGKEQIKRGGDAGMPGIEENDLAKVDDLPPALRKPPISVSQHESHQAISHLPTGQPLSPNMPPDSHINHNGNPGTSKQNPSSPLQRLIPGSNLDSEPRIQTDILKQATKDRVSDFHKLKQSRFFDENESPVDPQHGSKLADYNGDDGNVGEYEADKQAELAYNEEEDGDGGEEDVQDDEERELQMDPADYGKQHFNDVL

SEQ ID NO: 8813 - protein, 24 aa, Artificial Sequence
  Description of Artificial Sequence: Synthetic coding sequence
QDDEERELQMDPADYGKQHFNDVL

SEQ ID NO: 8814 - protein, 433 aa, Artificial Sequence [sequence omitted]

SEQ ID NO: 8815 - protein, 182 aa, Artificial Sequence
  Description of Artificial Sequence: Synthetic coding sequence
MKGWGWLALLLGALLGTAWARRSQDLHCGACRALVDELEWEIAQVDPKKTIQMGSFRINPDGSQSVVEVPYARSEAHLTELLEEICDRMKEYGEQIDPSTHRKNYVRVVGRNGESSELDLQGIRIDSDISGTLKFACESIVEEYEDELIEFFSREADNVKDKLCSKRTDLCDHALHISHDEL

SEQ ID NO: 8816 - protein, 168 aa, Artificial Sequence
  Description of Artificial Sequence: Synthetic coding sequence
MKGWGWLALLLGALLGTAWARRSQDLHCGACRALVDELEWEIAQVDPKKTIQMGSFRINPDGSQSVVEVPYARSEAHLTELLEEICDRMKEYGEQIDPSTHRKNYVRVVGRNGESSELDLQGIRIDSDISGTLKFACESIVEEYEDELIEFFSREADNVKDKLCSKRT

SEQ ID NO: 8817 - protein, 547 aa, Artificial Sequence
  Description of Artificial Sequence: Synthetic coding sequence
MTKTDPAPMAPPPRGEEEEEEEEDEPVPEAPSPTQERRQKPVVHPSAPAPLPKDYAFTFFDPNDPACQEILFDPQTTIPELFAIVRQWVPQVQHKIDVIGNEILRRGCHVNDRDGLTDMTLLHYACKAGAHGVGDPAAAVRLSQQLLALGADVTLRSRWTNMNALHYAAYFDVPDLVRVLLKGARPRVVNSTCSDFNHGSALHIAASSLCLGAAKCLLEHGANPALRNRKGQVPAEVVPDPMDMSLDKAEAALVAKELRTLLEEAVPLSCALPKVTLPNYDNVPGNLMLSALGLRLGDRVLLDGQKTGTLRFCGTTEFASGQWVGVELDEPEGKNDGSVGGVRYFICPPKQGLFASVSKISKAVDAPPSSVTSTPRTPRMDFSRVTGKGRREHKGKKKTPSSPSLGSLQQRDGAKAEVGDQVLVAGQKQGIVRFYGKTDFAPGYWYGIELDQPTGKHDGSVFGVRYFTCPPRHGVFAPASRIQRIGGSTDSPGDSVGAKKVHQVTMTQPKRTFTTVRTPKDIASENSISRLLFCCWFPWMLRAEMQS

SEQ ID NO: 8818 - protein, 523 aa, Artificial Sequence
  Description of Artificial Sequence: Synthetic coding sequence
MNPSPRPPAPPRSAGRSLLCTPRHLPPSLRTTLTFFDPNDPACQEILFDPQTTIPELFAIVRQWVPQVQHKIDVIGNEILRRGCHVNDRDGLTDMTLLHYACKAGAHGVGDPAAAVRLSQQLLALGADVTLRSRWTNMNALHYAAYFDVPDLVRVLLKGARPRVVNSTCSDFNHGSALHIAASSLCLGAAKCLLEHGANPALRNRKGQVPAEVVPDPMDMSLDKAEAALVAKELRTLLEEAVPLSCALPKVTLPNYDNVPGNLMLSALGLRLGDRVLLDGQKTGTLRFCGTTEFASGQWVGVELDEPEGKNDGSVGGVRYFICPPKQGLFASVSKISKAVDAPPSSVTSTPRTPRMDFSRVTGKGRREHKGKKKTPSSPSLGSLQQRDGAKAEVGDQVLVAGQKQGIVRFYGKTDFAPGYWYGIELDQPTGKHDGSVFGVRYFTCPPRHGVFAPASRIQRIGGSTDSPGDSVGAKKVHQVTMTQPKRTFTTVRTPKDIASENSISRLLFCCWFPWMLRAEMQS

SEQ ID NO: 8819 - protein, 429 aa, Artificial Sequence
  Description of Artificial Sequence: Synthetic coding sequence
MTLLHYACKAGAHGVGDPAAAVRLSQQLLALGADVTLRSRWTNMNALHYAAYFDVPDLVRVLLKGARPRVVNSTCSDFNHGSALHIAASSLCLGAAKCLLEHGANPALRNRKGQVPAEVVPDPMDMSLDKAEAALVAKELRTLLEEAVPLSCALPKVTLPNYDNVPGNLMLSALGLRLGDRVLLDGQKTGTLRFCGTTEFASGQWVGVELDEPEGKNDGSVGGVRYFICPPKQGLFASVSKISKAVDAPPSSVTSTPRTPRMDFSRVTGKGRREHKGKKKTPSSPSLGSLQQRDGAKAEVGDQVLVAGQKQGIVRFYGKTDFAPGYWYGIELDQPTGKHDGSVFGVRYFTCPPRHGVFAPASRIQRIGGSTDSPGDSVGAKKVHQVTMTQPKRTFTTVRTPKDIASENSISRLLFCCWFPWMLRAEMQS

SEQ ID NO: 8820 - protein, 352 aa, Artificial Sequence
  Description of Artificial Sequence: Synthetic coding sequence
MKPALLEVMRMNRICRMVLATCLGSFILVIFYFQSMLHPVMRRNPFGVDICCRKGSRSPLQELYNPIQLELSNTAVLHQMRRDQVTDTCRANSATSRKRRVLTPNDLKHLVVDEDHELIYCYVPKVACTNWKRLMMVLTGRGKYSDPMEIPANEAHVSANLKTLNQYSIPEINHRLKSYMKFLFVREPFERLVSAYRNKFTQKYNISFHKRYGTKIIKRQRKNATQEALRKGDDVKFEEFVAYLIDPHTQREEPFNEHWQTVYSLCHPCHIHYDLVGKYETLEEDSNYVLQLAGVGSYLKFPTYAKSTRTTDEMTTEFFQNISSEHQTQLYEVYKLDFLMFNYSVPSYLKLE

SEQ ID NO: 8821 - protein, 347 aa, Artificial Sequence
  Description of Artificial Sequence: Synthetic coding sequence
MKPALLEVMRMNRICRMVLATCLGSFILVIFYFQIMRRNPFGVDICCRKGSRSPLQELYNPIQLELSNTAVLHQMRRDQVTDTCRANSATSRKRRVLTPNDLKHLVVDEDHELIYCYVPKVACTNWKRLMMVLTGRGKYSDPMEIPANEAHVSANLKTLNQYSIPEINHRLKSYMKFLFVREPFERLVSAYRNKFTQKYNISFHKRYGTKIIKRQRKNATQEALRKGDDVKFEEFVAYLIDPHTQREEPFNEHWQTVYSLCHPCHIHYDLVGKYETLEEDSNYVLQLAGVGSYLKFPTYAKSTRTTDEMTTEFFQNISSEHQTQLYEVYKLDFLMFNYSVPSYLKLE

SEQ ID NO: 8822 - protein, 414 aa, Artificial Sequence
  Description of Artificial Sequence: Synthetic coding sequence
MTKARLFRLWLVLGSVFMILLIIVYWDSAGAAHFYLHTSFSRPHTGPPLPTPGPDRDRELTADSDVDEFLDKFLSAGVKQSDLPRKETEQPPAPGSMEESVRGYDWSPRDARRSPDQGRQQAERRSVLRGFCANSSLAFPTKERAFDDIPNSELSHLIVDDRHGAIYCYVPKVACTNWKRVMIVLSGSLLHRGAPYRDPLRIPREHVHNASAHLTFNKFWRRYGKLSRHLMKVKLKKYTKFLFVRDPFVRLISAFRSKFELENEEFYRKFAVPMLRLYANHTSLPASAREAFRAGLKVSFANFIQYLLDPHTEKLAPFNEHWRQVYRLCHPCQIDYDFVGKLETLDEDAAQLLQLLQVDRQLRFPPSYRNRTASSWEEDWFAKIPLAWRQQLYKLYEADFVLFGYPKPENLLRD

SEQ ID NO: 8823 - protein, 245 aa, Artificial Sequence
  Description of Artificial Sequence: Synthetic coding sequence
MTKARLFRLWLVLGSVFMILLIIVYWDSAGAAHFYLHTSFSRPHTGPPLPTPGPDRDRELTADSDVDEFLDKFLSAGVKQSDLPRKETEQPPAPGSMEESVRGYDWSPRDARRSPDQGRQQAERRSVLRGFCANSSLAFPTKERAFDDIPNSELSHLIVDDRHGAIYCYVPKVACTNWKRVMIVLSGSLLHRGAPYRDPLRIPREHVHNASAHLTFNKFWRRYGKLSRHLMKVKLKKYTKFLFVR

SEQ ID NO: 8824 - protein, 341 aa, Artificial Sequence
  Description of Artificial Sequence: Synthetic coding sequence
MGRRCCRRRVLAAACLGAALLLLCAAPRSLRPAFGNRALGSSWLGGEKRSPLQKLYDLDQDPRSTLAKVHRQRRDLLNSACSRHSRRQRLLQPEDLRHVLVDDAHGLLYCYVPKVACTNWKRVLLALSGQARGDPRAISAQEAHAPGRLPSLADFSPAEINRRLRAYLAFLFVREPFERLASAYRNKLARPYSAAFQRRYGARIVQRLRPRALPDARARGHDVRFAEFLAYLLDPRTRREEPFNEHWERAHALCHPCRLRYDVVGKFETLAEDAAFVLGLAGASDLSFPGPPRPRGAAASRDLAARLFRDISPFYQRRLFDLYKMDFLLFNYSAPSYLRLL

SEQ ID NO: 8825 - protein, 225 aa, Artificial Sequence
  Description of Artificial Sequence: Synthetic coding sequence
MGRRCCRRRVLAAACLGAALLLLCAAPRSLRPAFGNRALGSSWLGGEKRSPLQKLYDLDQDPRSTLAKVHRQRRDLLNSACSRHSRRQRLLQPEDLRHVLVDDAHGLLYCYVPKVACTNWKRVLLALSGQARGDPRAISAQEAHAPGRLPSLADFSPAEINRRLRAYLAFLFVREPFERLASAYRNKLARTRSATRVASATTSWASSRRWRRTRPSCWAWRAHPT

SEQ ID NO: 8826 - protein, 386 aa, Artificial Sequence
  Description of Artificial Sequence: Synthetic coding sequence
MLLPKKMKLLLFLVSQMAILALFFHMYSHNISSLSMKAQPERMHVLVLSSWRSGSSFVGQLFGQHPDVFYLMEPAWHVWMTFKQSTAWMLHMAVRDLIRAVFLCDMSVFDAYMEPGPRRQSSLFQWENSRALCSAPACDIIPQDEIIPRAHCRLLCSQQPFEVVEKACRSYSHVVLKEVRFFNLQSLYPLLKDPSLNLHIVHLVRDPRAVFRSRERTKGDLMIDSRIVMGQHEQKLKKEDQPYYVMQVICQSQLEIYKTIQSLPKALQERYLLVRYEDLARAPVAQTSRMYEFVGLEFLPHLQTWVHNITRGKGMGDHAFHTNARDALNVSQAWRWSLPYEKVSRLQKACGDAMNLLGYRHVRSEQEQRNLLLDLLSTWTVPEQIH

SEQ ID NO: 8827 - protein, 386 aa, Artificial Sequence; identical to SEQ ID NO: 8826
  Description of Artificial Sequence: Synthetic coding sequence

SEQ ID NO: 8828 - protein, 305 aa, Artificial Sequence
  Description of Artificial Sequence: Synthetic coding sequence
MLGRNTWKTSAFSFLVEQMWAPLWSRSMRPGRWCSQRSCAWQTSNNTLHPLWTVPVSVPGGTRQSPINIQWRDSVYDPQLKPLRVSYEAASCLYIWNTGYLFQVEFDDATEASGISGGPLENHYRLKQFHFHWGAVNEGGSEHTVDGHAYPAELHLVHWNSVKYQNYKEAVVGENGLAVIGVFLKLGAHHQTLQRLVDILPEIKHKDARAAMRPFDPSTLLPTCWDYWTYAGSLTTPPLTESVTWIIQKEPVEVAPSQLSAFRTLLFSALGEEEKMMVNNYRPLQPLMNRKVWASFQATNEGTRS

SEQ ID NO: 8829 - protein, 237 aa, Artificial Sequence
  Description of Artificial Sequence: Synthetic coding sequence
MDKVCAVFGGSRGIGRAVAQLMARKGYRLAVIARNLEGAKAAAGDLGGDHLAFSCDVAKEHDVQNTFEELEKHLGRVNFLVNAAGINRDGLLVRTKTEDMVSQLHTNLLGSMLTCKAAMRTMIQQQGGSIVNVGSIVGLKGNSGQSVYSASKGGLVGFSRALAKEVARKKIRVNVVAPGFVHTDMTKDLKEEHLKKNIPLGRFGETIEVAHAVVFLLESPYITGHVLVVDGGLQLIL

SEQ ID NO: 8830 - protein, 179 aa, Artificial Sequence
  Description of Artificial Sequence: Synthetic coding sequence
MDKVCAVFGGSRGIGRAVAQLMARKGYRLAVIARNLEGAKAAAGDLGGDHLAFSCDVAKEHDVQNTFEELEKHLGRVNFLVNAAGINRDGLLVRTKTEDMVSQLHTNLLGSMLTCKAAMRTMIQQQGGSIVNVGSIVGLKGNSGQSVYSASKGGLVGFSRALAKEVARKKIRVNVVAPG

SEQ ID NO: 8831 - protein, 623 aa, Artificial Sequence
  Description of Artificial Sequence: Synthetic coding sequence
MTAQSRSPTTPTFPGPSQRTPLTPCPVQTPRLGKALIHCWTDPGQPLGEQQRVRRQRTETSEPTMRLHRLRARLSAVACGLLLLLVRGQGQDSASPIRTTHTGQVLGSLVHVKGANAGVQTFLGIPFAKPPLGPLRFAPPEPPESWSGVRDGTTHPAMCLQDLTAVESEFLSQFNMTFPSDSMSEDCLYLSIYTPAHSHEGSNLPVMVWIHGGALVFGMASLYDGSMLAALENVVVVIIQYRLGVLGFFSTGDKHATGNWGYLDQVAALRWVQQNIAHFGGNPDRVTIFGESAGGTSVSSLVVSPISQGLFHGAIMESGVALLPGLIASSADVISTVVANLSACDQVDSEALVGCLRGKSKEEILAINKPFKMIPGVVDGVFLPRHPQELLASADFQPVPSIVGVNNNEFGWLIPKVMRIYDTQKEMDREASQAALQKMLTLLMLPPTFGDLLREEYIGDNGDPQTLQAQFQEMMADSMFVIPALQVAHFQCSRAPVYFYEFQHQPSWLKNIRPPHMKADHGDELPFVFRSFFGGNYIKFTEEEEQLSRKMMKYWANFARNGNPNGEGLPHWPLFDQEEQYLQLNLQPAVGRALKAHRLQFWKKALPQKIQELEEPEERHTEL

SEQ ID NO: 8832 - protein, 607 aa, Artificial Sequence
  Description of Artificial Sequence: Synthetic coding sequence
MTAQSRSPTTPTFPGPSQRTPLTPCPVQTPRLGKALIHCWTDPGQPLGEQQRVRRQRTETSEPTMRLHRLRARLSAVACGLLLLLVRGQGQDSASPIRTTHTGQVLGSLVHVKGANAGVQTFLGIPFAKPPLGPLRFAPPEPPESWSGVRDGTTHPAMCLQDLTAVESEFLSQFNMTFPSDSMSEDCLYLSIYTPAHSHEGSNLPVMVWIHGGALVFGMASLYDGSMLAALENVVVVIIQYRLGVLGFFSTGDKHATGNWGYLDQVAALRWVQQNIAHFGGNPDRVTIFGESAGGTSVSSLVVSPISQGLFHGAIMESGVALLPGLIASSADVISTVVANLSACDQVDSEALVGCLRGKSKEEILAINKPFKMIPGVVDGVFLPRHPQELLASADFQPVPSIVGVNNNEFGWLIPKVMRIYDTQKEMDREASQAALQKMLTLLMLPPTFGDLLREEYIGDNGDPQTLQAQFQEMMADSMFVIPALQVAHFQCSRAPVYFYEFQHQPSWLKNIRPPHMKADHVKFTEEEEQLSRKMMKYWANFARNGNPNGEGLPHWPLFDQEEQYLQLNLQPAVGRALKAHRLQFWKKALPQKIQELEEPEERHTEL

SEQ ID NO: 8833 - protein, 300 aa, Artificial Sequence
  Description of Artificial Sequence: Synthetic coding sequence
MEIPMGTQGCFSKSLLLSASILVLWMLQGSQAALYIQKIPEQPQKNQDLLLSVQGVPDTFQDFNWYLGEETYGGTRLFTYIPGIQRPQRDGSAMGQRDIVGFPNGSMLLRRAQPTDSGTYQVAITINSEWTMKAKTEVQVAEKNKELPSTHLPTNAGILAATIIGSLAAGALLISCIAYLLVTRNWRGQSHRLPAPRGQGSLSILCSAVSPVPSVTPSTWMATTEKPELGPAHDAGDNNIYEVMPSPVLLVSPISDTRSINPARPLPTPPHLQAEPENHQYQQDLLNPDPAPYCQLVPTS

SEQ ID NO: 8834 - protein, 299 aa, Artificial Sequence
  Description of Artificial Sequence: Synthetic coding sequence
MEIPMGTQGCFSKSLLLSASILVLWMLQGSQAALYIQKIPEQPQKNQDLLLSVQGVPDTFQDFNWYLGEETYGGTRLFTYIPGIQRPQRDGSAMGQRDIVGFPNGSMLLRRAQPTDSGTYQVAITINSEWTMKAKTEVQVAEKNKELPSTHLPTNAGILAATIIGSLAAGALLISCIAYLLVTRNWRGQSHRLPAPRGQGSLSILCSAVSPVPSVTPSTWMATTEKPELGPAHDAGDNNIYEVMPSPVLLVSPISDTRSINPARPLPTPPHLQAEPENHQYQDLLNPDPAPYCQLVPTS

SEQ ID NO: 8835 - protein, 292 aa, Artificial Sequence
  Description of Artificial Sequence: Synthetic coding sequence
MGPPSACPHRECIPWQGLLLTASLLTFWNAPTTAWLFIASAPFEVAEGENVHLSVVYLPENLYSYGWYKGKTVEPNQLIAAYVIDTHVRTPGPAYSGRETISPSGDLHFQNVTLEDTGYYTLQVTYRNSQIEQASHHLRVYESVAQPSIQASSTTVTEKGSVVLTCHTNNTGTSFQWIFNNQRLQVTKRMKLSWFNHMLTIDPIRQEDAGEYQCEVSNPVSSNRSDPLKLTVKYDNTLGILIGVLVGSLLVAALVCFLLLRKTGRASDQSDFREQQPPASTPGHGPSDSSIS

SEQ ID NO: 8836 - protein, 293 aa, Artificial Sequence
  Description of Artificial Sequence: Synthetic coding sequence
MGPPSACPHRECIPWQGLLLTASLLTFWNAPTTAWLFIASAPFEVAEGENVHLSVVYLPENLYSYGWYKGKTVEPNQLIAAYVIDTHVRTPGPAYSGRETISPSGDLHFQNVTLEDTGYYTLQVTYRNSQIEQASHHLRVYESVAQPSIQASSTTVTEKGSVVLTCHTNNTGTSFQWIFNNQRLQVTKRMKLSWFNHMLTIDPIRQEDAGEYQCEVSNPVSSNRSDPLKLTVKSDDNTLGILIGVLVGSLLVAALVCFLLLRKTGRASDQSDFREQQPPASTPGHGPSDSSIS

SEQ ID NO: 8837 - protein, 212 aa, Artificial Sequence
  Description of Artificial Sequence: Synthetic coding sequence
MGPPSASPHRECIPWQGLLLTASLLNFWNPPTTAKLTIESMPLSVAEGKEVLLLVHNLPQHLFGYSWYKGERVDGNSLIVGYVIGTQQATPGAAYSGRETIYTNASLLIQNVTQNDIGFYTLQVIKSDLVNEEATGQFHVYQENAPGLPVGAVAGIVTGVLVGVALVAALVCFLLLAKTGRPWSLPQLCLLDVPSLHCPGPPTQPQDSSFHL

SEQ ID NO: 8838 - protein, 212 aa, Artificial Sequence; identical to SEQ ID NO: 8837
  Description of Artificial Sequence: Synthetic coding sequence

SEQ ID NO: 8839 - protein, 252 aa, Artificial Sequence
  Description of Artificial Sequence: Synthetic coding sequence
MGPPSASPHRECIPWQGLLLTASLLNFWNPPTTAKLTIESMPLSVAEGKEVLLLVHNLPQHLFGYSWYKGERVDGNSLIVGYVIGTQQATPGAAYSGRETIYTNASLLIQNVTQNDIGFYTLQVIKSDLVNEEATGQFHVYQENAPGLPVGAVAGIVTGVLVGVALVAALVCFLLLAKTGRTSIQRDLKEQQPQALAPGRGPSHSSAFSMSPLSTAQAPLPNPRTAASIYEELLKHDTNIYCRMDHKAEVAS

SEQ ID NO: 8840 - protein, 177 aa, Artificial Sequence
  Description of Artificial Sequence: Synthetic coding sequence
MGPPSASPHRECIPWQGLLLTASLLNFWNPPTTAKLTIESMPLSVAEGKEVLLLVHNLPQHLFGYSWYKGERVDGNSLIVGYVIGTQQATPGAAYSGRETIYTNASLLIQNVTQNDIGFYTLQVIKSDLVNEEATGQFHVYPELPKPSISSNNSNPKEDKDAVAFTCEPEIHSTTCL

SEQ ID NO: 8841 - protein, 244 aa, Artificial Sequence
  Description of Artificial Sequence: Synthetic coding sequence
MGPPSAAPRGGHRPWQGLLITASLLTFWHPPTTVQFTIEALPSSAAEGKDVLLLACNISETIQAYYWHKGKTAEGSPLIAGYITDIQANIPGAAYSGRETVYPNGSLLFQNITLEDAGSYTLRTINASYDSDQATGQLHVHQNNVPGLPVGAVAGIVTGVLVGVALVAALVCFLLLSRTGRASIQRDLREQPPPASTPGHGPSHRSTFSAPLPSPRTATPIYEELLYSDANIYCQIDHKADVVS

SEQ ID NO: 8842 - protein, 265 aa, Artificial Sequence
  Description of Artificial Sequence: Synthetic coding sequence
MGSPSACPYRVCIPWQGLLLTASLLTFWNLPNSAQTNIDVVPFNVAEGKEVLLVVHNESQNLYGYNWYKGERVHANYRIIGYVKNISQENAPGPAHNGRETIYPNGTLLIQNVTHNDAGFYTLHVIKENLVNEEVTRQFYVFSEPPKPSITSNNFNPVENKDIVVLTCQPETQNTTYLWWVNNQSLLVSPRLLLSTDNRTLVLLSATKNDIGPYECEIQNPVGASRSDPVTLNVRYESVQASSPDLSAGTAVSIMIGVLAGMALI

SEQ ID NO: 8843 - protein, 172 aa, Artificial Sequence [sequence omitted]

SEQ ID NO: 8844 - protein, 265 aa, Artificial Sequence; identical to SEQ ID NO: 8842
  Description of Artificial Sequence: Synthetic coding sequence

SEQ ID NO: 8845 - protein, 244 aa, Artificial Sequence
  Description of Artificial Sequence: Synthetic coding sequence
MGSPSACPYRVCIPWQGLLLTASLLTFWNLPNSAQTNIDVVPFNVAEGKEVLLVVHNESQNLYGYNWYKGERVHANGRETIYPNGTLLIQNVTHNDAGFYTLHVIKENLVNEEVTRQFYVFSEPPKPSITSNNFNPVENKDIVVLTCQPETQNTTYLWWVNNQSLLVSPRLLLSTDNRTLVLLSATKNDIGPYECEIQNPVGASRSDPVTLNVRYESVQASSPDLSAGTAVSIMIGVLAGMALI

SEQ ID NO: 8846 - protein, 786 aa, Artificial Sequence
  Description of Artificial Sequence: Synthetic coding sequence
MKGTGIMDCAPKALLARALYDNCPDCSDELAFSRGDILTILEQHVPESEGWWKCLLHGRQGLAPANRLQILTEVAADRPCPPFLRGLEEAPASSEETYQVPTLPRPPTPGPVYEQMRSWAEGPQPPTAQVYEFPDPPTSARIICEKTLSFPKQAILTLPRPVRASLPTLPSQVYDVPTQHRGPVVLKEPEKQQLYDIPASPKKAGLHPPDSQASGQGVPLISVTTLRRGGYSTLPNPQKSEWIYDTPVSPGKASVRNTPLTSFAEESRPHALPSSSSTFYNPPSGRSRSLTPQLNNNVPMQKKLSLPEIPSYGFLVPRGTFPLDEDVSYKVPSSFLIPRVEQQNTKPNIYDIPKATSSVSQAGKELEKAKEVSENSAGHNSSWFSRRTTSPSPEPDRLSGSSSDSRASIVSSCSTTSTDDSSSSSSEESAKELSLDLDVAKETVMALQHKVVSSVAGLMLFVSRKWRFRDYLEANIDAIHRSTDHIEESVREFLDFARGVHGTACNLTDSNLQNRIRDQMQTISNSYRILLETKESLDNRNWPLEVLVTDSVQNSPDDLERFVMVARMLPEDIKRFASIVIANGRLLFKRNCEKEETVQLTPNAEFKCEKYIQPPQRETESHQKSTPSTKQREDEHSSELLKKNRANICGQNPGPLIPQPSSQQTPERKPRLSEHCRLYFGALFKAISAFHGSLSSSQPAEIITQSKLVIMVGQKLVDTLCMETQERDVRNEILRGSSHLCSLLKDVALATKNAVLTYPSPAALGHLQAEAEKLEQHTRQFRGTLG

SEQ ID NO: 8847 - protein, 786 aa, Artificial Sequence; identical to SEQ ID NO: 8846
  Description of Artificial Sequence: Synthetic coding sequence

SEQ ID NO: 8848 - protein, 349 aa, Artificial Sequence
  Description of Artificial Sequence: Synthetic coding sequence
MKGTGIMDCAPKALLARALYDNCPDCSDELAFSRGDILTILEQHVPESEGWWKCLLHGRQGLAPANRLQILTEVAADRPCPPFLRGLEEAPASSEETYQVPTLPRPPTPGPVYEQMRSWAEGPQPPTAQVYEFPDPPTSARIICEKTLSFPKQAILTLPRPVRASLPTLPSQVYDVPTQHRGPVVLKEPEKQQLYDIPASPKKAGLHPPDSQASNPGPLIPQPSSQQTPERKPRLSEHCRLYFGALFKAISAFHGSLSSSQPAEIITQSKLVIMVGQKLVDTLCMETQERDVRNEILRGSSHLCSLLKDVALATKNAVLTYPSPAALGHLQAEAEKLEQHTRQFRGTLG

SEQ ID NO: 8849 - protein, 228 aa, Artificial Sequence
  Description of Artificial Sequence: Synthetic coding sequence
MSSSEEVSWISWFCGLRGNEFFCEVDEDYIQDKFNLTGLNEQVPHYRQALDMILDLEPDEELEDNPNQSDLIEQAAEMLYGLIHARYILTNRGIAQMLEKYQQGDFGYCPRVYCENQPMLPIGLSDIPGEAMVKLYCPKCMDVYTPKSSRHHHTDGAYFGTGFPHMLFMVHPEYRPKRPANQFVPSSCSRHPDVPLLPRRRPFCRMHFRLREVYHQQLIPVHGDHHLL

SEQ ID NO: 8850 - protein, 393 aa, Artificial Sequence
  Description of Artificial Sequence: Synthetic coding sequence
MYAWFFLPSFSQSPPTFGFLLDIDGVLVRGHRVIPAALKAFRRLVNSQGQLRVPVVFVTNAGNILQHSKAQELSALLGCEVDADQVILSHSPMKLFSEYHEKRMLVSGQGPVMENAQGLGFRNVVTVDELRMAFPLLDMVDLERRLKTTPLPRNDFPRIEGVLLLGEPVRWETSLQLIMDVLLSNGSPGAGLATPPYPHLPVLASNMDLLWMAEAKMPRFGHGTFLLCLETIYQKVTGKELRYEGLMGKPSILTYQYAEDLIRRQAERRGWAAPIRKLYAVGDNPMSDVYGANLFHQYLQKATHDGAPELGAGGTRQQQPSASQSCISILVCTGVYNPRNPQSTEPVLGGGEPPFHGHRDLCFSPGLMEASHVVNDVNEAVQLVFRKEGWALE

SEQ ID NO: 8851 - protein, 423 aa, Artificial Sequence
  Description of Artificial Sequence: Synthetic coding sequence
MAAWGCVAALGAARGLCWRAARAAAGLQGRPARRCYAVGPAQSPPTFGFLLDIDGVLVRGHRVIPAALKAFRRLVNSQGQLRVPVVFVTNAGNILQHSKAQELSALLGCEVDADQVILSHSPMKLFSEYHEKRMLVSGQGPVMENAQGLGFRNVVTVDELRMAFPLLDMVDLERRLKTTPLPRNDFPRIEGVLLLGEPVRWETSLQLIMDVLLSNGSPGAGLATPPYPHLPVLASNMDLLWMAEAKMPRFGHGTFLLCLETIYQKVTGKELRYEGLMGKPSILTYQYAEDLIRRQAERRGWAAPIRKLYAVGDNPMSDVYGANLFHQYLQKATHDGAPELGAGGTRQQQPSASQSCISILVCTGVYNPRNPQSTEPVLGGGEPPFHGHRDLCFSPGLMEASHVVNDVNEAVQLVFRKEGWALE

SEQ ID NO: 8852 - protein, 262 aa, Artificial Sequence
  Description of Artificial Sequence: Synthetic coding sequence
MTQPVPRLSVPAALALGSAALGAAFATGLFLGRRCPPWRGRREQCLLPPEDSRLWQYLLSRSMREHPALRSLRLLTLEQPQGDSMMTCEQAQLLANLARLIQAKKALDLGTFTGYSALALALALPADGRVVTCEVDAQPPELGRPLWRQAEAEHKIDLRLKPALETLDELLAAGEAGTFDVAVVDADKENCSAYYERCLQLLRPGGILAVLRVLWRGKVLQPPKGDVAAECVRNLNERIRRDVRVYISLLPLGDGLTLAFKI

SEQ ID NO: 8853 - protein, 287 aa, Artificial Sequence
  Description of Artificial Sequence: Synthetic coding sequence
MTQPVPRLSVPAALALGSAALGAAFATGLFLGRRCPPWRGRREQCLLPPEDSRLWQYLLSRSMREHPALRSLRLLTLEQPQGDSMMTCEQAQLLANLARLIQAKKALDLGTFTGYSALALALALPADGRVVTCEVDAGRGGAQDRPPAEARLGDPGRAAGGGRGRHLRRGRGGCGQGELLRLLRALPAAAATRRHPRRPQSPVAREGAATSERGRGGRVCAKPKRTHPAGRQGLHQPPAPGRWTHLGLQDLGLAPSEWARGRVAWEPQELTLSFKFENKVGLGHTTS

SEQ ID NO: 8854 - protein, 321 aa, Artificial Sequence
  Description of Artificial Sequence: Synthetic coding sequence
MDVRALPWLPWLLWLLCRGGGDADSRAPFTPTWPRSREREAAAFRESLNRHRYLNSLFPSENSTAFYGINQFSYLFPEEFKAIYLRSKPSKFPRYSAEVHMSIPNVSLPLRFDWRDKQVVTQVRNQQMCGGCWAFSVVGAVESAYAIKGKPLEDLSVQQVIDCSYNNYGCNGGSTLNALNWLNKMQVKLVKDSEYPFKAQNGLCHYFSGSHSGFSIKGYSAYDFSDQEDEMAKALLTFGPLVVIVDAVSWQDYLGGIIQHHCSSGEANHAVLITGFDKTGSTPYWIVRNSWGSSWGVDGYAHVKMGSNVCGIADSVSSIFV

SEQ ID NO: 8855 - protein, 530 aa, Artificial Sequence
  Description of Artificial Sequence: Synthetic coding sequence
MAAYQQEEQMQLPRADAIRSRLIDTFSLIEHLQGLSQAVPRHTIRELLDPSRQKKLVLGDQHQLVRFSIKPQRIEQISHAQRLLSRLHVRCSQRPPLSLWAGWVLECPLFKNFIIFLVFLNTIILMVEIELLESTNTKLWPLKLTLEVAAWFILLIFILEILLKWLSNFSVFWKSAWNVFDFVVTMLSLLPEVVVLVGVTGQSVWLQLLRICRVLRSLKLLAQFRQIQIIILVLVRALKSMTFLLMLLLIFFYIFAVTGVYVFSEYTRSPRQDLEYHVFFSDLPNSLVTVFILFTLDHWYALLQDVWKVPEVSRIFSSIYFILWLLLGSIIFRSIIVAMMVTNFQNIRKELNEEMARREVQLKADMFKRQIIQRRKNMSHEALTSSHSKIEDSSRGASQQRESLDLSEVSEVESNYGATEEDLITSASKTEETLSKKREYQSSSCVSSTSSSYSSSSESRFSESIGRLDWETLVHENLPGLMEMDQDDRVWPRDSLFRYFELLEKLQYNLEERKKLQEFAVQALMNLEDK

SEQ ID NO: 8856 - protein, 530 aa, Artificial Sequence; identical to SEQ ID NO: 8855
  Description of Artificial Sequence: Synthetic coding sequence

SEQ ID NO: 8857 - protein, 528 aa, Artificial Sequence
  Description of Artificial Sequence: Synthetic coding sequence
MAAYQQEEQMQLPRADAIRSRLIDTFSLIEHLQGLSQAVPRHTIRELLDPSRQKKLVLGDQHQLVRFSIKPQRIEQISHAQRLLSRLHVRCSQRPPLSLWAGWVLECPLFKNFIIFLVFLNTIILMVEIELLESTNTKLWPLKLTLEVAAWFILLIFILEILLKWLSNFSVFWKSAWNVFDFVVTMLSLLPEVVVLVGVTGQSVWLQLLRICRVLRSLKLLAQFRQIQIIILVLVRALKSMTFLLMLLLIFFYIFAVTGVYVFSEYTRSPRQDLEYHVFFSDLPNSLVTVFILFTLDHWYALLQDVWKVPEVSRIFSSIYFILWLLLGSIIFRSIIVAMMVTNFQNIRKELNEEMARREVQLKADMFKRQIIQRRKNMSHEALTSSHSKIEDRGASQQRESLDLSEVSEVESNYGATEEDLITSASKTEETLSKKREYQSSSCVSSTSSSYSSSSESRFSESIGRLDWETLVHENLPGLMEMDQDDRVWPRDSLFRYFELLEKLQYNLEERKKLQEFAVQALMNLEDK

SEQ ID NO: 8858 - protein, 414 aa, Artificial Sequence
  Description of Artificial Sequence: Synthetic coding sequence
MAAYQQEEQMQLPRADAIRSRLIDTFSLIEHLQGLSQAVPRHTIRELLDPSRQKKLVLGDQHQLVRFSIKPQRIEQISHAQRLLSRLHVRCSQRPPLSLWAGWVLECPLFKNFIIFLVFLNTIILMVEIELLESTNTKLWPLKLTLEVAAWFILLIFILEILLKWLSNFSVFWKSAWNVFDFVVTMLSLLPEVVVLVGVTGQSVWLQLLRICRVLRSLKLLAQFRQIQIIILVLVRALKSMTFLLMLLLIFFYIFAVTGVYVFSEYTRSPRQDLEYHVFFSDLPNSLVTVFILFTLDHWYALLQDVWKVPEVSRIFSSIYFILWLLLGSIIFRSIIVAMMVTNFQNIRKELNEEMARREVQLKADMFKRQIIQRRKNMSHEALTSSHSKIEDRSFGLGDSCARKSARANGNGSG

SEQ ID NO: 8859 - protein, 528 aa, Artificial Sequence; identical to SEQ ID NO: 8857
  Description of Artificial Sequence: Synthetic coding sequence

SEQ ID NO: 8860 - protein, 64 aa, Artificial Sequence
  Description of Artificial Sequence: Synthetic coding sequence
MAAYQQEEQMQLPRADAIRSRLIDTFSLIEHLQGLSQAVPRHTIRELLDPSRQKKLVLGDQHQL

SEQ ID NO: 8861 - protein, 48 aa, Artificial Sequence
  Description of Artificial Sequence: Synthetic coding sequence
MAAYQQEEQMQLPRADAIRSRLIDTFSLIEHLQGLSQAVPRHTIRELL

SEQ ID NO: 8862 - protein, 80 aa, Artificial Sequence
  Description of Artificial Sequence: Synthetic coding sequence
MAAYQQEEQMQLPRADAIRSRLIDTFSLIEHLQGLSQAVPRHTIRELLDPSRQKKLVLGDQHQLVRFSIKPQRIEQISHA

SEQ ID NO: 8863 - protein, 482 aa, Artificial Sequence
  Description of Artificial Sequence: Synthetic coding sequence
MAAAAAGAGSGPWAAQEKQFPPALLSFFIYNPRFGPREGQEENKILFYHPNEVEKNEKIRNVGLCEAIVQFTRTFSPSKPAKSLHTQKNRQFFNEPEENFWMVMVVRNPIIEKQSKDGKPVIEYQEEELLDKVYSSVLRQCYSMYKLFNGTFLKAMEDGGVKLLKERLEKFFHRYLQTLHLQSCDLLDIFGGISFFPLDKMTYLKIQSFINRMEESLNIVKYTAFLYNDQLIWSGLEQDDMRILYKYLTTSLFPRHIEPELAGRDSPIRAEMPGNLQHYGRFLTGPLNLNDPDAKCRFPKIFVNTDDTYEELHLIVYKAMSAAVCFMIDASVHPTLDFCRRLDSIVGPQLTVLASDICEQFNINKRMSGSEKEPQFKFIYFNHMNLAEKSTVHMRKTPSVSLTSVHPDLMKILGDINSDFTRVDEDEEIIVKAMSDYWVVGKKSDRRELYVILNQKNANLIEVNEEVKKLCATQFNNIFFLD

SEQ ID NO: 8864 - protein, 339 aa, Artificial Sequence
  Description of Artificial Sequence: Synthetic coding sequence
MYKLFNGTFLKAMEDGGVKLLKERLEKFFHRYLQTLHLQSCDLLDIFGGISFFPLDKMTYLKIQSFINRMEESLNIVKYTAFLYNDQLIWSGLEQDDMRILYKYLTTSLFPRHIEPELAGRDSPIRAEMPGNLQHYGRFLTGPLNLNDPDAKCRFPKIFVNTDDTYEELHLIVYKAMSAAVCFMIDASVHPTLDFCRRLDSIVGPQLTVLASDICEQFNINKRMSGSEKEPQFKFIYFNHMNLAEKSTVHMRKTPSVSLTSVHPDLMKILGDINSDFTRVDEDEEIIVKAMSDYWVVGKKSDRRELYVILNQKNANLIEVNEEVKKLCATQFNNIFFLD

SEQ ID NO: 8865 - protein, 482 aa, Artificial Sequence; identical to SEQ ID NO: 8863
  Description of Artificial Sequence: Synthetic coding sequence

SEQ ID NO: 8866 - protein, 339 aa, Artificial Sequence; identical to SEQ ID NO: 8864
  Description of Artificial Sequence: Synthetic coding sequence

SEQ ID NO: 8867 - protein, 1021 aa, Artificial Sequence
  Description of Artificial Sequence: Synthetic coding sequence
MAGISYVASFFLLLTKLSIGQREVTVQKGPLFRAEGYPVSIGCNVTGHQGPSEQHFQWSVYLPTNPTQEVQIISTKDAAFSYAVYTQRVRSGDVYVERVQGNSVLLHISKLQMKDAGEYECHTPNTDEKYYGSYSAKTNLIVIPDTLSATMSSQTLGKEEGEPLALTCEASKATAQHTHLSVTWYLTQDGGGSQATEIISLSKDFILVPGPLYTERFAASDVQLNKLGPTTFRLSIERLQSSDQGQLFCEATEWIQDPDETWMFITKKQTDQTTLRIQPAVKDFQVNITADSLFAEGKPLELVCLVVSSGRDPQLQGIWFFNGTEIAHIDAGGVLGLKNDYKERASQGELQVSKLGPKAFSLKIFSLGPEDEGAYRCVVAEVMKTRTGSWQVLQRKQSPDSHVHLRKPAARSVVMSTKNKQQVVWEGETLAFLCKAGGAESPLSVSWWHIPRDQTQPEFVAGMGQDGIVQLGASYGVPSYHGNTRLEKMDWATFQLEITFTAITDSGTYECRVSEKSRNQARDLSWTQKISVTVKSLESSLQVSLMSRQPQVMLTNTFDLSCVVRAGYSDLKVPLTVTWQFQPASSHIFHQLIRITHNGTIEWGNFLSRFQKKTKVSQSLFRSQLLVHDATEEETGVYQCEVEVYDRNSLYNNRPPRASAISHPLRIAVTLPESKLKVNSRSQVQELSINSNTDIECSILSRSNGNLQLAIIWYFSPVSTNASWLKILEMDQTNVIKTGDEFHTPQRKQKFHTEKVSQDLFQLHILNVEDSDRGKYHCAVEEWLLSTNGTWHKLGEKKSGLTELKLKPTGSKVRVSKVYWTENVTEHREVAIRCSLESVGSSATLYSVMWYWNRENSGSKLLVHLQHDGLLEYGEEGLRRHLHCYRSSSTDFVLKLHQVEMEDAGMYWCRVAEWQLHGHPSKWINQASDESQRMVLTVLPSEPTLPSRICSSAPLLYFLFICPFVLLLLLLISLLCLYWKARKLSTLRSNTRKEKALWVDLKEAGGVTTNRREDEEEDEGN

SEQ ID NO: 8868 - protein, 1021 aa, Artificial Sequence; identical to SEQ ID NO: 8867
  Description of Artificial Sequence: Synthetic coding sequence

SEQ ID NO: 8869 - protein, 181 aa, Artificial Sequence
  Description of Artificial Sequence: Synthetic coding sequence
MLLEPGRGCCALAILLAIVDIQSGGCINITSSASQEGTRLNLICTVWHKKEEAEGFVVFLCKDRSGDCSPETSLKQLRLKRDPGIDGVGEISSQLMFTISQVTPLHSGTYQCCARSQKSGIRLQGHFFSILFTETGNYTVTGLKQRQHLEFSHNEGTLSSGFLQEKVWVMLVTSLVALQAL

SEQ ID NO: 8870 - protein, 181 aa, Artificial Sequence; identical to SEQ ID NO: 8869
  Description of Artificial Sequence: Synthetic coding sequence

SEQ ID NO: 8871 - protein, 125 aa, Artificial Sequence
  Description of Artificial Sequence: Synthetic coding sequence
MLLEPGRGCCALAILLAIVDIQSGETGNYTVTGLKQRQHLEFSHNEGTLSSGFLQEKVWVMLVTSLVALQGMSKRAVSTPSNEGAIIFLPPWLFSRRRRLERMSRGREKCYSSPGYPQESSNQFH

SEQ ID NO: 8872 - protein, 181 aa, Artificial Sequence; identical to SEQ ID NO: 8869
  Description of Artificial Sequence: Synthetic coding sequence

SEQ ID NO: 8873 - protein, 171 aa, Artificial Sequence [sequence omitted]

SEQ ID NO: 8874 - protein, 173 aa, Artificial Sequence
  Description of Artificial Sequence: Synthetic coding sequence
MEAPGPRALRTALCGGCCCLLLCAQLAVAGKGARGFGRGALIRLNIWPAVQGACKQLEVCEHCVEGDRARNLSSCMWEQCRPEEPGHCVAQSEVVKEGCSIYNRSEACPAAHHHPTYEPKTVTTGSPPVPEAHSPGFDGASFIGGVVLVLSLQAVAFFVLHFLKAKDSTYQTL

SEQ ID NO: 8875 - protein, 174 aa, Artificial Sequence [sequence omitted]

SEQ ID NO: 8876 - protein, 661 aa, Artificial Sequence
  Description of Artificial Sequence: Synthetic coding sequence
MAFDVSCFFWVVLFSAGCKVITSWDQMCIEKEANKTYNCENLGLSEIPDTLPNTTEFLEFSFNFLPTIHNRTFSRLMNLTFLDLTRCQINWIHEDTFQSHHQLSTLVLTGNPLIFMAETSLNGPKSLKHLFLIQTGISNLEFIPVHNLENLESLYLGSNHISSIKFPKDFPARNLKVLDFQNNAIHYISREDMRSLEQAINLSLNFNGNNVKGIELGAFDSTIFQSLNFGGTPNLSVIFNGLQNSTTQSLWLGTFEDIDDEDISSAMLKGLCEMSVESLNLQEHRFSDISSTTFQCFTQLQELDLTATHLKGLPSGMKGLNLLKKLVLSVNHFDQLCQISAANFPSLTHLYIRGNVKKLHLGVGCLEKLGNLQTLDLSHNDIEASDCCSLQLKNLSHLQTLNLSHNEPLGLQSQAFKECPQLELLDLAFTRLHINAPQSPFQNLHFLQVLNLTYCFLDTSNQHLLAGLPVLRHLNLKGNHFQDGTITKTNLLQTVGSLEVLILSSCGLLSIDQQAFHSLGKMSHVDLSHNSLTCDSIDSLSHLKGIYLNLAANSINIISPRLLPILSQQSTINLSHNPLDCTCSNIHFLTWYKENLHKLEGSEETTCANPPSLRGVKLSDVKLSCGITAIGIFFLIVFLLLLAILLFFAVKYLLRWKYQHI

SEQ ID NO: 8877 - protein, 271 aa, Artificial Sequence
  Description of Artificial Sequence: Synthetic coding sequence
MSAPRLLISIIIMVSASSSSCMGGKQMTQNYSTIFAEGNISQPVLMDINAVLCCPPIALRNLIIITWEIILRGQPSCTKAYKKETNETKETNCTVERITWVSRPDQNSDLQIRPVDTTHDGYYRGIVVTPDGNFHRGYHLQVLVTPEVNLFQSRNITAVCKAVTGKPAAQISWIPEGSILATKQEYWGNGTVTVKSTCPWEGHKSTVTCHVSHLTGNKSLSVKLNSGLRTSGSPALSLLIILYVKLSLFVVILVTTGFVFFQRINHVRKVL

SEQ ID NO: 8878 - protein, 250 aa, Artificial Sequence
  Description of Artificial Sequence: Synthetic coding sequence
MGGKQMTQNYSTIFAEGNISQPVLMDINAVLCCPPIALRNLIIITWEIILRGQPSCTKAYKKETNETKETNCTVERITWVSRPDQNSDLQIRPVDTTHDGYYRGIVVTPDGNFHRGYHLQVLVTPEVNLFQSRNITAVCKAVTGKPAAQISWIPEGSILATKQEYWGNGTVTVKSTCPWEGHKSTVTCHVSHLTGNKSLSVKLNSGLRTSGSPALSLLIILYVKLSLFVVILVTTGFVFFQRINHVRKVL

SEQ ID NO: 8879 - protein, 250 aa, Artificial Sequence; identical to SEQ ID NO: 8878
  Description of Artificial Sequence: Synthetic coding sequence

SEQ ID NO: 8880 - protein, 176 aa, Artificial Sequence
  Description of Artificial Sequence: Synthetic coding sequence
MRIFAVFIFMTYWHLLNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 8881 - protein, 290 aa, Artificial Sequence
  Description of Artificial Sequence: Synthetic coding sequence
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 8882 - protein, 194 aa, Artificial Sequence
  Description of Artificial Sequence: Synthetic coding sequence
MWLSPSLLLLILPGYSIAAKITGPTTVNGSEQGSLTVQCAYGSGWETYLKWRCQGADWNYCNILVKTNGSEQEVKKNRVSIRDNQKNHVFTVTMENLKRDDADSYWCGTERPGIDLGVKVQVTINPGTQTAVSEWTTTTASLAFTAAATQKTSSPLTRSPLKSTHFLFLFLLELPLLLSMLGTVLWVNRPQRRS

SEQ ID NO: 8883 - protein, 233 aa, Artificial Sequence
  Description of Artificial Sequence: Synthetic coding sequence
MRLLVLLWGCLLLPGYEALEGPEEISGFEGDTVSLQCTYREELRDHRKYWCRKGGILFSRCSGTIYAEEEGQETMKGRVSIRDSRQELSLIVTLWNLTLQDAGEYWCGVEKRGPDESLLISLFVFPGSSRPPMQLDSTSAEDTSPALSSGSSKPRVSIPMVRILAPVLVLLSLLSAAGLIAFCSHLLLWRKEAQQATETQRNEKFCLSRLNHRTSELDPDEAFEISSLTFLSV

SEQ ID NO: 8884 - protein, 332 aa, Artificial Sequence
  Description of Artificial Sequence: Synthetic coding sequence
MRLLVLLWGCLLLPGYEALEGPEEISGFEGDTVSLQCTYREELRDHRKYWCRKGGILFSRCSGTIYAEEEGQETMKGRVSIRDSRQELSLIVTLWNLTLQDAGEYWCGVEKRGPDESLLISLFVFPGPCCPPSPSPTFQPLATTRLQPKAKAQQTQPPGLTSPGLYPAATTAKQGKTGAEAPPLPGTSQYGHERTSQYTGTSPHPATSPPAGSSRPPMQLDSTSAEDTSPALSSGSSKPRVSIPMVRILAPVLVLLSLLSAAGLIAFCSHLLLWRKEAQQATETQRNEKFCLSRLTAEEKEAPSQAPEGDVISMPPLHTSEEELGFSKFVSA

SEQ ID NO: 8885 - protein, 273 aa, Artificial Sequence
  Description of Artificial Sequence: Synthetic coding sequence
MRLLVLLWGCLLLPGYEALEGPEEISGFEGDTVSLQCTYREELRDHRKYWCRKGGILFSRCSGTIYAEEEGQETMKGRVSIRDSRQELSLIVTLWNLTLQDAGEYWCGVEKRGPDESLLISLFVFPASPGLYPAATTAKQGKTGAEAPPLPGTSQYGHERTSQYTGTSPHPATSPPAGSSRPPMQLDSTSAEDTSPALSSGSSKPRVSIPMVRILAPVLVLLSLLSAAGLIAFCSHLLLWRKEAQQATETQRNEKFCLSRLNSLMFSLSLPWL

SEQ ID NO: 8886 - protein, 307 aa, Artificial Sequence
  Description of Artificial Sequence: Synthetic coding sequence
MRLLVLLWGCLLLPGYEALEGPEEISGFEGDTVSLQCTYREELRDHRKYWCRKGGILFSRCSGTIYAEEEGQETMKGRVSIRDSRQELSLIVTLWNLTLQDAGEYWCGVEKRGPDESLLISLFVFPGPCCPPSPSPTFQPLATTRLQPKAKAQQTQPPGLTSPGLYPAATTAKQGKTGAEAPPLPGTSQYGHERTSQYTGTSPHPATSPPAGSSRPPMQLDSTSAEDTSPALSSGSSKPRVSIPMVRILAPVLVLLSLLSAAGLIAFCSHLLLWRKEAQQATETQRNEKFCLSRLNSLMFSLSLPWL

SEQ ID NO: 8887 - protein, 186 aa, Artificial Sequence
  Description of Artificial Sequence: Synthetic coding sequence
MWLPWALLLLWVPASTSMTPASITAAKTSTITTAFPPVSSTTLFAVGATHSASIQEETEEVVNSQLPLLLSLLALLLLLLVGASLLAWRMFQKWIKAGDHSELSQNPKQAATQSELHYANLELLMWPLQEKPAPPREVEVEYSTVASPREELHYASVVFDSNTNRIAAQRPREEEPDSDYSVIRKT

SEQ ID NO: 8888 - protein, 299 aa, Artificial Sequence
  Description of Artificial Sequence: Synthetic coding sequence
MWLPWALLLLWVPGCFALSKCRTVAGPVGGSLSVQCPYEKEHRTLNKYWCRPPQIFLCDKIVETKGSAGKRNGRVSIRDSPANLSFTVTLENLTEEDAGTYWCGVDTPWLRDFHDPVVEVEVSVFPASTSMTPASITAAKTSTITTAFPPVSSTTLFAVGATHSASIQEETEEVVNSQLPLLLSLLALLLLLLVGASLLAWRMFQKWIKAGDHSELSQNPKQAATQSELHYANLELLMWPLQEKPAPPREVEVEYSTVASPREELHYASVVFDSNTNRIAAQRPREEEPDSDYSVIRKT

SEQ ID NO: 8889 - protein, 103 aa, Artificial Sequence
  Description of Artificial Sequence: Synthetic coding sequence
MWLPWALLLLWVPAGDHSELSQNPKQAATQSELHYANLELLMWPLQEKPAPPREVEVEYSTVASPREELHYASVVFDSNTNRIAAQRPREEEPDSDYSVIRKT

SEQ ID NO: 8890 - protein, 150 aa, Artificial Sequence
  Description of Artificial Sequence: Synthetic coding sequence
MWLPWALLLLWVPASTSMTPASITAAKTSTITTAFPPVSSTTLFAVGATHSASIQEETEEVVNSQLPLLLSLLALLLLLLVGASLLAWRMFQKWIKAGDHSELSQNPKQASPREELHYASVVFDSNTNRIAAQRPREEEPDSDYSVIRKT

SEQ ID NO: 8891 - protein, 224 aa, Artificial Sequence
  Description of Artificial Sequence: Synthetic coding sequence
MTARAWASWRSSALLLLLVPGYFPLSHPMTVAGPVGGSLSVQCRYEKEHRTLNKFWCRPPQILRCDKIVETKGSAGKRNGRVSIRDSPANLSFTVTLENLTEEDAGTYWCGVDTPWLRDFHDPIVEVEVSVFPAGTTTASSPQSSMGTSGPPTKLPVHTWPSVTRKDSPEPSPHPGSLFSNVRFLLLVLLELPLLLSMLGAVLWVNRPQRSSRSRQNWPKGENQ

SEQ ID NO: 8892 - protein, 205 aa, Artificial Sequence
  Description of Artificial Sequence: Synthetic coding sequence
MWLLPALLLLCLSGCLSLKGPGSVTGTAGDSLTVWCQYESMYKGYNKYWCRGQYDTSCESIVETKGEEKVERNGRVSIRDHPEALAFTVTMQNLNEDDAGSYWCKIQTVWVLDSWSRDPSDLVRVYVSPAITTPRRTTHPATPPIFLVVNPGRNLSTGEVLTQNSGFRLSSPHFLLVVLLKLPLLLSMLGAVFWVNRPQWAPPGR

SEQ ID NO: 8893 - protein, 232 aa, Artificial Sequence
  Description of Artificial Sequence: Synthetic coding sequence
MTQAPLHILGFQLGPRFAEDGSQGDRNMWLLPALLLLCLSGCLSLKGPGSVTGTAGDSLTVWCQYESMYKGYNKYWCRGQYDTSCESIVETKGEEKVERNGRVSIRDHPEALAFTVTMQNLNEDDAGSYWCKIQTVWVLDSWSRDPSDLVRVYVSPAITTPRRTTHPATPPIFLVVNPGRNLSTGEVLTQNSGFRLSSPHFLLVVLLKLPLLLSMLGAVFWVNRPQWAPPGR

SEQ ID NO: 8894 - protein, 122 aa, Artificial Sequence
  Description of Artificial Sequence: Synthetic coding sequence
MCHLQEEAGGRWKGGGCLSLKGPGSVTGTAGDSLTVWCQYESMYKGYNKYWCRGQYDTSCESIVETKGEEKVERNGRVSIRDHPEALAFTVTMQNLNEDDAGSYWCKIQTVWVLDSWSRDPS

SEQ ID NO: 8895 - protein, 246 aa, Artificial Sequence [sequence omitted]

SEQ ID NO: 8896 - protein, 99 aa, Artificial Sequence
  Description of Artificial Sequence: Synthetic coding sequence
MGCDRNCGLIAGAVIGAVLAVFGGILMPVGDLLIQKTIKKQVVLEEGTIAFKNWVKTGTEVYRQFWIFDVQNPQEVMMNSSCIPYLSKSICSNDPQFTY

SEQ ID NO: 8897 - protein, 61 aa, Artificial Sequence
  Description of Artificial Sequence: Synthetic coding sequence
MKRFLFLLLTISLLVMVQIQTGLSGQNDTSQTSSPSASSNISGGIFLFFVANAIIHLFCFS

SEQ ID NO: 8898 - protein, 345 aa, Artificial Sequence
  Description of Artificial Sequence: Synthetic coding sequence
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQGRIFPEGSCLNTFTKNPYAASKKTIYTYIMASRNTQPAESRIYDEILQSKVLPSKEEPVNTVYSEVQFADKMGKASTQDSKPPGTSSYEIVI

SEQ ID NO: 8899 - protein, 280 aa, Artificial Sequence
  Description of Artificial Sequence: Synthetic coding sequence
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQGRIFPEGKMWKLTFSPPGTEAIYPRFS

SEQ ID NO: 8900 - protein, 241 aa, Artificial Sequence
  Description of Artificial Sequence: Synthetic coding sequence
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCAGNQLCPSLLVSLRDHSEELQGLNVGHIL

SEQ ID NO: 8901 - protein, 339 aa, Artificial Sequence
  Description of Artificial Sequence: Synthetic coding sequence
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQGSCLNTFTKNPYAASKKTIYTYIMASRNTQPAESRIYDEILQSKVLPSKEEPVNTVYSEVQFADKMGKASTQDSKPPGTSSYEIVI

SEQ ID NO: 8902 - protein, 272 aa, Artificial Sequence
  Description of Artificial Sequence: Synthetic coding sequence
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQGASLQGRASEHSLFRSAVC

SEQ ID NO: 8903 - protein, 328 aa, Artificial Sequence
  Description of Artificial Sequence: Synthetic coding sequence
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQDAASKKTIYTYIMASRNTQPAESRIYDEILQSKVLPSKEEPVNTVYSEVQFADKMGKASTQDSKPPGTSSYEIVI

SEQ ID NO: 8904 - protein, 214 aa, Artificial Sequence
  Description of Artificial Sequence: Synthetic coding sequence
MAQHHLWILLLCLQTCRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQDAASKKTIYTYIMASRNTQPAESRIYDEILQSKVLPSKEEPVNTVYSEVQFADKMGKASTQDSKPPGTSSYEIVI

SEQ ID NO: 8905 - protein, 652 aa, Artificial Sequence
  Description of Artificial Sequence: Synthetic coding sequence
MATSMGLLLLLLLLLTQPGAGTGADTEAVVCVGTACYTAHSGKLSAAEAQNHCNQNGGNLATVKSKEEAQHVQRVLAQLLRREAALTARMSKFWIGLQREKGKCLDPSLPLKGFSWVGGGEDTPYSNWHKELRNSCISKRCVSLLLDLSQPLLPSRLPKWSEGPCGSPGSPGSNIEGFVCKFSFKGMCRPLALGGPGQVTYTTPFQTTSSSLEAVPFASAANVACGEGDKDETQSHYFLCKEKAPDVFDWGSSGPLCVSPKYGCNFNNGGCHQDCFEGGDGSFLCGCRPGFRLLDDLVTCASRNPCSSSPCRGGATCVLGPHGKNYTCRCPQGYQLDSSQLDCVDVDECQDSPCAQECVNTPGGFRCECWVGYEPGGPGEGACQDVDECALGRSPCAQGCTNTDGSFHCSCEEGYVLAGEDGTQCQDVDECVGPGGPLCDSLCFNTQGSFHCGCLPGWVLAPNGVSCTMGPVSLGPPSGPPDEEDKGEKEGSTVPRAATASPTRGPEGTPKATPTTSRPSLSSDAPITSAPLKMLAPSGSPGVWREPSIHHATAASGPQEPAGGDSSVATQNNDGTDGQKLLLFYILGTVVAILLLLALALGLLVYRKRRAKREEKKEKKPQNAADSYSWVPERAESRAMENQYSPTPGTDC

SEQ ID NO: 8906 - protein, 347 aa, Artificial Sequence
  Description of Artificial Sequence: Synthetic coding sequence
MATSMGLLLLLLLLLTQPGAGTGADTEAVVCVGTACYTAHSGKLSAAEAQNHCNQNGGNLATVKSKEEAQHVQRVLAQLLRREAALTARMSKFWIGLQREKGKCLDPSLPLKGFSWVGGGEDTPYSNWHKELRNSCISKRCVSLLLDLSQPLLPSRLPKWSEGPCGSPGSPGSNIEGFVCKFSFKGMCRPLALGGPGQVTYTTPFQTTSSSLEAVPFASAANVACGEGDKDETQSHYFLCKEKAPDVFDWGSSGPLCVSPKYGCNFNNGGCHQDCFEGGDGSFLCGCRPGFRLLDDLVTCASRNPCSSSPCRGGATGLSQAESEEGGEEGEEAPECGRQLLLGSRAS

SEQ ID NO: 8907 - protein, 148 aa, Artificial Sequence
  Description of Artificial Sequence: Synthetic coding sequence
MPVLKQLGPAQPKKRPDRGALSISAPLGDFRHTLHVGRGGDAFGDTSFLSRHGGGPPPEPRAPPAGAPRSPPPPAVPQSAAPSPADPLLSFHLDLGPSMLDAVLGVMDAARPEAAAAKPDAEPRPGTQPPQARCRPNADLELNDVIGL

SEQ ID NO: 8908 - protein, 79 aa, Artificial Sequence
  Description of Artificial Sequence: Synthetic coding sequence
MSEFWHKLGCCVVEKPQPKKKRRRIDRTMIGEPMNFVHLTHIGSGEMGAGDGLAMTGAVQEQMRSKGNRDRPWSNSRGL

SEQ ID NO: 8909 - protein, 79 aa, Artificial Sequence; identical to SEQ ID NO: 8908
  Description of Artificial Sequence: Synthetic coding sequence

SEQ ID NO: 8910 - protein, 84 aa, Artificial Sequence
  Description of Artificial Sequence: Synthetic coding sequence
MSEFWLCFNCCIAEQPQPKRRRRIDRSMIGEPTNFVHTAHVGSGDLFSGMNSVSSIQNQMQSKGGYGGGMPANVQMQLVDTKAG

SEQ ID NO: 8911 - protein, 84 aa, Artificial Sequence; identical to SEQ ID NO: 8910
  Description of Artificial Sequence: Synthetic coding sequence

SEQ ID NO: 8912 - protein, 84 aa, Artificial Sequence; identical to SEQ ID NO: 8910
  Description of Artificial Sequence: Synthetic coding sequence

SEQ ID NO: 8913 - protein, 213 aa, Artificial Sequence
  Description of Artificial Sequence: Synthetic coding sequence
MPDENIFLFVPNLIGYARIVFAIISFYFMPCCPLTASSFYLLSGLLDAFDGHAARALNQGTRFGAMLDMLTDRCSTMCLLVNLALLYPGATLFFQISMSLDVASHWLHLHSSVVRGSESHKMIDLSGNPVLRIYYTSRPALFTLCAGNELFYCLLYLFHFSEGPLVGSVGLFRMGLWVTAPIALLKSLISVIHLITAARNMAALDAADRAKKK

SEQ ID NO: 8914 - protein, 182 aa, Artificial Sequence
  Description of Artificial Sequence: Synthetic coding sequence
MLPTAAGFSIWGQPGAAREAPRCQTKISSCSCPTSSVSAAHGPGPNERARGLGGLPDPALSPRVPFQGYARIVFAIISFYFMPCCPLTASSFYLLSGLLDAFDGHAARALNQGTRFGAMLDMLTDRCSTMCLLVNLALLYPGATLFFQISMSLDVASHWLHLHRSAAILGAWATWRHYSGVG

SEQ ID NO: 8915 - protein, 404 aa, Artificial Sequence
  Description of Artificial Sequence: Synthetic coding sequence
MIWKRSAVLRFYSVCGLLLQAAASKNKVKGSQGQFPLTQNVTVVEGGTAILTCRVDQNDNTSLQWSNPAQQTLYFDDKKALRDNRIELVRASWHELSISVSDVSLSDEGQYTCSLFTMPVKTSKAYLTVLGVPEKPQISGFSSPVMEGDLMQLTCKTSGSKPAADIRWFKNDKEIKDVKYLKEEDANRKTFTVSSTLDFRVDRSDDGVAVICRVDHESLNATPQVAMQVLEIHYTPSVKIIPSTPFPQEGQPLILTCESKGKPLPEPVLWTKDGGELPDPDRMVVSGRELNILFLNKTDNGTYRCEATNTIGQSSAEYVLIVHDPNALAGQNGPDHALIGGIVAVVVFVTLCSIFLLGRYLARHKGTYLTNEAKGAEDAPDADTAIINAEGSQVNAEEKKEYFI

SEQ ID NO: 8916 - protein, 437 aa, Artificial Sequence
  Description of Artificial Sequence: Synthetic coding sequence
MFVLFLCNLSLVPAAASKNKVKGSQGQFPLTQNVTVVEGGTAILTCRVDQNDNTSLQWSNPAQQTLYFDDKKALRDNRIELVRASWHELSISVSDVSLSDEGQYTCSLFTMPVKTSKAYLTVLGVPEKPQISGFSSPVMEGDLMQLTCKTSGSKPAADIRWFKNDKEIKDVKYLKEEDANRKTFTVSSTLDFRVDRSDDGVAVICRVDHESLNATPQVAMQVLEIHYTPSVKIIPSTPFPQEGQPLILTCESKGKPLPEPVLWTKDGGELPDPDRMVVSGRELNILFLNKTDNGTYRCEATNTIGQSSAEYVLIVHDVPNTLLPTTIIPSLTTATVTTTVAITTSPTTSATTSSIRDPNALAGQNGPDHALIGGIVAVVVFVTLCSIFLLGRYLARHKGTYLTNEAKGAEDAPDADTAIINAEGSQVNAEEKKEYFI

SEQ ID NO: 8917 - protein, 435 aa, Artificial Sequence
  Description of Artificial Sequence: Synthetic coding sequence
MIWKRSAVLRFYSVCGLLLQGSQGQFPLTQNVTVVEGGTAILTCRVDQNDNTSLQWSNPAQQTLYFDDKKALRDNRIELVRASWHELSISVSDVSLSDEGQYTCSLFTMPVKTSKAYLTVLGVPEKPQISGFSSPVMEGDLMQLTCKTSGSKPAADIRWFKNDKEIKDVKYLKEEDANRKTFTVSSTLDFRVDRSDDGVAVICRVDHESLNATPQVAMQVLEIHYTPSVKIIPSTPFPQEGQPLILTCESKGKPLPEPVLWTKDGGELPDPDRMVVSGRELNILFLNKTDNGTYRCEATNTIGQSSAEYVLIVHDVPNTLLPTTIIPSLTTATVTTTVAITTSPTTSATTSSIRDPNALAGQNGPDHALIGGIVAVVVFVTLCSIFLLGRYLARHKGTYLTNEAKGAEDAPDADTAIINAEGSQVNAEEKKEYFI

SEQ ID NO: 8918 - protein, 432 aa, Artificial Sequence
  Description of Artificial Sequence: Synthetic coding sequence
MGAPAASLLLLLLLFACCWAPGGANLSQDGYWQEQDLELGTLAPLDEAISSTVWSSPDMLASQDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNGKTFTVSSSVTFQVTREDDGASIVCSVNHESLKGADRSTSQRIEVLYTPTAMIRPDPPHPREGQKLLLHCEGRGNPVPQQYLWEKEGSVPPLKMTQESALIFPFLNKSDSGTYGCTATSNMGSYKAYYTLNVNDPSPVPSSSSTYHAIIGGIVAFIVFLLLIMLIFLGHYLIRHKGTYLTHEAKGSDDAPDADTAIINAEGGQSGGDDKKEYFI

SEQ ID NO: 8919 - protein, 398 aa, Artificial Sequence
  Description of Artificial Sequence: Synthetic coding sequence
MGAPAASLLLLLLLFACCWAPGGANLSQDDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNGKTFTVSSSVTFQVTREDDGASIVCSVNHESLKGADRSTSQRIEVLYTPTAMIRPDPPHPREGQKLLLHCEGRGNPVPQQYLWEKEGSVPPLKMTQESALIFPFLNKSDSGTYGCTATSNMGSYKAYYTLNVNDPSPVPSSSSTYHAIIGGIVAFIVFLLLIMLIFLGHYLIRHKGTYLTHEAKGSDDAPDADTAIINAEGGQSGGDDKKEYFI

SEQ ID NO: 8920 - protein, 234 aa, Artificial Sequence
  Description of Artificial Sequence: Synthetic coding sequence
MGAPAASLLLLLLLFACCWAPGGANLSQDDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNDTPTAMIRPDPPHPREGQKLLLHCEGRGNPVPQQYLWEKEGSVPPLKMTQ

SEQ ID NO: 8921 - protein, 709 aa, Artificial Sequence
  Description of Artificial Sequence: Synthetic coding sequence
MPSATSHSGSGSKSSGPPPPSGSSGSEAAAGAGAAAPASQHPATGTGAVQTEAMKQILGVIDKKLRNLEKKKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEAASAPAVEDQVPEAEPEPAEEYTEQSEVESTEYVNRQFMAETQFTSGEKEQVDEWTVETVEVVNSLQQQPQAASPSVPEPHSLTPVAQADPLVRRQRVQDLMAQMQGPYNFIQDSMLDFENQTLDPAIVSAQPMNPTQNMDMPQLVCPPVHSESRLAQPNQVPVQPEATQVPLVSSTSEGYTASQPLYQPSHATEQRPQKEPIDQIQATISLNTDQTTASSSLPAASQPQVFQAGTSKPLHSSGINVNAAPFQSMQTVFNMNAPVPPVNEPETLKQQNQYQASYNQSFSSQPHQVEQTELQQEQLQTVVGTYHGSPDQSHQVTGNHQQPPQQNTGFPRSNQPYYNSRGVSRGGSRGARGLMNGYRGPANGFRGGYDGYRPSFSNTPNSGYTQSQFSAPRDYSGYQRDGYQQNFKRGSGQSGPRGAPRGRGGPPRPNRGMPQMNTQQVN

SEQ ID NO: 8922 - protein, 709 aa, Artificial Sequence; identical to SEQ ID NO: 8921
  Description of Artificial Sequence: Synthetic coding sequence

SEQ ID NO: 8923 - protein, 694 aa, Artificial Sequence
  Description of Artificial Sequence: Synthetic coding sequence
MPSATSHSGSGSKSSGPPPPSGSSGSEAAAGAGAAAPASQHPATGTGAVQTEAMKQILGVIDKKLRNLEKKKGKLDDYQERMNKGERLNQDQLDAVSKYQEVTNNLEFAKELQRSFMALSQDIQKTIKKTARREQLMREEAEQKRLKTVLELQYVLDKLGDDEVRTDLKQGLNGVPILSEEELSLLDEFYKLVDPERDMSLRLNEQYEHASIHLWDLLEGKEKPVCGTTYKVLKEIVERVFQSNYFDSTHNHQNGLCEEEEAASAPAVEDQVPEAEPEPAEEYTEQSEVESTEYVNRQFMAETQFTSGEKEQVDEWTVETVEVVNSLQQQPQAASPSVPEPHSLTPVAQADPLVRRQRVQDLMAQMQGPYNFIQDSMLDFENQTLDPAIVSAQPMNPTQNMDMPQLVCPPVHSESRLAQPNQVPVQPEATQVPLVSSTSEGYTASQPLYQPSHATEQRPQKEPIDQIQATISLNTDQTTASSSLPAASQPQVFQAGTSKPLHSSGINVNAAPFQSMQTVFNMNAPVPPVNEPETLKQQNQYQASYNQSFSSQPHQVEQTELQQEQLQTVVGTYHGSPDQSHQVTGNHQQPPQQNTGFPRSNQPYYNSRGVSRGGSRGARGLMNGYRGPANGFRGGYDGYRPSFSNTPNSGYTQSQFSAPRDYSGYQRDGYQQNFKRGSGQSGPRGAPRGNILWW

SEQ ID NO: 8924 - protein, 757 aa, Artificial Sequence
  Description of Artificial Sequence: Synthetic coding sequence
MSENSSDSDSSCGWTVISHEGSDIEMLNSVTPTDSCEPAPECSSLEQEELQALQIEQGESSQNGTVLMEETAYPALEETSSTIEAEEQKIPEDSIYIGTASDDSDIVTLEPPKLEEIGNQEVVIVEEAQSSEDFNMGSSSSSQYTFCQPETVFSSQPSDDESSSDETSNQPSPAFRRRRARKKTVSASESEDRLVAEQETEPSKELSKRQFSSGLNKCVILALVIAISMGFGHFYGTIQIQKRQQLVRKIHEDELNDMKDYLSQCQQEQESFIDYKSLKENLARCWTLTEAEKMSFETQKTNLATENQYLRVSLEKEEKALSSLQEELNKLREQIRILEDKGTSTELVKENQKLKQHLEEEKQKKHSFLSQRETLLTEAKMLKRELERERLVTTALRGELQQLSGSQLHGKSDSPNVYTEKKEIAILRERLTELERKLTFEQQRSDLWERLYVEAKDQNGKQGTDGKKKGGRGSHRAKNKSKETFLGSVKETFDAMKNSTKEFVRHHKEKIKQAKEAVKENLKKFSDSVKSTFRHFKDTTKNIFDEKGNKRFGATKEAAEKPRTVFSDYLHPQYKAPTENHHNRGPTMQNDGRKEKPVHFKEFRKNTNSKKCSPGHDCRENSHSFRKACSGVFDCAQQESMSLFNTVVNPIRMDEFRQIIQRYMLKELDTFCHWNELDQFINKFFLNGVFIHDQKLFTDFVNDVKDYLRNMKEYEVDNDGVFEKLDEYIYRHFFGHTFSPPYGPRSVYIKPCHYSSL

SEQ ID NO: 8925 - protein, 424 aa, Artificial Sequence
  Description of Artificial Sequence: Synthetic coding sequence
MSENSSDSDSSCGWTVISHEGSDIEMLNSVTPTDSCEPAPECSSLEQEELQALQIEQGESSQNGTVLMEETAYPALEETSSTIEAEEQKIPEDSIYIGTASDDSDIVTLEPPKLEEIGNQEVVIVEEAQSSEDFNMGSSSSSQYTFCQPETVFSSQPSDDESSSDETSNQPSPAFRRRRARKKTVSASESEDRLVAEQETEPSKELSKRQFSSGLNKCVILALVIAISMGFGHFYGTIQIQKRQQLVRKIHEDELNDMKDYLSQCQQEQESFIDYKSLKENLARCWTLTEAEKMSFETQKTNLATENQYLRKLFTDFVNDVKDYLRNMKEYEVDNDGVFEKLDEYIYRHFFGHTFSPPYGPSRPDKKQRMVNIENSRHRKQEQKHLQPQPYKREGKWHKYGRTNGRQMANLEIELGQLPFDPQY

SEQ ID NO: 8926 - protein, 807 aa, Artificial Sequence
  Description of Artificial Sequence: Synthetic coding sequence
MSENSSDSDSSCGWTVISHEGSDIEMLNSVTPTDSCEPAPECSSLEQEELQALQIEQGESSQNGTVLMEETAYPALEETSSTIEAEEQKIPEDSIYIGTASDDSDIVTLEPPKLEEIGNQEVVIVEEAQSSEDFNMGSSSSSQYTFCQPETVFSSQPSDDESSSDETSNQPSPAFRRRRARKKTVSASESEDRLVAEQETEPSKELSKRQFSSGLNKCVILALVIAISMGFGHFYGTIQIQKRQQLVRKIHEDELNDMKDYLSQCQQEQESFIDYKSLKENLARCWTLTEAEKMSFETQKTNLATENQYLRVSLEKEEKALSSLQEELNKLREQIRILEDKGTSTELVKENQKLKQHLEEEKQKKHSFLSQRETLLTEAKMLKRELERERLVTTALRGELQQLSGSQLHGKSDSPNVYTEKKEIAILRERLTELERKLTFEQQRSDLWERLYVEAKDQNGKQGTDGKKKGGRGSHRAKNKSKETFLGSVKETFDAMKNSTKEFVRHHKEKIKQAKEAVKENLKKFSDSVKSTFRHFKDTTKNIFDEKGNKRFGATKEAAEKPRTVFSDYLHPQYKAPTENHHNRGPTMQNDGRKEKPVHFKEFRKNTNSKKCSPGHDCRENSHSFRKACSGVFDCAQQESMSLFNTVVNPIRMDEFRQIIQRYMLKELDTFCHWNELDQFINKFFLNGVFIHDQKLFTDFVNDVKDYLRNMKEYEVDNDGVFEKLDEYIYRHFFGHTFSPPYGPSRPDKKQRMVNIENSRHRKQEQKHLQPQPYKREGKWHKYGRTNGRQMANLEIELGQLPFDPQY

SEQ ID NO: 8927 - protein, 238 aa, Artificial Sequence
  Description of Artificial Sequence: Synthetic coding sequence
MEYAMKSLSLLYPKSLSRHVSVRTSVVTQQLLSEPSPKAPRARPCRVSTADRSVRKGIMAYSLEDLLLKVRDTLMLADKPFFLVLEEDGTTVETEEYFQALAGDTVFMVLQKGQKWQPPSEQGTRHPLSLSHKPAKKIDVARVTFDLYKLNPQDFIGCLNVKATFYDTYSLSYDLHCCGAKRIMKEAFRWALFSMQATGHVLLGTSCYLQQLLDATEEGQPPKGKASSLIPTCLKILQ

SEQ ID NO: 8928 - protein, 133 aa, Artificial Sequence
  Description of Artificial Sequence: Synthetic coding sequence
MEYAMKSLSLLYPKSLSRHVSVRTSVVTQQLLSEPSPKAPRARPCRVSTADRSVRKGIMAYSLEDLLLKGSFPLGPLQHAGHRPRTAWHLLLPAAAPRCYGGRAAPQGQGLIPYPDLSEDTAVKAQVLGSFPQ

SEQ ID NO: 8929 - protein, 164 aa, Artificial Sequence
  Description of Artificial Sequence: Synthetic coding sequence
MLADKPFFLVLEEDGTTVETEEYFQALAGDTVFMVLQKGQKWQPPSEQGTRHPLSLSHKPAKKIDVARVTFDLYKLNPQDFIGCLNVKATFYDTYSLSYDLHCCGAKRIMKEAFRWALFSMQATGHVLLGTSCYLQQLLDATEEGQPPKGKASSLIPTCLKILQ

SEQ ID NO: 8930 - protein, 164 aa, Artificial Sequence; identical to SEQ ID NO: 8929
  Description of Artificial Sequence: Synthetic coding sequence

SEQ ID NO: 8931 - protein, 248 aa, Artificial Sequence
  Description of Artificial Sequence: Synthetic coding sequence
MEYAMKSLSLLYPKSLSRHVSVRTSVVTQQLLSEPSPKAPRARPCRVSTADRSVRKGIMAYSLEDLLLKTRNPEARSQEVRDTLMLADKPFFLVLEEDGTTVETEEYFQALAGDTVFMVLQKGQKWQPPSEQGTRHPLSLSHKPAKKIDVARVTFDLYKLNPQDFIGCLNVKATFYDTYSLSYDLHCCGAKRIMKEAFRWALFSMQATGHVLLGTSCYLQQLLDATEEGQPPKGKASSLIPTCLKILQ

SEQ ID NO: 8932 - protein, 699 aa, Artificial Sequence
  Description of Artificial Sequence: Synthetic coding sequence
MPSLWREILLESLLGCVSWSLYHDLGPMIYYFPLQTLELTGLEGFSIAFLSPIFLTITPFWKLVNKKWMLTLLRIITIGSIASFQAPNAKLRLMVLALGVSSSLIVQAVTWWSGSHLQRYLRIWGFILGQIVLVVLRIWYTSLNPIWSYQMSNKVILTLSAIATLDRIGTDGDCSKPEEKKTGEVATGMASRPNWLLAGAAFGSLVFLTHWVFGEVSLVSRWAVSGHPHPGPDPNPFGGAVLLCLASGLMLPSCLWFRGTGLIWWVTGTASAAGLLYLHTWAAAVSGCVFAIFTASMWPQTLGHLINSGTNPGKTMTIAMIFYLLEIFFCAWCTAFKFVPGGVYARERSDVLLGTMMLIIGLNMLFGPKKNLDLLLQTKNSSKVLFRKSEKYMKLFLWLLVGVGLLGLGLRHKAYERKLGKVAPTKEVSAAIWPFRFGYDNEGWSSLERSAHLLNETGADFITILESDASKPYMGNNDLTMWLGEKLGFYTDFGPSTRYHTWGIMALSRYPIVKSEHHLLPSPEGEIAPAITLTVNISGKLVDFVVTHFGNHEDDLDRKLQAIAVSKLLKSSSNQVIFLGYITSAPGSRDYLQLTEHGNVKDIDSTDHDRWCEYIMYRGLIRLGYARISHAELSDSEIQMAKFRIPDDPTNYRDNQKVVIDHREVSEKIHFNPRFGSYKEGHNYENNHHFHMNTPKYFL

SEQ ID NO: 8933 - protein, 167 aa, Artificial Sequence
  Description of Artificial Sequence: Synthetic coding sequence
MSLALRSELVVDKTKRKKRRELSEEQKQEIKDAFELFDTDKDEAIDYHELKVAMRALGFDVKKADVLKILKDYDREATGKITFEDFNEVVTDWILERDPHEEILKAFKLFDDDDSGKISLRNLRRVARELGENMSDEELRAMIEEFDKDGDGEINQEEFIAIMTGDI

SEQ ID NO: 8934 - protein, 537 aa, Artificial Sequence
  Description of Artificial Sequence: Synthetic coding sequence
MGATGAAEPLQSVLWVKQQRCAVSLEPARALLRWWRSPGPGAGAPGADACSVPVSEIIAVEETDVHGKHQGSGKWQKMEKPYAFTVHCVKRARRHRWKWAQVTFWCPEEQLCHLWLQTLREMLEKLTSRPKHLLVFINPFGGKGQGKRIYERKVAPLFTLASITTDIIVTEHANQAKETLYEINIDKYDGIVCVGGDGMFSEVLHGLIGRTQRSAGVDQNHPRAVLVPSSLRIGIIPAGSTDCVCYSTVGTSDAETSALHIVVGDSLAMDVSSVHHNSTLLRYSVSLLGYGFYGDIIKDSEKKRWLGLARYDFSGLKTFLSHHCYEGTVSFLPAQHTVGSPRDRKPCRAGCFVCRQSKQQLEEEQKKALYGLEAAEDVEEWQVVCGKFLAINATNMSCACRRSPRGLSPAAHLGDGSSDLILIRKCSRFNFLRFLIRHTNQQDQFDFTFVEVYRVKKFQFTSKHMEDEDSDLKEGGKKRFGHICSSHPSCCCTVSNSSWNCDGEVLHSPAIEVRVHCQLVRLFARGIEENPKPDSHS

SEQ ID NO: 8935 - protein, 339 aa, Artificial Sequence
  Description of Artificial Sequence: Synthetic coding sequence
MFSEVLHGLIGRTQRSAGVDQNHPRAVLVPSSLRIGIIPAGSTDCVCYSTVGTSDAETSALHIVVGDSLAMDVSSVHHNSTLLRYSVSLLGYGFYGDIIKDSEKKRWLGLARYDFSGLKTFLSHHCYEGTVSFLPAQHTVGSPRDRKPCRAGCFVCRQSKQQLEEEQKKALYGLEAAEDVEEWQVVCGKFLAINATNMSCACRRSPRGLSPAAHLGDGSSDLILIRKCSRFNFLRFLIRHTNQQDQFDFTFVEVYRVKKFQFTSKHMEDEDSDLKEGGKKRFGHICSSHPSCCCTVSNSSWNCDGEVLHSPAIEVRVHCQLVRLFARGIEENPKPDSHS

SEQ ID NO: 8936 - protein, 350 aa, Artificial Sequence
  Description of Artificial Sequence: Synthetic coding sequence
MAAAGPAAGPTGPEPMPSYAQLVQRGWGSALAAARGCTDCGWGLARRGLAEHAHLAPPELLLLALGALGWTALRSAATARLFRPLAKRCCLQPRDAAKMPESAWKFLFYLGSWSYSAYLLFGTDYPFFHDPPSVFYDWTPGMAVPRDIAAAYLLQGSFYGHSIYATLYMDTWRKDSVVMLLHHVVTLILIVSSYAFRYHNVGILVLFLHDISDVQLEFTKLNIYFKSRGGSYHRLHALAADLGCLSFGFSWFWFRLYWFPLKVLYATSHCSLRTVPDIPFYFFFNALLLLLTLMNLYWFLYIVAFAAKVLTGQVHELKDLREYDTAEAQSLKPSKAEKPLRNGLVKDKRF

SEQ ID NO: 8937 - protein, 337 aa, Artificial Sequence
  Description of Artificial Sequence: Synthetic coding sequence
MAAAGPAAGPTGPEPMPSYAQLVQRGWGSALAAARGCTDCGWGLARRGLAEHAHLAPPELLLLALGALGWTALRSAATARLFRPLAKRCCLQPRDAAKMPESAWKFLFYLGSWSYSAYLLFGTDYPFFHDPPSVFYDWTPGMAVPRDIAAAYLLQGSFYGHSIYATLYMDTWRKDSVVMLLHHVVTLILIVSSYAFRYHNVGILVLFLHDISDVQLEFTKLNIYFKSRGGSYHRLHALAADLGCLSFGFSWFWFRLYWFPLKVLYATSHCSLRTVPDIPFYFFFNALLLLLTLMNLYWFLYIVAFAAKVLTGQVHELKDLREYDTAEAQSLKPSKAE

SEQ ID NO: 8938 - protein, 239 aa, Artificial Sequence
  Description of Artificial Sequence: Synthetic coding sequence
MPESAWKFLFYLGSWSYSAYLLFGTDYPFFHDPPSVFYDWTPGMAVPRDIAAAYLLQGSFYGHSIYATLYMDTWRKDSVVMLLHHVVTLILIVSSYAFRYHNVGILVLFLHDISDVQLEFTKLNIYFKSRGGSYHRLHALAADLGCLSFGFSWFWFRLYWFPLKVLYATSHCSLRTVPDIPFYFFFNALLLLLTLMNLYWFLYIVAFAAKVLTGQVHELKDLREYDTAEAQSLKPSKAE

SEQ ID NO: 8939 - protein, 380 aa, Artificial Sequence
  Description of Artificial Sequence: Synthetic coding sequence
MLQTLYDYFWWERLWLPVNLTWADLEDRDGRVYAKASDLYITLPLALLFLIVRYFFELYVATPLAALLNIKEKTRLRAPPNATLEHFYLTSGKQPKQVEVELLSRQSGLSGRQVERWFRRRRNQDRPSLLKKFREASWRFTFYLIAFIAGMAVIVDKPWFYDMKKVWEGYPIQSTIPSQYWYYMIELSFYWSLLFSIASDVKRKDFKEQIIHHVATIILISFSWFANYIRAGTLIMALHDSSDYLLESAKMFNYAGWKNTCNNIFIVFAIVFIITRLVILPFWILHCTLVYPLELYPAFFGYYFFNSMMGVLQLLHIFWAYLILRMAHKFITGKLVEDERSDREETESSEGEEAAAGGGAKSRPLANGHPILNNNHRKND

SEQ ID NO: 8940 - protein, 230 aa, Artificial Sequence
  Description of Artificial Sequence: Synthetic coding sequence
MAVIVDKPWFYDMKKVWEGYPIQSTIPSQYWYYMIELSFYWSLLFSIASDVKRKDFKEQIIHHVATIILISFSWFANYIRAGTLIMALHDSSDYLLESAKMFNYAGWKNTCNNIFIVFAIVFIITRLVILPFWILHCTLVYPLELYPAFFGYYFFNSMMGVLQLLHIFWAYLILRMAHKFITGKLVEDERSDREETESSEGEEAAAGGGAKSRPLANGHPILNNNHRKND

SEQ ID NO: 8941 - protein, 249 aa, Artificial Sequence
  Description of Artificial Sequence: Synthetic coding sequence
MLQTLYDYFWWERLWLPVNLTWADLEDRDGRVYAKASDLYITLPLALLFLIVRYFFELYVATPLAALLNIKEKTRLRAPPNATLEHFYLTSGKQPKQVEVELLSRQSGLSGRQVERWFRRRRNQDRPSLLKKFREASWRFTFYLIAFIAGMAVIVDKPWFYDMKKVWEGYPIQSTIPSQYWYYMIELSFYWSLLFSIASDVKRKDFKEQIIHHVATIILISFSWFANYIRAGTLIMALHDSSDYLLEVR

SEQ ID NO: 8942 - protein, 324 aa, Artificial Sequence
  Description of Artificial Sequence: Synthetic coding sequence
MVPLALHFPGEVGLQETAVRMLQTLYDYFWWERLWLPVNLTWADLEDRDGRVYAKASDLYITLPLALLFLIVRYFFELYVATPLAALLNIKEKTRLRAPPNATLEHFYLTSGKQPKQVEVELLSRQSGLSGRQVERWFRRRRNQDRPSLLKKFREASWRFTFYLIAFIAGMAVIVDKPWFYDMKKVWEGYPIQSTIPSQYWYYMIELSFYWSLLFSIASDVKRKDFKEQIIHHVATIILISFSWFANYIRAGTLIMALHDSSDYLLESAKMFNYAGWKNTCNNIFIVFAIVFIITRLVILPFWILHCTLVYPLELYPAFFGYYF

SEQ ID NO: 8943 - protein, 380 aa, Artificial Sequence; identical to SEQ ID NO: 8939
  Description of Artificial Sequence: Synthetic coding sequence

SEQ ID NO: 8944 - protein, 192 aa, Artificial Sequence
  Description of Artificial Sequence: Synthetic coding sequence
MLQTLYDYFWWERLWLPVNLTWADLEDRDGRVYAKASDLYITLPLALLFLIVRYFFELYVATPLAALLNIKEKTRLRAPPNATLEHFYLTSGKQPKQVEVELLSRQSGLSGRQVERWFRRRRNQDRPSLLKKFREASWRFTFYLIAFIAGMAVIVDKPWFYDMKKVWEGYPIQSTIPSQYWYYMIELSFYWS

SEQ ID NO: 8945 - protein, 129 aa, Artificial Sequence
  Description of Artificial Sequence: Synthetic coding sequence
MLQTLYDYFWWERLWLPVNLTWADLEDRDGRVYAKASDLYITLPLALLFLIVRYFFELYVATPLAALLNIKEKTRLRAPPNATLEHFYLTSGKQPKQVEVELLSRQSGLSGRQVERWFRRRRNQDRPSL

SEQ ID NO: 8946 - protein, 223 aa, Artificial Sequence
  Description of Artificial Sequence: Synthetic coding sequence
MLQTLYDYFWWERLWLPVNLTWADLEDRDGRVYAKASDLYITLPLALLFLIVRYFFELYVATPLAALLNIKEKTRLRAPPNATLEHFYLTSGKQPKQVEVELLSRQSGLSGRQVERWFRRRRNQDRPSLLKKFREASWRFTFYLIAFIAGMAVIVDKPWFYDMKKVWEGYPIQSTIPSQYWYYMIELSFYWSLLFSIASDVKRKDFKEQIIHHVATIILISFS

SEQ ID NO: 8947 - protein, 383 aa, Artificial Sequence
  Description of Artificial Sequence: Synthetic coding sequence
MFWTFKEWFWLERFWLPPTIKWSDLEDHDGLVFVKPSHLYVTIPYAFLLLIIRRVFEKFVASPLAKSFGIKETVRKVTPNTVLENFFKHSTRQPLQTDIYGLAKKCNLTERQVERWFRSRRNQERPSRLKKFQEACWRFAFYLMITVAGIAFLYDKPWLYDLWEVWNGYPKQPLLPSQYWYYILEMSFYWSLLFRLGFDVKRKDFLAHIIHHLAAISLMSFSWCANYIRSGTLVMIVHDVADIWLESAKMFSYAGWTQTCNTLFFIFSTIFFISRLIVFPFWILYCTLILPMYHLEPFFSYIFLNLQLMILQVLHLYWGYYILKMLNRCIFMKSIQDVRSDDEDYEEEEEEEEEEATKGKEMDCLKNGLRAERHLIPNGQHGH

SEQ ID NO: 8948 - protein, 383 aa, Artificial Sequence; identical to SEQ ID NO: 8947
  Description of Artificial Sequence: Synthetic coding sequence

SEQ ID NO: 8949 - protein, 383 aa, Artificial Sequence; identical to SEQ ID NO: 8947
  Description of Artificial Sequence: Synthetic coding sequence

SEQ ID NO: 8950 - protein, 155 aa, Artificial Sequence
  Description of Artificial Sequence: Synthetic coding sequence
MFWTFKEWFWLERFWLPPTIKWSDLEDHDGLVFVKPSHLYVTIPYAFLLLIIRRVFEKFVASPLAKSFGIKETVRKVTPNTVLENFFKHSTRQPLQTDIYGLAKKCNLTERQVERWFRSRRNQERPSRLKKFQEACWRFAFYLMITVAGIAFLYD

SEQ ID NO: 8951 - protein, 15 aa, Artificial Sequence
  Description of Artificial Sequence: Synthetic coding sequence
MFWTFKEWFWLERFW

SEQ ID NO: 8952 - protein, 57 aa, Artificial Sequence
  Description of Artificial Sequence: Synthetic coding sequence
MFWTFKEWFWLERFWLPPTIKWSDLEDHDGLVFVKPSHLYVTIPYAFLLLIIRRVFE

SEQ ID NO: 8953 - protein, 394 aa, Artificial Sequence
  Description of Artificial Sequence: Synthetic coding sequence
MLSSFNEWFWQDRFWLPPNVTWTELEDRDGRVYPHPQDLLAALPLALVLLAMRLAFERFIGLPLSRWLGVRDQTRRQVKPNATLEKHFLTEGHRPKEPQLSLLAAQCGLTLQQTQRWFRRRRNQDRPQLTKKFCEASWRFLFYLSSFVGGLSVLYHESWLWAPVMCWDRYPNQTLKPSLYWWYLLELGFYLSLLIRLPFDVKRKDFKEQVIHHFVAVILMTFSYSANLLRIGSLVLLLHDSSDYLLEACKMVNYMQYQQVCDALFLIFSFVFFYTRLVLFPTQILYTTYYESISNRGPFFGYYFFNGLLMLLQLLHVFWSCLILRMLYSFMKKGQMEKDIRSDVEESDSSEEAAAAQEPLQLKNGAAGGPRPAPTDGPRSRVAGRLTNRHTTAT

SEQ ID NO: 8954 - protein, 113 aa, Artificial Sequence
  Description of Artificial Sequence: Synthetic coding sequence
MLSSFNEWFWQDRFWLPPNVTWTELEDRDGRVYPHPQDLLAALPLALVLLAMRLAFERFIGLPLSRWLGVRDQTRRQVKPNATLEKHFLTEGHRPKEPQLSLLAAQCGLTLQQ

SEQ ID NO: 8955 - protein, 192 aa, Artificial Sequence
  Description of Artificial Sequence: Synthetic coding sequence
MLSSFNEWFWQDRFWLPPNVTWTELEDRDGRVYPHPQDLLAALPLALVLLAMRLAFERFIGLPLSRWLGVRDQTRRQVKPNATLEKHFLTEGHRPKEPQLSLLAAQCGLTLQQTQRWFRRRRNQDRPQLTKKFCEASWRFLFYLSSFVGGLSVLYHESWLWAPVMCWDRYPNQTLKPSLYWWYLLELGFYLS

SEQ ID NO: 8956 - protein, 394 aa, Artificial Sequence; identical to SEQ ID NO: 8953
  Description of Artificial Sequence: Synthetic coding sequence

SEQ ID NO: 8957 - protein, 32 aa, Artificial Sequence
  Description of Artificial Sequence: Synthetic coding sequence
MLSSFNEWFWQDRFWLPPNVTWTELEDRDGRV

SEQ ID NO: 8958 - protein, 92 aa, Artificial Sequence
  Description of Artificial Sequence: Synthetic coding sequence
MLSSFNEWFWQDRFWLPPNVTWTELEDRDGRVYPHPQDLLAALPLALVLLAMRLAFERFIGLPLSRWLGVRDQTRRQVKPNATLEKHFLTEG

SEQ ID NO: 8959 - protein, 392 aa, Artificial Sequence
  Description of Artificial Sequence: Synthetic coding sequence
MATAAQGPLSLLWGWLWSERFWLPENVSWADLEGPADGYGYPRGRHILSVFPLAAGIFFVRLLFERFIAKPCALCIGIEDSGPYQAQPNAILEKVFISITKYPDKKRLEGLSKQLDWNVRKIQCWFRHRRNQDKPPTLTKFCESMWRFTFYLCIFCYGIRFLWSSPWFWDIRQCWHNYPFQPLSSGLYHYYIMELAFYWSLMFSQFTDIKRKDFLIMFVHHLVTIGLISFSYINNMVRVGTLIMCLHDVSDFLLEAAKLANYAKYQRLCDTLFVIFSAVFMVTRLGIYPFWILNTTLFESWEIIGPYASWWLLNGLLLTLQLLHVIWSYLIARIALKALIRGKVSKDDRSDVESSSEEEDVTTCTKSPCDSSSSNGANRVNGHMGGSYWAEE

SEQ ID NO: 8960 - protein, 195 aa, Artificial Sequence
  Description of Artificial Sequence: Synthetic coding sequence
MATAAQGPLSLLWGWLWSERFWLPENVSWADLEGPADGYGYPRGRHILSVFPLAAGIFFVRLLFERFIAKPCALCIGIEDSGPYQAQPNAILEKVFISITKYPDKKRLEGLSKQLDWNVRKIQCWFRHRRNQDKPPTLTKFCESIHLGSGTSDSAGITIHFSLFQVGFITIISWNWPSIGPLCFLSLQTLKERTS

SEQ ID NO: 8961 - protein, 334 aa, Artificial Sequence
  Description of Artificial Sequence: Synthetic coding sequence
MMKPRPKRFIAKPCALCIGIEDSGPYQAQPNAILEKVFISITKYPDKKRLEGLSKQLDWNVRKIQCWFRHRRNQDKPPTLTKFCESMWRFTFYLCIFCYGIRFLWSSPWFWDIRQCWHNYPFQPLSSGLYHYYIMELAFYWSLMFSQFTDIKRKDFLIMFVHHLVTIGLISFSYINNMVRVGTLIMCLHDVSDFLLEAAKLANYAKYQRLCDTLFVIFSAVFMVTRLGIYPFWILNTTLFESWEIIGPYASWWLLNGLLLTLQLLHVIWSYLIARIALKALIRGKVSKDDRSDVESSSEEEDVTTCTKSPCDSSSSNGANRVNGHMGGSYWAEE

SEQ ID NO: 8962 - protein, 195 aa, Artificial Sequence; identical to SEQ ID NO: 8960
  Description of Artificial Sequence: Synthetic coding sequence

SEQ ID NO: 8963 - protein, 384 aa, Artificial Sequence
  Description of Artificial Sequence: Synthetic coding sequence
MAGILAWFWNERFWLPHNVTWADLKNTEEATFPQAEDLYLAFPLAFCIFMVRLIFERFVAKPCAIALNIQANGPQIAPPNAILEKVFTAITKHPDEKRLEGLSKQLDWDVRSIQRWFRQRRNQEKPSTLTRFCESMWRFSFYLYVFTYGVRFLKKTPWLWNTRHCWYNYPYQPLTTDLHYYYILELSFYWSLMFSQFTDIKRKDFGIMFLHHLVSIFLITFSYVNNMARVGTLVLCLHDSADALLEAAKMANYAKFQKMCDLLFVMFAVVFITTRLGIFPLWVLNTTLFESWEIVGPYPSWWVFNLLLLLVQGLNCFWSYLIVKIACKAVSRGKVSKDDRSDIESSSDEEDSEPPGKNPHTATTTNGTSGTNGYLLTGSCSMDD

SEQ ID NO: 8964 - protein, 392 aa, Artificial Sequence
  Description of Artificial Sequence: Synthetic coding sequence
MAGILAWFWNERFWLPHNVTWADLKNTEEATFPQAEDLYLAFPLAFCIFMVRLIFERFVAKPCAIALNIQANGPQIAPPNAILEKVFTAITKHPDEKRLEGLSKQLDWDVRSIQRWFRQRRNQEKPSTLTRFCESMWRFSFYLYVFTYGVRFLKKTPWLWNTRHCWYNYPYQPLTTDLHYYYILELSFYWSLMFSQFTDIKRKDFGIMFLHHLVSIFLITFSYVNNMARVGTLVLCLHDSADALLEAAKMANYAKFQKMCDLLFVMFAVVFITTRLGIFPLWVLNTTLFESWEIVGPYPSWWVFNLLLLLVQGLNCFWSYLIVKIACKAVSRGKAGKWNPLHVSKDDRSDIESSSDEEDSEPPGKNPHTATTTNGTSGTNGYLLTGSCSMDD

SEQ ID NO: 8965 - protein, 224 aa, Artificial Sequence
  Description of Artificial Sequence: Synthetic coding sequence
MQAPGRGPLGLRLMMPGRRGALREPGGCGSCLGVALALLLLLLPACCPVRAQNDTEPIVLEGKCLVVCDSSPSADGAVTSSLGISVRSGSAKVAFSATRSTNHEPSEMSNRTMTIYFDQVLVNIGNHFDLASSIFVAPRKGIYSFSFHVVKVYNRQTIQVSLMQNGYPVISAFAGDQDVTREAASNGVLLLMEREDKVHLKLERGNLMGGWKYSTFSGFLVFPL

SEQ ID NO: 8966 - protein, 595 aa, Artificial Sequence
  Description of Artificial Sequence: Synthetic coding sequence
MRAARAAPLLQLLLLLGPWLEAAGVAESPLPAVVLAILARNAEHSLPHYLGALERLDYPRARMALWCATDHNVDNTTEMLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGRLISWSGSQKTLRSPRLDLTGSSGHSLQPQPRDEL

SEQ ID NO: 8967 - protein, 517 aa, Artificial Sequence
  Description of Artificial Sequence: Synthetic coding sequence
MLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGRLISWSGSQKTLRSPRLDLTGSSGHSLQPQPRDEL

SEQ ID NO: 8968 - protein, 79 aa, Artificial Sequence
  Description of Artificial Sequence: Synthetic coding sequence
MLQEWLAAVGDDYAAVVWRPEGEPRFYPDEEGPKHWTKERHQFLMELKQEALTFARNWGADYILFADTDNILTNNQTLR

SEQ ID NO: 8969 - protein, 548 aa, Artificial Sequence
  Description of Artificial Sequence: Synthetic coding sequence
MRAARAAPLLQLLLLLGPWLEAAGVAESPLPAVVLAILARNAEHSLPHYLGALERLDYPHEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALVDGPRMQASAHVTRPSKRPSKIGFDEVFVISLARRPDRRERMLASLWEMEISGRVVDAVDGWMLNSSAIRNLGVDLLPGYQDPYSGRTLTKGEVGCFLSHYSIWEEVVARGLARVLVFEDDVRFESNFRGRLERLMEDVEAEKLSWDLIYLGRKQVNPEKETAVEGLPGLVVAGYSYWTLAYALRLAGARKLLASQPLRRMLPVDEFLPIMFDQHPNEQYKAHFWPRDLVAFSAQPLLAAPTHYAGDAEWLSDTETSSPWDDDSGRLISWSGSQKTLRSPRLDLTGSSGHSLQPQPRDEL

SEQ ID NO: 8970 - protein, 64 aa, Artificial Sequence
  Description of Artificial Sequence: Synthetic coding sequence
MLQEWLAAVGDDYAAVVWRPEGEPRFYPDEEGPKHWTKERHQFLMELKQEALTFARNWGADYIL

SEQ ID NO: 8971 - protein, 218 aa, Artificial Sequence
  Description of Artificial Sequence: Synthetic coding sequence
MLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQGYYRRTAEYFPTKNRQRRGCFRVPMVHSTFLASLRAEGADQLAFYPPHPNYTWPFDDIIVFAYACQAAGVSVHVCNEHRYGYMNVPVKSHQGLEDERVNFIHLILEALG

SEQ ID NO: 8972 - protein, 109 aa, Artificial Sequence
  Description of Artificial Sequence: Synthetic coding sequence
MLQEWLAAVGDDYAAVVWRPEGEPRFYPDEEGPKHWTKERHQFLMELKQEALTFARNWGADYILFADTDNILTNNQTLRLLMGQGLPVVAPMLDSQTYYSNFWCGITPQ

SEQ ID NO: 8973 - protein, 115 aa, Artificial Sequence
  Description of Artificial Sequence: Synthetic coding sequence
MEVKDANSALLSNYETLKYISKTPCRHQSPEIVREFLTALKSHKLTKAEKLQLLNHRPVTAVEIQLMVEESEERLTEEQIEALLHTVTSILPAEPEAEQKKNTNSNVAMDEEDPA

SEQ ID NO: 8974 - protein, 148 aa, Artificial Sequence
  Description of Artificial Sequence: Synthetic coding sequence
MEVKDANSALLSNYEVFQLLTDLKEQRKESGKNKHSSGQQNLNTITYETLKYISKTPCRHQSPEIVREFLTALKSHKLTKAEKLQLLNHRPVTAVEIQLMVEESEERLTEEQIEALLHTVTSILPAEPEAEQKKNTNSNVAMDEEDPA

SEQ ID NO: 8975 - protein, 71 aa, Artificial Sequence
  Description of Artificial Sequence: Synthetic coding sequence
MEVAEKLQLLNHRPVTAVEIQLMVEESEERLTEEQIEALLHTVTSILPAEPEAEQKKNTNSNVAMDEEDPA

SEQ ID NO: 8976 - protein, 115 aa, Artificial Sequence
  Description of Artificial Sequence: Synthetic coding sequence
MEMKDANSALLSNYETLKYISKTPCRHQSPEIVREFLTALKSHKLTKAEKLQLLNHRPVTAVEIQLMVEESEERLTEEQIEALLHTVTSILPAEPEAEQKKNTNSNVAMDEEDPA

SEQ ID NO: 8977 - protein, 141 aa, Artificial Sequence
  Description of Artificial Sequence: Synthetic coding sequence
MQRGDPGEHLGARSWHLGAVGGGGDSCEVKDANSALLSNYETLKYISKTPCRHQSPEIVREFLTALKSHKLTKAEKLQLLNHRPVTAVEIQLMVEESEERLTEEQIEALLHTVTSILPAEPEAEQKKNTNSNVAMDEEDPA

SEQ ID NO: 8978 - protein, 233 aa, Artificial Sequence
  Description of Artificial Sequence: Synthetic coding sequence
MSKLGKFFKGGGSSKSRAAPSPQEALVRLRETEEMLGKKQEYLENRIQREIALAKKHGTQNKRAALQALKRKKRFEKQLTQIDGTLSTIEFQREALENSHTNTEVLRNMGFAAKAMKSVHENMDLNKIDDLMQEITEQQDIAQEISEAFSQRVGFGDDFDEDELMAELEELEQEELNKKMTNIRLPNVPSSSLPAQPNRKPGMSSTARRSRAASSQRAEEEDDDIKQLAAWAT

SEQ ID NO: 8979 - protein, 430 aa, Artificial Sequence
  Description of Artificial Sequence: Synthetic coding sequence
MLCSLLLCECLLLVAGYAHDDDWIDPTDMLNYDAASGTMRKSQAKYGISGEKDVSPDLSCADEISECYHKLDSLTYKIDECEKKKREDYESQSNPVFRRYLNKILIEAGKLGLLAFAQHQAEVAKMEPLNNVCAKKMDWTGSIWEWFRSSWTYKDDPCQKYYELLLVNPIWLVPPTKALAVTFTTFVTEPLKHIGKGTGEFIKALMKEIPALLHLPVLIIMALAILSFCYGAGKSVHVLRHIGGPESEPPQALRPRDRRRQEEIDYRPDGGAGDADFHYRGQMGPTEQGPYAKTYEGRREILRERDVDLRFQTGNKSPEVLRAFDVPDAEAREHPTVVPSHKSPVLDTKPKETGGILGEGTPKESSTESSQSAKPVSGQDTSGNTEGSPAAEKAQLKSEAAGSPDQGSTYSPARGVAGPRGQDPVSSPCG

SEQ ID NO: 8980 - protein, 366 aa, Artificial Sequence
  Description of Artificial Sequence: Synthetic coding sequence
MLCSLLLCECLLLVAGYAHDDDWIDPTDMLNYDAASGTMRKSQAKYGISGEKDVSPDLSCADEISECYHKLDSLTYKIDECEKKKREDYESQSNPVFRRYLNKILIEAGKLGLALAVTFTTFVTEPLKHIGKGTGEFIKALMKEIPALLHLPVLIIMALAILSFCYGAGKSVHVLRHIGGPESEPPQALRPRDRRRQEEIDYRPDGGAGDADFHYRGQMGPTEQGPYAKTYEGRREILRERDVDLRFQTGNKSPEVLRAFDVPDAEAREHPTVVPSHKSPVLDTKPKETGGILGEGTPKESSTESSQSAKPVSGQDTSGNTEGSPAAEKAQLKSEAAGSPDQGSTYSPARGVAGPRGQDPVSSPCG

SEQ ID NO: 8981 - protein, 551 aa, Artificial Sequence
  Description of Artificial Sequence: Synthetic coding sequence
MLCSLLLCECLLLVAGYAHDDDWIDPTDMLNYDAASGTMRKSQAKYGISGEKDVSPDLSCADEISECYHKLDSLTYKIDECEKKKREDYESQSNPVFRRYLNKILIEAGKLGLPDENKGDMHYDAEIILKRETLLEIQKFLNGEDWKPGALDDALSDILINFKFHDFETWKWRFEDSFGVDPYNVLMVLLCLLCIVVLVATELWTYVRWYTQLRRVLIISFLFSLGWNWMYLYKLAFAQHQAEVAKMEPLNNVCAKKMDWTGSIWEWFRSSWTYKDDPCQKYYELLLVNPIWLVPPTKALAVTFTTFVTEPLKHIGKGTGEFIKALMKEIPALLHLPVLIIMALAILSFCYGAGKSVHVLRHIGGPESEPPQALRPRDRRRQEEIDYRPDGGAGDADFHYRGQMGPTEQGPYAKTYEGRREILRERDVDLRFQTGNKSPEVLRAFDVPDAEAREHPTVVPSHKSPVLDTKPKETGGILGEGTPKESSTESSQSAKPVSGQDTSGNTEGSPAAEKAQLKSEAAGSPDQGSTYSPARGVAGPRGQDPVSSPCG

SEQ ID NO: 8982 - protein, 366 aa, Artificial Sequence; identical to SEQ ID NO: 8980
  Description of Artificial Sequence: Synthetic coding sequence

SEQ ID NO: 8983 - protein, 430 aa, Artificial Sequence; identical to SEQ ID NO: 8979
  Description of Artificial Sequence: Synthetic coding sequence

SEQ ID NO: 8984 - protein, 501 aa, Artificial Sequence
  Description of Artificial Sequence: Synthetic coding sequence
MLCSLLLCECLLLVAGYAHDDDWIDPTDMLNYDAASGTMRKSQAKYGISGEKDVSPDLSCADEISECYHKLDSLTYKIDECEKKKREDYESQSNPVFRRYLNKILIEAGKLGLFHDFETWKWRFEDSFGVDPYNVLMVLLCLLCIVVLVATELWTYVRWYTQLRRVLIISFLFSLGWNWMYLYKLAFAQHQAEVAKMEPLNNVCAKKMDWTGSIWEWFRSSWTYKDDPCQKYYELLLVNPIWLVPPTKALAVTFTTFVTEPLKHIGKGTGEFIKALMKEIPALLHLPVLIIMALAILSFCYGAGKSVHVLRHIGGPESEPPQALRPRDRRRQEEIDYRPDGGAGDADFHYRGQMGPTEQGPYAKTYEGRREILRERDVDLRFQTGNKSPEVLRAFDVPDAEAREHPTVVPSHKSPVLDTKPKETGGILGEGTPKESSTESSQSAKPVSGQDTSGNTEGSPAAEKAQLKSEAAGSPDQGSTYSPARGVAGPRGQDPVSSPCG

SEQ ID NO: 8985 - protein, 551 aa, Artificial Sequence; identical to SEQ ID NO: 8981
  Description of Artificial Sequence: Synthetic coding sequence

SEQ ID NO: 8986 - protein, 262 aa, Artificial Sequence
  Description of Artificial Sequence: Synthetic coding sequence
MLCSLLLCECLLLVAGYAHDDDWIDPTDMLNYDAASGTMRKSQAKYGISGEKDVSPDLSCADEISECYHKLDSLTYKIDECEKKKREDYESQSNPVFRRYLNKILIEAGKLGLPDENKGDMHYDAEIILKRETLLEIQKFLNGEDWKPGALDDALSDILINFKFHDFETWKWRFEDSFGVDPYNVLMVLLCLLCIVVLVATELWTYVRWYTQLRRVLIISCAQSEASRVKQVGNLFQAWAFAVCDPVLLQVPVCPILVFCYS

SEQ ID NO: 8987 - protein, 501 aa, Artificial Sequence; identical to SEQ ID NO: 8984
  Description of Artificial Sequence: Synthetic coding sequence

SEQ ID NO: 8988 - protein, 241 aa, Artificial Sequence
  Description of Artificial Sequence: Synthetic coding sequence
MAEEQPQVELFVKAGSDGAKIGNCPFSQRLFMVLWLKGVTFNVTTVDTKRRTETVQKLCPGGQLPFLLYGTEVHTDTNKIEEFLEAVLCPPRYPKLAALNPESNTAGLDIFAKFSAYIKNSNPALNDNLEKGLLKALKVLDNYLTSPLPEEVDETSAEDEGVSQRKFLDGNELTLADCNLLPKLHIVQVVCKKYRGFTIPEAFRGVHRYLSNAYAREEFASTCPDDEEIELAYEQVAKALK

SEQ ID NO: 8989 - protein, 241 aa, Artificial Sequence; identical to SEQ ID NO: 8988
  Description of Artificial Sequence: Synthetic coding sequence

SEQ ID NO: 8990 - protein, 241 aa, Artificial Sequence; identical to SEQ ID NO: 8988
  Description of Artificial Sequence: Synthetic coding sequence

SEQ ID NO: 8991 - protein, 241 aa, Artificial Sequence; identical to SEQ ID NO: 8988
  Description of Artificial Sequence: Synthetic coding sequence

SEQ ID NO: 8992 - protein, 241 aa, Artificial Sequence; identical to SEQ ID NO: 8988
  Description of Artificial Sequence: Synthetic coding sequence

SEQ ID NO: 8993 - protein, 241 aa, Artificial Sequence; identical to SEQ ID NO: 8988
  Description of Artificial Sequence: Synthetic coding sequence

SEQ ID NO: 8994 - protein, 241 aa, Artificial Sequence; identical to SEQ ID NO: 8988
  Description of Artificial Sequence: Synthetic coding sequence

SEQ ID NO: 8995 - protein, 241 aa, Artificial Sequence; identical to SEQ ID NO: 8988
  Description of Artificial Sequence: Synthetic coding sequence

SEQ ID NO: 8996 - protein, 241 aa, Artificial Sequence; identical to SEQ ID NO: 8988
  Description of Artificial Sequence: Synthetic coding sequence

SEQ ID NO: 8997 - protein, 241 aa, Artificial Sequence; identical to SEQ ID NO: 8988
  Description of Artificial Sequence: Synthetic coding sequence

SEQ ID NO: 8998 - protein, 241 aa, Artificial Sequence; identical to SEQ ID NO: 8988
  Description of Artificial Sequence: Synthetic coding sequence

SEQ ID NO: 8999 - protein, 241 aa, Artificial Sequence; identical to SEQ ID NO: 8988
  Description of Artificial Sequence: Synthetic coding sequence

SEQ ID NO: 9000 - protein, 241 aa, Artificial Sequence; identical to SEQ ID NO: 8988
  Description of Artificial Sequence: Synthetic coding sequence

SEQ ID NO: 9001 - protein, 241 aa, Artificial Sequence; identical to SEQ ID NO: 8988
  Description of Artificial Sequence: Synthetic coding sequence

SEQ ID NO: 9002 - protein, 241 aa, Artificial Sequence; identical to SEQ ID NO: 8988
  Description of Artificial Sequence: Synthetic coding sequence

SEQ ID NO: 9003 - protein, 241 aa, Artificial Sequence; identical to SEQ ID NO: 8988
  Description of Artificial Sequence: Synthetic coding sequence

SEQ ID NO: 9004 - protein, 241 aa, Artificial Sequence; identical to SEQ ID NO: 8988
  Description of Artificial Sequence: Synthetic coding sequence

SEQ ID NO: 9005 - protein, 241 aa, Artificial Sequence; identical to SEQ ID NO: 8988
  Description of Artificial Sequence: Synthetic coding sequence

SEQ ID NO: 9006 - protein, 241 aa, Artificial Sequence; identical to SEQ ID NO: 8988
  Description of Artificial Sequence: Synthetic coding sequence

SEQ ID NO: 9007 - protein, 241 aa, Artificial Sequence; identical to SEQ ID NO: 8988
  Description of Artificial Sequence: Synthetic coding sequence

SEQ ID NO: 9008 - protein, 241 aa, Artificial Sequence; identical to SEQ ID NO: 8988
  Description of Artificial Sequence: Synthetic coding sequence

SEQ ID NO: 9009 - protein, 241 aa, Artificial Sequence; identical to SEQ ID NO: 8988
  Description of Artificial Sequence: Synthetic coding sequence

SEQ ID NO: 9010 - protein, 241 aa, Artificial Sequence; identical to SEQ ID NO: 8988
  Description of Artificial Sequence: Synthetic coding sequence

SEQ ID NO: 9011 - protein, 241 aa, Artificial Sequence; identical to SEQ ID NO: 8988
  Description of Artificial Sequence: Synthetic coding sequence

SEQ ID NO: 9012 - protein, 241 aa, Artificial Sequence; identical to SEQ ID NO: 8988
  Description of Artificial Sequence: Synthetic coding sequence

SEQ ID NO: 9013 - protein, 241 aa, Artificial Sequence; identical to SEQ ID NO: 8988
  Description of Artificial Sequence: Synthetic coding sequence

SEQ ID NO: 9014 - protein, 241 aa, Artificial Sequence; identical to SEQ ID NO: 8988
  Description of Artificial Sequence: Synthetic coding sequence

SEQ ID NO: 9015 - protein, 247 aa, Artificial Sequence
  Description of Artificial Sequence: Synthetic coding sequence
MSGLRPGTQVDPEIELFVKAGSDGESIGNCPFCQRLFMILWLKGVKFNVTTVDMTRKPEELKDLAPGTNPPFLVYNKELKTDFIKIEEFLEQTLAPPRYPHLSPKYKESFDVGCNLFAKFSAYIKNTQKEANKNFEKSLLKEFKRLDDYLNTPLLDEIDPDSAEEPPVSRRLFLDGDQLTLADCSLLPKLNIIKVAAKKYRDFDIPAEFSGVWRYLHNAYAREEFTHTCPEDKEIENTYANVAKQKS

SEQ ID NO: 9016 - protein, 253 aa, Artificial Sequence
  Description of Artificial Sequence: Synthetic coding sequence
MALSMPLNGLKEEDKEPLIELFVKAGSDGESIGNCPFSQRLFMILWLKGVVFSVTTVDLKRKPADLQNLAPGTHPPFITFNSEVKTDVNKIEEFLEEVLCPPKYLKLSPKHPESNTAGMDIFAKFSAYIKNSRPEANEALERGLLKTLQKLDEYLNSPLPDEIDENSMEDIKFSTRKFLDGNEMTLADCNLLPKLHIVKVVAKKYRNFDIPKEMTGIWRYLTNAYSRDEFTNTCPSDKEVEIAYSDVAKRLTK

SEQ ID NO: 9017 - protein, 207 aa, Artificial Sequence
  Description of Artificial Sequence: Synthetic coding sequence
MALSMPLNGLKEEDKEPLIELFVKAGSDGESIGNCPFSQRLFMILWLKGVVFSVTTVDLKRKPADLQNLAPGTHPPFITFNSEVKTDVNKIEEFLEEVLCPPKYLKLSPKHPESNTAGMDIFAKFSAYIKNSRPEANEALERGLLKTLQKLDEYLNSPLPDEIDENSMEDIKFSTRKFLDGNEMTLADCNLLPKLHIVKVVAKISQL

SEQ ID NO: 9018 - protein, 253 aa, Artificial Sequence; identical to SEQ ID NO: 9016
  Description of Artificial Sequence: Synthetic coding sequence

SEQ ID NO: 9019 - protein, 686 aa, Artificial Sequence
  Description of Artificial Sequence: Synthetic coding sequence
MAEAAEPEGVAPGPQGPPEVPAPLAERPGEPGAAGGEAEGPEGSEGAEEAPRGAAAVKEAGGGGPDRGPEAEARGTRGAHGETEAEEGAPEGAEVPQGGEETSGAQQVEGASPGRGAQGEPRGEAQREPEDSAAPERQEEAEQRPEVPEGSASGEAGDSVDAEGPLGDNIEAEGPAGDSVEAEGRVGDSVDAEGPAGDSVDAEGPLGDNIQAEGPAGDSVDAEGRVGDSVDAEGPAGDSVDAEGRVGDSVEAGDPAGDGVEAGVPAGDSVEAEGPAGDSMDAEGPAGRARRVSGEPQQSGDGSLSPQAEAIEVAAGESAGRSPGELAWDAAEEAEVPGVKGSEEAAPGDARADAGEDRVGDGPQQEPGEDEERRERSPEGPREEEAAGGEEESPDSSPHGEASRGAAEPEAQLSNHLAEEGPAEGSGEAARVNGRREDGEASEPRALGQEHDITLFVKAGYDGESIGNCPFSQRLFMILWLKGVIFNVTTVDLKRKPADLQNLAPGTNPPFMTFDGEVKTDVNKIEEFLEEKLAPPRYPKLGTQHPESNSAGNDVFAKFSAFIKNTKKDANEIHEKNLLKALRKLDNYLNSPLPDEIDAYSTEDVTVSGRKFLDGDELTLADCNLLPKLHIIKIVAKKYRDFEFPSEMTGIWRYLNNAYARDEFTNTCPADQEIEHAYSDVAKRMK

SEQ ID NO: 9020 - protein, 704 aa, Artificial Sequence
  Description of Artificial Sequence: Synthetic coding sequence
MAEAAEPEGVAPGPQGPPEVPAPLAERPGEPGAAGGEAEGPEGSEGAEEAPRGAAAVKEAGGGGPDRGPEAEARGTRGAHGETEAEEGAPEGAEVPQGGEETSGAQQVEGASPGRGAQGEPRGEAQREPEDSAAPERQEEAEQRPEVPEGSASGEAGDSVDAEGPLGDNIEAEGPAGDSVEAEGRVGDSVDAEGPAGDSVDAEGPLGDNIQAEGPAGDSVDAEGRVGDSVDAEGPAGDSVDAEGRVGDSVEAGDPAGDGVEAGVPAGDSVEAEGPAGDSMDAEGPAGRARRVSGEPQQSGDGSLSPQAEAIEVAAGESAGRSPGELAWDAAEEAEVPGVKGSEEAAPGDARADAGEDRVGDGPQQEPGEDEERRERSPEGPREEEAAGGEEESPDSSPHGEASRGAAEPEAQLSNHLAEEGPAEGSGEAARVNGRREDGEASEPRALGQEHDITLFVKVKLTALGCSRIAIKKYLRAGYDGESIGNCPFSQRLFMILWLKGVIFNVTTVDLKRKPADLQNLAPGTNPPFMTFDGEVKTDVNKIEEFLEEKLAPPRYPKLGTQHPESNSAGNDVFAKFSAFIKNTKKDANEIHEKNLLKALRKLDNYLNSPLPDEIDAYSTEDVTVSGRKFLDGDELTLADCNLLPKLHIIKIVAKKYRDFEFPSEMTGIWRYLNNAYARDEFTNTCPADQEIEHAYSDVAKRMK

SEQ ID NO: 9021 - protein, 594 aa, Artificial Sequence
  Description of Artificial Sequence: Synthetic coding sequence
MWCLLRGLGRPGALARGALGQQQSLGARALASAGSESRDEYSYVVVGAGSAGCVLAGRLTEDPAERVLLLEAGPKDVLAGSKRLSWKIHMPAALVANLCDDRYNWCYHTEVQRGLDGRVLYWPRGRVWGGSSSLNAMVYVRGHAEDYERWQRQGARGWDYAHCLPYFRKAQGHELGASRYRGADGPLRVSRGKTNHPLHCAFLEATQQAGYPLTEDMNGFQQEGFGWMDMTIHEGKRWSAACAYLHPALSRTNLKAEAETLVSRVLFEGTRAVGVEYVKNGQSHRAYASKEVILSGGAINSPQLLMLSGIGNADDLKKLGIPVVCHLPGVGQNLQDHLEIYIQQACTRPITLHSAQKPLRKVCIGLEWLWKFTGEGATAHLETGGFIRSQPGVPHPDIQFHFLPSQVIDHGRVPTQQEAYQVHVGPMRGTSVGWLKLRSANPQDHPVIQPNYLSTETDIEDFRLCVKLTREIFAQEALAPFRGKELQPGSHIQSDKEIDAFVRAKADSAYHPSCTCKMGQPSDPTAVVDPQTRVLGVENLRVVDASIMPSMVSGNLNAPTIMIAEKAADIIKGQPALWDKDVPVYKPRTLATQR

SEQ ID NO: 9022 - protein, 126 aa, Artificial Sequence
  Description of Artificial Sequence: Synthetic coding sequence
MWCLLRGLGRPGALARGALGQQQSLGARALASAGSESRDEYSYVVVGAGSAGCVLAGRLTEDPAERVLLLEAGPKDVLAGSKRLSWKIHMPAALVANLCDDRYNWCYHTEVQRGLDGRVLYWPRGR

SEQ ID NO: 9023 - protein, 155 aa, Artificial Sequence
  Description of Artificial Sequence: Synthetic coding sequence
MWCLLRGLGRPGALARGALGQQQSLGARALASAGSESRDEYSYVVVGAGSAGCVLAGRLTEDPAERVLLLEAGPKDVLAGSKRLSWKIHMPAALVANLCDDRYNWCYHTEVQRGLDGRVLYWPRGRVWGGSSSLNAMVYVRGHAEDYERWQRQGA

SEQ ID NO: 9024 - protein, 406 aa, Artificial Sequence
  Description of Artificial Sequence: Synthetic coding sequence
MAAGAGAGSAPRWLRALSEPLSAAQLRRLEEHRYSAAGVSLLEPPLQLYWTWLLQWIPLWMAPNSITLLGLAVNVVTTLVLISYCPTATEEAPYWTYLLCALGLFIYQSLDAIDGKQARRTNSCSPLGELFDHGCDSLSTVFMAVGASIAARLGTYPDWFFFCSFIGMFVFYCAHWQTYVSGMLRFGKVDVTEIQIALVIVFVLSAFGGATMWDYTIPILEIKLKILPVLGFLGGVIFSCSNYFHVILHGGVGKNGSTIAGTSVLSPGLHIGLIIILAIMIYKKSATDVFEKHPCLYILMFGCVFAKVSQKLVVAHMTKSELYLQDTVFLGPGLLFLDQYFNNFIDEYVVLWMAMVISSFDMVIYFSALCLQISRHLHLNIFKTACHQAPEQVQVLSSKSHQNNMD

SEQ ID NO: 9025 - protein, 231 aa, Artificial Sequence
  Description of Artificial Sequence: Synthetic coding sequence
MFVFYCAHWQTYVSGMLRFGKVDVTEIQIALVIVFVLSAFGGATMWDYTIPILEIKLKILPVLGFLGGVIFSCSNYFHVILHGGVGKNGSTIAGTSVLSPGLHIGLIIILAIMIYKKSATDVFEKHPCLYILMFGCVFAKVSQKLVVAHMTKSELYLQDTVFLGPGLLFLDQYFNNFIDEYVVLWMAMVISSFDMVIYFSALCLQISRHLHLNIFKTACHQAPEQVHKHID

SEQ ID NO: 9026 - protein, 416 aa, Artificial Sequence
  Description of Artificial Sequence: Synthetic coding sequence
MSGHRSTRKRCGDSHPESPVGFGHMSTTGCVLNKLFQLPTPPLSRHQLKRLEEHRYQSAGRSLLEPLMQGYWEWLVRRVPSWIAPNLITIIGLSINICTTILLVFYCPTATEQAPLWAYIACACGLFIYQSLDAIDGKQARRTNSSSPLGELFDHGCDSLSTVFVVLGTCIAVQLGTNPDWMFFCCFAGTFMFYCAHWQTYVSGTLRFGIIDVTEVQIFIIIMHLLAVIGGPPFWQSMIPVLNIQMKIFPALCTVAGTIFSCTNYFRVIFTGGVGKNGSTIAGTSVLSPFLHIGSVITLAAMIYKKSAVQLFEKHPCLYILTFGFVSAKITNKLVVAHMTKSEMHLHDTAFIGPALLFLDQYFNSFIDEYIVLWIALVFSFFDLIRYCVSVCNQIASHLHIHVFRIKVSTAHSNHH

SEQ ID NO: 9027 - protein, 416 aa, Artificial Sequence; identical to SEQ ID NO: 9026
  Description of Artificial Sequence: Synthetic coding sequence

SEQ ID NO: 9028 - protein, 532 aa, Artificial Sequence
  Description of Artificial Sequence: Synthetic coding sequence
MMMVRRGLLAWISRVVVLLVLLCCAISVLYMLACTPKGDEEQLALPRANSPTGKEGYQAVLQEWEEQHRNYVSSLKRQIAQLKEELQERSEQLRNGQYQASDAAGLGLDRSPPEKTQADLLAFLHSQVDKAEVNAGVKLATEYAAVPFDSFTLQKVYQLETGLTRHPEEKPVRKDKRDELVEAIESALETLNSPAENSPNHRPYTASDFIEGIYRTERDKGTLYELTFKGDHKHEFKRLILFRPFGPIMKVKNEKLNMANTLINVIVPLAKRVDKFRQFMQNFREMCIEQDGRVHLTVVYFGKEEINEVKGILENTSKAANFRNFTFIQLNGEFSRGKGLDVGARFWKGSNVLLFFCDVDIYFTSEFLNTCRLNTQPGKKVFYPVLFSQYNPGIIYGHHDAVPPLEQQLVIKKETGFWRDFGFGMTCQYRSDFINIGGFDLDIKGWGGEDVHLYRKYLHSNLIVVRTPVRGLFHLWHEKRCMDELTPEQYKMCMQSKAMNEASHGQLGMLVFRHEIEAHLRKQKQKTSSKKT

SEQ ID NO: 9029 - protein, 532 aa, Artificial Sequence; identical to SEQ ID NO: 9028
  Description of Artificial Sequence: Synthetic coding sequence

SEQ ID NO: 9030 - protein, 532 aa, Artificial Sequence; identical to SEQ ID NO: 9028
  Description of Artificial Sequence: Synthetic coding sequence

SEQ ID NO: 9031 - protein, 96 aa, Artificial Sequence
  Description of Artificial Sequence: Synthetic coding sequence
MMMVRRGLLAWISRVVVLLVLLCCAISVLYMLACTPKGDEEQLALPRANSPTGKEGYQAVLQEWEEQHRNYVSSLKRQIAQLKEELQERSEQLRNG

SEQ ID NO: 9032 - protein, 53 aa, Artificial Sequence
  Description of Artificial Sequence: Synthetic coding sequence
MMMVRRGLLAWISRVVVLLVLLCCAISVLYMLACTPKGDEEQLALPRANSPTG

SEQ ID NO: 9033 - protein, 532 aa, Artificial Sequence; identical to SEQ ID NO: 9028
  Description of Artificial Sequence: Synthetic coding sequence

SEQ ID NO: 9034 - protein, 104 aa, Artificial Sequence
  Description of Artificial Sequence: Synthetic coding sequence
MMMVRRGLLAWISRVVVLLVLLCCAISVLYMLACTPKGDEEQLALPRANSPTGKEGYQAVLQEWEEQHRNYVSSLKRQIAQLKEELQERSEQLRNGQYQASDAA

SEQ ID NO: 9035 - protein, 14 aa, Artificial Sequence
  Description of Artificial Sequence: Synthetic coding sequence
MMMVRRGLLAWISR

SEQ ID NO: 9036 - protein, 532 aa, Artificial Sequence; identical to SEQ ID NO: 9028
  Description of Artificial Sequence: Synthetic coding sequence

SEQ ID NO: 9037 - protein, 333 aa, Artificial Sequence
  Description of Artificial Sequence: Synthetic coding sequence
MPRRGLILHTRTHWLLLGLALLCSLVLFMYLLECAPQTDGNASLPGVVGENYGKEYYQALLQEQEEHYQTRATSLKRQIAQLKQELQEMSEKMRSLQERRNVGANGIGYQSNKEQAPSDLLEFLHSQIDKAEVSIGAKLPSEYGVIPFESFTLMKVFQLEMGLTRHPEEKPVRKDKRDELVEVIEAGLEVINNPDEDDEQEDEEGPLGEKLIFNENDFVEGYYRTERDKGTQYELFFKKADLTEYRHVTLFRPFGPLMKVKSEMIDITRSIINIIVPLAERTEAFVQFMQNFRDVCIHQDKKIHLTVVYFGKEGLSKVKSILESVTRLASSTW

SEQ ID NO: 9038 - protein, 542 aa, Artificial Sequence
  Description of Artificial Sequence: Synthetic coding sequence
MPRRGLILHTRTHWLLLGLALLCSLVLFMYLLECAPQTDGNASLPGVVGENYGKEYYQALLQEQEEHYQTRATSLKRQIAQLKQELQEMSEKMRSLQERRNVGANGIGYQSNKEQAPSDLLEFLHSQIDKAEVSIGAKLPSEYGVIPFESFTLMKVFQLEMGLTRHPEEKPVRKDKRDELVEVIEAGLEVINNPDEDDEQEDEEGPLGEKLIFNENDFVEGYYRTERDKGTQYELFFKKADLTEYRHVTLFRPFGPLMKVKSEMIDITRSIINIIVPLAERTEAFVQFMQNFRDVCIHQDKKIHLTVVYFGKEGLSKVKSILESVTSESNFHNYTLVSLNEEFNRGRGLNVGARAWDKGEVLMFFCDVDIYFSAEFLNSCRLNAEPGKKVFYPVVFSLYNPAIVYANQEVPPPVEQQLVHKKDSGFWRDFGFGMTCQYRSDFLTIGGFDMEVKGWGGEDVHLYRKYLHGDLIVIRTPVPGLFHLWHEKRCADELTPEQYRMCIQSKAMNEASHSHLGMLVFREEIETHLHKQAYRTNSEAVG

SEQ ID NO: 9039 - protein, 539 aa, Artificial Sequence
  Description of Artificial Sequence: Synthetic coding sequence
MGRAGGGGPGRGPPPLLLFLGAALVLASGAVPAREAGSAVEAEELVKGSPAWEPPANDTREEAGPPAAGEDEASWTAPGGELAGPEEVLQESAAVTGTAWLEADSPGLGGVTAEAGSGDAQALPATLQAPHEVLGQSIMPPAIPEATEASGPPSPTPGDKLSPASELPKESPLEVWLNLGGSTPDPQGPELTYPFQGTLEPQPASDIIDIDYFEGLDGEGRGADLGSFPGSPGTSENHPDTEGETPSWSLLDLYDDFTPFDESDFYPTTSFYDDLDEEEEEEEDDKDAVGGGDLEDENELLVPTGKPGLGPGTGQPTSRWHAVPPQHTLGSVPGSSIALRPRPGEPGRDLASSENGTECRSGFVRHNGSCRSVCDLFPSYCHNGGQCYLVENIGAFCRCNTQDYIWHKGMRCESIITDFQVMCVAVGSAALVLLLLFMMTVFFAKKLYLLKTENTKLRRTNKFRTPSELHNDNFSLSTIAEGSHPNDDPSAPHKIQEVLKSCLKEEESFNIQNSMSPKLEGGKGDQADLDVNCLQNNLT

SEQ ID NO: 9040 - protein, 566 aa, Artificial Sequence
  Description of Artificial Sequence: Synthetic coding sequence
MGRAGGGGPGRGPPPLLLFLGAALVLASGAVPAREAGSAVEAEELVKGSPAWEPPANDTREEAGPPAAGEDEASWTAPGGELAGPEEVLQESAAVTGTAWLEADSPGLGGVTAEAGSGDAQALPATLQAPHEVLGQSIMPPAIPEATEASGPPSPTPGDKLSPASELPKESPLEVWLNLGGSTPDPQGPELTYPFQGTLEPQPASDIIDIDYFEGLDGEGRGADLGSFPGSPGTSENHPDTEGETPSWSLLDLYDDFTPFDESDFYPTTSFYDDLDEEEEEEEDDKDAVGGGDLEDENELLVPTGKPGLGPGTGQPTSRWHAVPPQHTLGSVPGSSIALRPRPGEPGRDLASSENGTECRSGFVRHNGSCRSVCDLFPSYCHNGGQCYLVENIGAFCRCNTQDYIWHKGMRCESIITDFQVMCVAVGSAALVLLLLFMMTVFFAKKLYLLKTENTKLRRTNKFRTPSELHNDNFSLSTIAEGSHPNVRKLCNTPRTSSPHARALAHYDNVICQDDPSAPHKIQEVLKSCLKEEESFNIQNSMSPKLEGGKGDQADLDVNCLQNNLT

SEQ ID NO: 9041 - protein, 401 aa, Artificial Sequence
  Description of Artificial Sequence: Synthetic coding sequence
MPPAIPEATEASGPPSPTPGDKLSPASELPKESPLEVWLNLGGSTPDPQGPELTYPFQGTLEPQPASDIIDIDYFEGLDGEGRGADLGSFPGSPGTSENHPDTEGETPSWSLLDLYDDFTPFDESDFYPTTSFYDDLDEEEEEEEDDKDAVGGGDLEDENELLVPTGKPGLGPGTGQPTSRWHAVPPQHTLGSVPGSSIALRPRPGEPGRDLASSENGTECRSGFVRHNGSCRSVCDLFPSYCHNGGQCYLVENIGAFCRCNTQDYIWHKGMRCESIITDFQVMCVAVGSAALVLLLLFMMTVFFAKKLYLLKTENTKLRRTNKFRTPSELHNDNFSLSTIAEGSHPNDDPSAPHKIQEVLKSCLKEEESFNIQNSMSPKLEGGKGDQADLDVNCLQNNLT

SEQ ID NO: 9042 - protein, 273 aa, Artificial Sequence
  Description of Artificial Sequence: Synthetic coding sequence
MSRVVSLLLGAALLCGHGAFCRRVVSGQKVCFADFKHPCYKMAYFHELSSRVSFQEARLACESEGGVLLSLENEAEQKLIESMLQNLTKPGTGISDGDFWIGLWRNGDGQTSGACPDLYQWSDGSNSQYRNWYTDEPSCGSEKCVVMYHQPTANPGLGGPYLYQWNDDRCNMKHNYICKYEPEINPTAPVEKPYLTNQPGDTHQNVVVTEAGIIPNLIYVVIPTIPLLLLILVAFGTCCFQMLHKSKGRTKTSPNQSTLWISKSTRKESGMEV

SEQ ID NO: 9043 - protein, 236 aa, Artificial Sequence
  Description of Artificial Sequence: Synthetic coding sequence
MAYFHELSSRVSFQEARLACESEGGVLLSLENEAEQKLIESMLQNLTKPGTGISDGDFWIGLWRNGDGQTSGACPDLYQWSDGSNSQYRNWYTDEPSCGSEKCVVMYHQPTANPGLGGPYLYQWNDDRCNMKHNYICKYEPEINPTAPVEKPYLTNQPGDTHQNVVVTEAVKEEQKLVQTSLHCGFQRVPEKKVAWKYNNSLTWFQNFVILDLYKEWHQNNSLEWLEITKDLQDEL

SEQ ID NO: 9044 - protein, 232 aa, Artificial Sequence
  Description of Artificial Sequence: Synthetic coding sequence
MAYFHELSSRVSFQEARLACESEGGVLLSLENEAEQKLIESMLQNLTKPGTGISDGDFWIGLWRNGDGQTSGACPDLYQWSDGSNSQYRNWYTDEPSCGSEKCVVMYHQPTANPGLGGPYLYQWNDDRCNMKHNYICKYEPEINPTAPVEKPYLTNQPGDTHQNVVVTEAGIIPNLIYVVIPTIPLLLLILVAFGTCCFQMLHKSKGRTKTSPNQSTLWISKSTRKESGMEV

SEQ ID NO: 9045 - protein, 232 aa, Artificial Sequence; identical to SEQ ID NO: 9044
  Description of Artificial Sequence: Synthetic coding sequence

SEQ ID NO: 9046 - protein, 236 aa, Artificial Sequence; identical to SEQ ID NO: 9043
  Description of Artificial Sequence: Synthetic coding sequence

SEQ ID NO: 9047 - protein, 236 aa, Artificial Sequence; identical to SEQ ID NO: 9043
  Description of Artificial Sequence: Synthetic coding sequence

SEQ ID NO: 9048 - protein, 46 aa, Artificial Sequence
  Description of Artificial Sequence: Synthetic coding sequence
MAYFHELSSRVSFQEARLACESEGGVLLSLENEAEQKLIESMLQNL

SEQ ID NO: 9049 - protein, 46 aa, Artificial Sequence; identical to SEQ ID NO: 9048
  Description of Artificial Sequence: Synthetic coding sequence

SEQ ID NO: 9050 - protein, 46 aa, Artificial Sequence; identical to SEQ ID NO: 9048
  Description of Artificial Sequence: Synthetic coding sequence

SEQ ID NO: 9051 - protein, 254 aa, Artificial Sequence
  Description of Artificial Sequence: Synthetic coding sequence
MTAGSAHSQKVCFADFKHPCYKMAYFHELSSRVSFQEARLACESEGGVLLSLENEAEQKLIESMLQNLTKPGTGISDGDFWIGLWRNGDGQTSGACPDLYQWSDGSNSQYRNWYTDEPSCGSEKCVVMYHQPTANPGLGGPYLYQWNDDRCNMKHNYICKYEPEINPTAPVEKPYLTNQPGDTHQNVVVTEAGIIPNLIYVVIPTIPLLLLILVAFGTCCFQMLHKSKGRTKTSPNQSTLWISKSTRKESGMEV

SEQ ID NO: 9052 - protein, 412 aa, Artificial Sequence
  Description of Artificial Sequence: Synthetic coding sequence
MQKYCIYQHFQFQLLIQHLWIAANCDIADERFDATFHTNVLVNSSGHCQYLPPGIFKSSCYIDVRWFPFDVQHCKLKFGSWSYGGWSLDLQMQEADISGYIPNGEWDLVGIPGKRSERFYECCKEPYPDVTFTVTMRRRTLYYGLNLLIPCVLISALALLVFLLPADSGEKISLGITVLLSLTVFMLLVAEIMPATSDSVPLIAQYFASTMIIVGLSVVVTVIVLQYHHHDPDGGKMPKWTRVILLNWCAWFLRMKRPGEDKVRPACQHKQRRCSLASVEMSAVAPPPASNGNLLYIGFRGLDGVHCVPTPDSGVVCGRMACSPTHDEHLLHGGQPPEGDPDLAKILEEVRYIANRFRCQDESEAVCSEWKFAACVVDRLCLMAFSVFTIICTIGILMSAPNFVEAVSKDFA

SEQ ID NO: 9053 - protein, 321 aa, Artificial Sequence
  Description of Artificial Sequence: Synthetic coding sequence
MQEADISGYIPNGEWDLVGIPGKRSERFYECCKEPYPDVTFTVTMRRRTLYYGLNLLIPCVLISALALLVFLLPADSGEKISLGITVLLSLTVFMLLVAEIMPATSDSVPLIAQYFASTMIIVGLSVVVTVIVLQYHHHDPDGGKMPKWTRVILLNWCAWFLRMKRPGEDKVRPACQHKQRRCSLASVEMSAVAPPPASNGNLLYIGFRGLDGVHCVPTPDSGVVCGRMACSPTHDEHLLHGGQPPEGDPDLAKILEEVRYIANRFRCQDESEAVCSEWKFAACVVDRLCLMAFSVFTIICTIGILMSAPNFVEAVSKDFA

SEQ ID NO: 9054 - protein, 321 aa, Artificial Sequence; identical to SEQ ID NO: 9053
  Description of Artificial Sequence: Synthetic coding sequence

SEQ ID NO: 9055 - protein, 541 aa, Artificial Sequence
  Description of Artificial Sequence: Synthetic coding sequence
MASQEFEVEAIVDKRQDKNGNTQYLVRWKGYDKQDDTWEPEQHLMNCEKCVHDFNRRQTEKQKKLTWTTTSRIFSNNARRRTSRSTKANYSKNSPKTPVTDKHHRSKNCKLFAASKNVRRKAASTLSDTKNMEIINSTIETLAPDSPFDHKKTVSGFQKLEKLDPIAADQQDTVVFKVTEGKLLRDPLSHPGAEQTGIQNKTQMHPLMSQMSGSVTASMATGSATRKGIVVLIDPLAANGTTDMHTSVPRVKGGQRNITDDSRGQPFIKKMHFTIRLTESAITYRDIVVKKEDGFTQIVLSTRSTEKNALNTEVIKEMVNALNSAAADDSKLVLFSAAGSVFCCGLDFGYFVRHLRNDRNTASLEMVDTIKNFVNTFIQFKKPIVVSVNGPAIGLGASILPLCDLVWANEKAWFQTPYTTFGQSPDGCSSITFPKMMGKASANEMLIAGRKLTAREACAKGLVSQVFLTGTFTQEVMIQIKELASYNAIVLEECKALVRCNIKLELEQANERECEVLRKIWSSAQGIESMLKYVENKIDEF

SEQ ID NO: 9056 - protein, 555 aa, Artificial Sequence
  Description of Artificial Sequence: Synthetic coding sequence
MASQEFEVEAIVDKRQDKNGNTQYLVRWKGYDKQDDTWEPEQHLMNCEKCVHDFNRRQTEKQKKLTWTTTSRIFSNNARRRTSRSTKANYSKNSPKTPVTDKHHRSKNCKLFAASKNVRRKAASTLSDTKNMEIINSTIETLAPDSPFDHKKTVSGFQKLEKLDPIAADQQDTVVFKVTEGKLLRDPLSHPGAEQTGIQNKTQMHPLMSQMSGSVTASMATGSATRKGIVVLIDPLAANGTTDMHTSVPRVKGGQRNITDDSRGQPFIKKMHFTIRLTESAITYRDIVVKKEDGFTQIVLSTRSTEKNALNTEVIKEMVNALNSAAADDSKLVLFSAAGSVFCCGLDFGYFVRHLRNDRNTASLEMVDTIKNFVNTFIQFKKPIVVSVNGPAIGLGASILPLCDLVWANEKAWFQTPYTTFGQSPDGCSSITFPKMMGKASANEMLIAGRKLTAREACAKGLVSQVFLTGTFTQEVMIQIKELASYNAIVLEECKALVRCNIKLELEQANERECEVLRKIWSSAQGIESMLKIPLLGYKAAFPPRKTQNDQRWCP

SEQ ID NO: 9057 - protein, 800 aa, Artificial Sequence
  Description of Artificial Sequence: Synthetic coding sequence
MATLGQKPVIHTVLKRKVYSSNEKMRRGTWRIVVPMTKDDALKEIRGNQVTFQDCFIADFLILLTFPLLTIPEIPGYLPISSPRGSQLMASWDACVVASAVLVTDMETFHTTDSFKSWTRIRVPPDILSDDERRSVAHVILSRDGIVFLINGVLYIKSFRGFIRLGGIVNLPDGGITGISSRKWCWVNYLLKAKGRRSTFAVWTENEIYLGSILLKFARLVTTTELKNILSLSVTATLTIDRVEYTGHPLEIAVFLNYCTVCNVTKKIFLVIYNEDTKQWVSQDFTLDAPIDSVTMPHFTFSALPGLLLWNKHSIYYCYHNFTFTGILQTPAGHGNLSMLSNDSIIHEVFIDYYGDILVKMENNVIFYSKINTRDAVKLHLWTNYTTRAFIFLSTSGQTYFLYALDDGTIQIQDYPLHLEAQSIAFTTKDKCPYMAFHNNVAHVFYFLDKGEALTVWTQIVYPENTGLYVIVESYGPKILQESHEISFEAAFGYCTKTLTLTFYQNVDYERISDYFETQDKHTGLVLVQFRPSEYSKACPIAQKVFQIAVGCDDKKFIAIKGFSKKGCHHHDFSYVIEKSYLRHQPSKNLRVRYIWGEYGCPLRLDFTEKFQPVVQLFDDNGYVKDVEANFIVWEIHGRDDYSFNNTMAQSGCLHEAQTWKSMIELNKHLPLEEVWGPENYKHCFSYAIGKPGDLNQPYEIINSSNGNHIFWPMGHSGMYVFRVKILDPNYSFCNLTAMFAIETFGLIPSPSVYLVASFLFVLMLLFFTILVLSYFRYMRIYRRYIYEPLHKPQRKRKKN

SEQ ID NO: 9058 - protein, 832 aa, Artificial Sequence
  Description of Artificial Sequence: Synthetic coding sequence
MSAREVAVLLLWLSCYGSALWRYSTNSPNYRIFSTRSTIKLEYEGTLFTEWSVPETCFVLNKSSPTTELRCSSPGVHAIKPIVTGPDEEERYLFVESSHTCFLWYYRVRHFFNNFTQLITVWAYDPESADPDELLGNAEEPSINSIVLSTQMATLGQKPVIHTVLKRKVYSSNEKMRRGTWRIVVPMTKDDALKEIRGNQVTFQDCFIADFLILLTFPLLTIPEIPGYLPISSPRGSQLMASWDACVVASAVLVTDMETFHTTDSFKSWTRIRVPPDILSDDERRSVAHVILSRDGIVFLINGVLYIKSFRGFIRLGGIVNLPDGGITGISSRKWCWVNYLLKAKGRRSTFAVWTENEIYLGSILLKFARLVTTTELKNILSLSVTATLTIDRVEYTGHPLEIAVFLNYCTVCNVTKKIFLVIYNEDTKQWVSQDFTLDAPIDSVTMPHFTFSALPGLLLWNKHSIYYCYHNFTFTGILQTPAGHGNLSMLSNDSIIHEVFIDYYGDILVKMENNVIFYSKINTRDAVKLHLWTNYTTRAFIFLSTSGQTYFLYALDDGTIQIQDYPLHLEAQSIAFTTKDKCPYMAFHNNVAHVFYFLDKGEALTVWTQIVYPENTGLYVIVESYGPKILQESHEISFEAAFGYCTKTLTLTFYQNVDYERISDYFETQDKHTGLVLVQFRPSEYSKACPIAQKVFQIAVGCDDKKFIAIKGFSKKGCHHHDFSYVIEKSYLRHQPSKNLRVRYIWGEYGCPLRLDFTEKFQPVVQLFDDNGYVKDVEANFIVWEIHGRDDYSFNNTMAQSGCLHEAQTWKSMIELNKHLPLEEVWGPEFL

SEQ ID NO: 9059 - protein, 951 aa, Artificial Sequence
  Description of Artificial Sequence: Synthetic coding sequence
MSAREVAVLLLWLSCYGSALWRYSTNSPNYRIFSTRSTIKLEYEGTLFTEWSVPETCFVLNKSSPTTELRCSSPGVHAIKPIVTGPDEEERYLFVESSHTCFLWYYRVRHFFNNFTQLITVWAYDPESADPDELLGNAEEPSINSIVLSTQMATLGQKPVIHTVLKRKVYSSNEKMRRGTWRIVVPMTKDDALKEIRGNQVTFQDCFIADFLILLTFPLLTIPEIPGYLPISSPRGSQLMASWDACVVASAVLVTDMETFHTTDSFKSWTRIRVPPDILSDDERRSVAHVILSRDGIVFLINGVLYIKSFRGFIRLGGIVNLPDGGITGISSRKWCWVNYLLKAKGRRSTFAVWTENEIYLGSILLKFARLVTTTELKNILSLSVTATLTIDRVEYTGHPLEIAVFLNYCTVCNVTKKIFLVIYNEDTKQWVSQDFTLDAPIDSVTMPHFTFSALPGLLLWNKHSIYYCYHNFTFTGILQTPAGHGNLSMLSNDSIIHEVFIDYYGDILVKMENNVIFYSKINTRDAVKLHLWTNYTTRAFIFLSTSGQTYFLYALDDGTIQIQDYPLHLEAQSIAFTTKDKCPYMAFHNNVAHVFYFLDKGEALTVWTQIVYPENTGLYVIVESYGPKILQESHEISFEAAFGYCTKTLTLTFYQNVDYERISDYFETQDKHTGLVLVQFRPSEYSKACPIAQKVFQIAVGCDDKKFIAIKGFSKKGCHHHDFSYVIEKSYLRHQPSKNLRVRYIWGEYGCPLRLDFTEKFQPVVQLFDDNGYVKDVEANFIVWEIHGRDDYSFNNTMAQSGCLHEAQTWKSMIELNKHLPLEEVWGPENYKHCFSYAIGKPGDLNQPYEIINSSNGNHIFWPMGHSGMYVFRVKILDPNYSFCNLTAMFAIETFGLIPSPSVYLVASFLFVLMLLFFTILVLSYFRYMRIYRRYIYEPLHKPQRKRKKN

SEQ ID NO: 9060 - protein, 832 aa, Artificial Sequence; identical to SEQ ID NO: 9058
  Description of Artificial Sequence: Synthetic coding sequence

SEQ ID NO: 9061 - protein, 871 aa, Artificial Sequence
  Description of Artificial Sequence: Synthetic coding sequence
RRRSRRHVSPGSGRAAAVAELLWLRPLEIKLEYEGTLFTEWSVPETCFVLNKSSPTTELRCSSPGVHAIKPIVTGPDEEERYLFVESSHTCFLWYYRVRTWRIVVPMTKDDALKEIRGNQVTFQDCFIADFLILLTFPLLTIPEIPGYLPISSPRGSQLMASWDACVVASAVLVTDMETFHTTDSFKSWTRIRVPPDILSDDERRSVAHVILSRDGIVFLINGVLYIKSFRGFIRLGGIVNLPDGGITGISSRKWCWVNYLLKAKGRRSTFAVWTENEIYLGSILLKFARLVTTTELKNILSLSVTATLTIDRVEYTGHPLEIAVFLNYCTVCNVTKKIFLVIYNEDTKQWVSQDFTLDAPIDSVTMPHFTFSALPGLLLWNKHSIYYCYHNFTFTGILQTPAGHGNLSMLSNDSIIHEVFIDYYGDILVKMENNVIFYSKINTRDAVKLHLWTNYTTRAFIFLSTSGQTYFLYALDDGTIQIQDYPLHLEAQSIAFTTKDKCPYMAFHNNVAHVFYFLDKGEALTVWTQIVYPENTGLYVIVESYGPKILQESHEISFEAAFGYCTKTLTLTFYQNVDYERISDYFETQDKHTGLVLVQFRPSEYSKACPIAQKVFQIAVGCDDKKFIAIKGFSKKGCHHHDFSYVIEKSYLRHQPSKNLRVRYIWGEYGCPLRLDFTEKFQPVVQLFDDNGYVKDVEANFIVWEIHGRDDYSFNNTMAQSGCLHEAQTWKSMIELNKHLPLEEVWGPENYKHCFSYAIGKPGDLNQPYEIINSSNGNHIFWPMGHSGMYVFRVKILDPNYSFCNLTAMFAIETFGLIPSPSVYLVASFLFVLMLLFFTILVLSYFRYMRIYRRYIYEPLHKPQRKRKKN

SEQ ID NO: 9062 - protein, 102 aa, Artificial Sequence
  Description of Artificial Sequence: Synthetic coding sequence
MTTATPLGDTTFFSLNMTTRGEDFLYKSSGAIVAAVVVVVIIIFTVVLILLKMYNRKMRTRRELEPKGPKPTAPSAVGPNSNGSQHPATVTFSPVDVQVETR

SEQ ID NO: 9063 - protein, 344 aa, Artificial Sequence
  Description of Artificial Sequence: Synthetic coding sequence
MALRHLALLAGLLVGVASKSMENTAQLPECCVDVVGVNASCPGASLCGPGCYRRWNADGSASCVRCGNGTLPAYNGSECRSFAGPGAPFPMNRSSGTPGRPHPGAPRVAASLFLGTFFISSGLILSVAGFFYLKRSSKLPRACYRRNKAPALQPGEAAAMIPPPQSSGNSSCRIPLWGFPSLGQSQGALWVCPQTGLPGSGSRPPLPGSPGDPPTRQGQGRIWLVPPALDLSWIWPAPPARPPLIPVTSMLFPVPETWGLQERRTHHDRADPQYLLLLEVQLHPRTDAAGLRQALLSSHRFSGAGSGGPKSQPVRKPRYVRRERPLDRATDPAAFPGEARISNV

SEQ ID NO: 9064 - protein, 198 aa, Artificial Sequence
  Description of Artificial Sequence: Synthetic coding sequence
MALRHLALLAGLLVGVASKSMENTAQLPECCVDVVGVNASCPGASLCGPGCYRRWNADGSASCVRCGNGTLPAYNGSECRSFAGPGAPFPMNRSSGTPGRPHPGAPRVAASLFLGTFFISSGLILSVAGFFYLKRSSKLPRACYRRNKAPALQPGEAAAMIPPPQSSVRKPRYVRRERPLDRATDPAAFPGEARISNV

SEQ ID NO: 9065 - protein, 380 aa, Artificial Sequence
  Description of Artificial Sequence: Synthetic coding sequence
MALRHLALLAGLLVGVASKSMENTVTRNSTAVINTQAEGTLSPPGLSSLPVVREWALTHTAQLPECCVDVVGVNASCPGASLCGPGCYRRWNADGSASCVRCGNGTLPAYNGSECRSFAGPGAPFPMNRSSGTPGRPHPGAPRVAASLFLGTFFISSGLILSVAGFFYLKRSSKLPRACYRRNKAPALQPGEAAAMIPPPQSSGNSSCRIPLWGFPSLGQSQGALWVCPQTGLPGSGSRPPLPGSPGDPPTRQGQGRIWLVPPALDLSWIWPAPPARPPLIPVTSMLFPVPETWGLQERRTHHDRADPQYLLLLEVQLHPRTDAAGLRQALLSSHRFSGAGSGGPKSQPVRKPRYVRRERPLDRATDPAAFPGEARISNV

SEQ ID NO: 9066 - protein, 198 aa, Artificial Sequence; identical to SEQ ID NO: 9064
  Description of Artificial Sequence: Synthetic coding sequence

SEQ ID NO: 9067 - protein, 185 aa, Artificial Sequence
  Description of Artificial Sequence: Synthetic coding sequence
MALRHLALLAGLLVGVASKSMENTAQLPECCVDVVGVNASCPGASLCGPGCYRRWNADGSASCVRCGNGTLPAYNGSECRSFAGPGAPFPMNRSSGTPGRPHPGAPRVAASLFLGTFFISSGLILSVAGFFYLKRSSKLPRACYRRNKGPAPAGSLPGRWSSQQFGPQAPALQPGEAVSNPHHPG

SEQ ID NO: 9068 - protein, 57 aa, Artificial Sequence
  Description of Artificial Sequence: Synthetic coding sequence
MALRHLALLAGLLVGVASKSMENTAQLPECCVDVVGVNASCPGASLCGPGCYRRWNA

SEQ ID NO: 9069 - protein, 380 aa, Artificial Sequence; identical to SEQ ID NO: 9065
  Description of Artificial Sequence: Synthetic coding sequence

SEQ ID NO: 9070 - protein, 200 aa, Artificial Sequence [sequence omitted]

SEQ ID NO: 9071 - protein, 155 aa, Artificial Sequence
  Description of Artificial Sequence: Synthetic coding sequence
MGGNGSTCKPDTERQGTLSTAAPTTSPAPCLSNHHNKKHLILAFCAGVLLTLLLIAFIFLIIKSYRKYRRERLPISPGPLLRWVPLLSGTMADHSKPQAPDPHSDPPAKLSSIPGESLTYASTTFKLSEEKSNHLAENHSADFDPIVYAQIKVTN

SEQ ID NO: 9072 - protein, 130 aa, Artificial Sequence
  Description of Artificial Sequence: Synthetic coding sequence
MGGNGSTCKPDTERQGTLSTAAPTTSPAPCLSNHHNKKHLILAFCAGVLLTLLLIAFIFLIIKSYRKYHSKPQAPDPHSDPPAKLSSIPGESLTYASTTFKLSEEKSNHLAENHSADFDPIVYAQIKVTN

SEQ ID NO: 9073 - protein, 199 aa, Artificial Sequence
  Description of Artificial Sequence: Synthetic coding sequence
MASPKGFFNYLTYFLAAGAVTLGIGFFALASALWFLICKRREIFQNSKFKAIDERCRQRPSMAKIKSHSQCVFISRNFHTGRFQLQEEQRKKEAAHIKAIKDHSKDEPQLATKNIICDPSETSSTTNRSSVTLSLSTLPSDSYYSQSIEAADDWFSDDSLVKRNSPMPSLGEPLMEKVFSYLSTISLEEGTESVLNDTL

SEQ ID NO: 9074 - protein, 172 aa, Artificial Sequence
  Description of Artificial Sequence: Synthetic coding sequence
MLTEVMEVWHGLVIAVVSLFLQACFLTAINYLLSRHMAHKSEQILKAASLQVPRPSPGHHHPPAVKEMKETQTERDIPMSDSLYRHDSDTPSDSLDSSCSSPPACQATEDVDYTQVVFSDPGELKNDSPLDYENIKEITDYVNVNPERHKPSFWYFVNPALSEPAEYDQVAM

SEQ ID NO: 9075 - protein, 113 aa, Artificial Sequence
  Description of Artificial Sequence: Synthetic coding sequence
MNETNKTLVGPSELPTASAVAPGPGTGARAWPVLVGFVLGAVVLSLLIALAAKCHLCRRYHASYRHRPLPETGRGGRPQVAEDEDDDGFIEDNYIQPGTGELGTEGSRDHFSL

SEQ ID NO: 9076 - protein, 113 aa, Artificial Sequence; identical to SEQ ID NO: 9075
  Description of Artificial Sequence: Synthetic coding sequence

SEQ ID NO: 9077 - protein, 454 aa, Artificial Sequence
  Description of Artificial Sequence: Synthetic coding sequence
MGRTYIVEETVGQYLSNINLQGKAFVSGLLIGQCSSQKDYVILATRTPPKEEQSENLKHPKAKLDNLDEEWATEHACQVSRMLPGGLLVLGVFIITTLELANDFQNALRRLMFAVEKSINRKRLWNFTEEEVSERVTLHICASTKKIFCRTYDIHDPKSSARPADWKYQSGLSSSWLSLECTVHINIHIPLSATSVSYTLEKNTKNGLTRWAKEIENGVYLINGQVKDEDCDLLEGQKKSSRGNTQATSHSFDVRVLTQLLLNSDHRSTATVQICSGSVNLKGAVKCRAYIHSSKPKVKDAVQAVKRDILNTVADRCEMLFEDLLLNEIPEKKDSEKEFHVLPYRVFVPLPGSTVMLCDYKFDDESAEEIRDHFMEMLDHTIQIEDLEIAEETNTACMSSSMNSQASLDNTDDEQPKQPIKTTMLLKIQQNIGVIAAFTVAVLAAGISFHYFSD

SEQ ID NO: 9078 - protein, 431 aa, Artificial Sequence
  Description of Artificial Sequence: Synthetic coding sequence
MGRTYIVEETVGQYLSNINLQGKAFVSGLLIGQCSSQKDYVILATRTPPKEEQSENLKHPKAKLDNLDEEWATEHACQVSRMLPGGLLVLGVFIITTLELANDFQNALRRLMFAVEKSINRKRLWNFTEEEVSERVTLHICASTKKIFCRTYDIHDPKSSARPADWKYQSGLSSSWLSLECTVHINIHIPLSATSVSYTLEKNTKNGLTRWAKEIENGVYLINGQVKDEDCDLLEGQLLNSDHRSTATVQICSGSVNLKGAVKCRAYIHSSKPKVKDAVQAVKRDILNTVADRCEMLFEDLLLNEIPEKKDSEKEFHVLPYRVFVPLPGSTVMLCDYKFDDESAEEIRDHFMEMLDHTIQIEDLEIAEETNTACMSSSMNSQASLDNTDDEQPKQPIKTTMLLKIQQNIGVIAAFTVAVLAAGISFHYFSD

SEQ ID NO: 9079 - protein, 422 aa, Artificial Sequence
  Description of Artificial Sequence: Synthetic coding sequence
MGRTYIVEETVGQYLSNINLQGKAFVSGLLIGQCSSQKDYVILATRTPPKEEQSENLKHPKAKLDNLDEEWATEHACQLMFAVEKSINRKRLWNFTEEEVSERVTLHICASTKKIFCRTYDIHDPKSSARPADWKYQSGLSSSWLSLECTVHINIHIPLSATSVSYTLEKNTKNGLTRWAKEIENGVYLINGQVKDEDCDLLEGQKKSSRGNTQATSHSFDVRVLTQLLLNSDHRSTATVQICSGSVNLKGAVKCRAYIHSSKPKVKDAVQAVKRDILNTVADRCEMLFEDLLLNEIPEKKDSEKEFHVLPYRVFVPLPGSTVMLCDYKFDDESAEEIRDHFMEMLDHTIQIEDLEIAEETNTACMSSSMNSQASLDNTDDEQPKQPIKTTMLLKIQQNIGVIAAFTVAVLAAGISFHYFSD

SEQ ID NO: 9080 - protein, 335 aa, Artificial Sequence
  Description of Artificial Sequence: Synthetic coding sequence
MGRTYIVEETVGQYLSNINLQGKAFVSGLLIGQCSSQKDYVILATRTPPKEEQSENLKHPKAKLDNLDEEWATEHACQVSRMLPGGLLVLGVFIITTLELANDFQNALRRLMFAVEKSINRKRLWNFTEEEVSERVTLHICASTKKIFCRTYDIHDPKSSARPADWKYQSGLSSSWLSLECTVHINIHIPLSATSVSYTLEKNTKNGLTRWAKEIENGVYLINGQVKDEDCDLLEGQKKSSRGNTQATSHSFDVRVLTQLLLNSDHRSTATVQICSGSVNLKGAVKCRAYIHSSKPKVKDAVQAVKRDILNTVADRCEMLFEDLLLNEIPEKKDF

SEQ ID NO: 9081 - protein, 79 aa, Artificial Sequence
  Description of Artificial Sequence: Synthetic coding sequence
MAAPSMKERQVCWGARDEYWKCLDENLEDASQCKKLRSSFESSCPQQWIKYFDKRRDYLKFKEKFEAGQFEPSETTAKS

SEQ ID NO: 9082 - protein, 125 aa, Artificial Sequence
  Description of Artificial Sequence: Synthetic coding sequence
MGPGGPLLSPSRGFLLCKTGWHSNRLLGDCGPHTPVSTALSFIAVGMAAPSMKERQVCWGARDEYWKCLDENLEDASQCKKLRSSFESSCPQQWIKYFDKRRDYLKFKEKFEAGQFEPSETTAKS

SEQ ID NO: 9083 - protein, 155 aa, Artificial Sequence
  Description of Artificial Sequence: Synthetic coding sequence
MVARKGQKSPRFRRVSCFLRLGRSTLLELEPAGRPCSGRTRHRALHRRLVACVTVSSRRHRKEAGRGRAESFIAVGMAAPSMKERQVCWGARDEYWKCLDENLEDASQCKKLRSSFESSCPQQWIKYFDKRRDYLKFKEKFEAGQFEPSETTAKS

SEQ ID NO: 9084 - protein, 156 aa, Artificial Sequence
  Description of Artificial Sequence: Synthetic coding sequence
MVARKGQKSPRFRRVSCFLRLGRSTLLELEPAGRPCSGRTRHRALHRRLVACVTVSSRRHRKEAGRGRAESSFIAVGMAAPSMKERQVCWGARDEYWKCLDENLEDASQCKKLRSSFESSCPQQWIKYFDKRRDYLKFKEKFEAGQFEPSETTAKS

SEQ ID NO: 9085 - protein, 219 aa, Artificial Sequence
  Description of Artificial Sequence: Synthetic coding sequence
MASGSNWLSGVNVVLVMAYGSLDLKEEIDIRLSRVQDIKYEPQLLADDDARLLQLETQGNQSCYNYLYRMKALDAIRTSEIPFHSEGRHPRSLMGKNFRSYLLDLRNTSTPFKGVRKALIDTLLDGYETARYGTGVFGQNEYLRYQEALSELATAVKARIGSSQRHHQSAAKDLTQSPEVSPTTIQVTYLPSSQKSKRAKHFLELKSFKDNYNTLESTL

SEQ ID NO: 9086 - protein, 201 aa, Artificial Sequence
  Description of Artificial Sequence: Synthetic coding sequence
MASGSNWLSGVNVVLVMAYGSLDLKEEIDIRLSRVQDIKYEPQLLADDDARLLQLETQGNQKIPFHSEGRHPRSLMGKNFRSYLLDLRNTSTPFKGVRKALIDTLLDGYETARYGTGVFGQNEYLRYQEALSELATAVKARIGSSQRHHQSAAKDLTQSPEVSPTTIQVTYLPSSQKSKRAKHFLELKSFKDNYNTLESTL

SEQ ID NO: 9087 - protein, 155 aa, Artificial Sequence
  Description of Artificial Sequence: Synthetic coding sequence
MASGSNWLSGVNVVLVMAYGSLDLKEEIDIRLSRVQDIKYEPQLLADDDARLLQLETQGNQSCYNYLYRMKALDAIRTSEIPFHSEGRHPRSLMGKNFRSYLLDLRNTSTPFKGVRKALIDTLLDGYETARYGTGVFGQNEYLRYQEALSELATA

SEQ ID NO: 9088 - protein, 189 aa, Artificial Sequence
  Description of Artificial Sequence: Synthetic coding sequence
MASGSNWLSGVNVVLVMAYGSLVFVLLFIFVKRQIMRFAMKSRRGPHVPVGHNAPKDLKEEIDIRLSRVQDIKYEPQLLADDDARLLQLETQGNQSCYNYLYRMKALDAIRTSEIPFHSEGRHPRSLMGKNFRSYLLDLRNTSTPFKGVRKALIDTLLDGYETARYGTGVFGQNEYLRYQEALSELATA

SEQ ID NO: 9089 - protein, 235 aa, Artificial Sequence
  Description of Artificial Sequence: Synthetic coding sequence
MASGSNWLSGVNVVLVMAYGSLVFVLLFIFVKRQIMRFAMKSRRGPHVPVGHNAPKDLKEEIDIRLSRVQDIKYEPQLLADDDARLLQLETQGNQKIPFHSEGRHPRSLMGKNFRSYLLDLRNTSTPFKGVRKALIDTLLDGYETARYGTGVFGQNEYLRYQEALSELATAVKARIGSSQRHHQSAAKDLTQSPEVSPTTIQVTYLPSSQKSKRAKHFLELKSFKDNYNTLESTL

SEQ ID NO: 9090 - protein, 253 aa, Artificial Sequence
  Description of Artificial Sequence: Synthetic coding sequence
MASGSNWLSGVNVVLVMAYGSLVFVLLFIFVKRQIMRFAMKSRRGPHVPVGHNAPKDLKEEIDIRLSRVQDIKYEPQLLADDDARLLQLETQGNQSCYNYLYRMKALDAIRTSEIPFHSEGRHPRSLMGKNFRSYLLDLRNTSTPFKGVRKALIDTLLDGYETARYGTGVFGQNEYLRYQEALSELATAVKARIGSSQRHHQSAAKDLTQSPEVSPTTIQVTYLPSSQKSKRAKHFLELKSFKDNYNTLESTL

SEQ ID NO: 9091 - protein, 406 aa, Artificial Sequence
  Description of Artificial Sequence: Synthetic coding sequence
MRGSVECTWGWGHCAPSPLLLWTLLLFAAPFGLLGEKTRQVSLEVIPNWLGPLQNLLHIRAVGTNSTLHYVWSSLGPLAVVMVATNTPHSTLSVNWSLLLSPEPDGGLMVLPKDSIQFSSALVFTRLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQLDQLLWGSLPSGFAQWRPVAYSQKPGGRESALPCQASPLHPALAYSLPQSPIVRAFFGSQNNFCAFNLTFGASTGPGYWDQHYLSWSMLLGVGFPPVDGLSPLVLGIMAVALGAPGLMLLGGGLVLLLHHKKYSEYQSIN

SEQ ID NO: 9092 - protein, 1254 aa, Artificial Sequence
  Description of Artificial Sequence: Synthetic coding sequence
MKKHRRALALVSCLFLCSLVWLPSWRVCCKESSSASASSYYSQDDNCALENEDVQFQKKDEREGPINAESLGKSGSNLPISPKEHKLKDDSIVDVQNTESKKLSPPVVETLPTVDLHEESSNAVVDSETVENISSSSTSEITPISKLDEIEKSGTIPIAKPSETEQSETDCDVGEALDASAPIEQPSFVSPPDSLVGQHIENVSSSHGKGKITKSEFESKVSASEQGGGDPKSALNASDNLKNESSDYTKPGDIDPTSVASPKDPEDIPTFDEWKKKVMEVEKEKSQSMHASSNGGSHATKKVQKNRNNYASVECGAKILAANPEAKSTSAILIENMDLYMLNPCSTKIWFVIELCEPIQVKQLDIANYELFSSTPKDFLVSISDRYPTNKWIKLGTFHGRDERNVQSFPLDEQMYAKYVKMFIKYIKVELLSHFGSEHFCPLSLIRVFGTSMVEEYEEIADSQYHSERQELFDEDYDYPLDYNTGEDKSSKNLLGSATNAILNMVNIAANILGAKTEDLTEGNKSISENATATAAPKMPESTPVSTPVPSPEYVTTEVHTHDMEPSTPDTPKESPIVQLVQEEEEEASPSTVTLLGSGEQEDESSPWFESETQIFCSELTTICCISSFSEYIYKWCSVRVALYRQRSRTALSKGKDYLVLAQPPLLLPAESVDVSVLQPLSGELENTNIEREAETVVLGDLSSSMHQDDLVNHTVDAVELEPSHSQTLSQSLLLDITPEINPLPKIEVSESVEYEAGHIPSPVIPQESSVEIDNETEQKSESFSSIEKPSITYETNKVNELMDNIIKEDVNSMQIFTKLSETIVPPINTATVPDNEDGEAKMNIADTAKQTLISVVDSSSLPEVKEEEQSPEDALLRGLQRTATDFYAELQNSTDLGYANGNLVHGSNQKESVFMRLNNRIKALEVNMSLSGRYLEELSQRYRKQMEEMQKAFNKTIVKLQNTSRIAEEQDQRQTEAIQLLQAQLTNMTQLVSNLSATVAELKREVSDRQSYLVISLVLCVVLGLMLCMQRCRNTSQFDGDYISKLPKSNQYPSPKRCFSSYDDMNLKRRTSFPLMRSKSLQLTGKEVDPNDLYIVEPLKFSPEKKKKRCKYKIEKIETIKPEEPLHPIANGDIKGRKPFTNQRDFSNMGEVYHSSYKGPPSEGSSETSSQSEESYFCGISACTSLCNGQSQKTKTEKRALKRRRSKVQDQGKLIKTLIQTKSGSLPSLHDIIKGNKEITVGTFGVTAVSGHI

SEQ ID NO: 9093 - protein, 1406 aa, Artificial Sequence
  Description of Artificial Sequence: Synthetic coding sequence
MRGFLARPFLSTNQHLAQWGSPLPQGKGLVQLPSQHTRHSRPFHELCSKEENSATVPKLISLVVSSETIDFSNKTMDSRRDWEREKRILEGKLQLPKALARTQRARDEGRRAWTSRWLQRRRSPESCEAPLSAPLWGPQRGLPGREPLRSRSASAIALRTIGHILALLLRLLHLGLGSGGCREDVPPSGRGKKEEKMKKHRRALALVSCLFLCSLVWLPSWRVCCKESSSASASSYYSQDDNCALENEDVQFQKKNTESKKLSPPVVETLPTVDLHEESSNAVVDSETVENISSSSTSEITPISKLDEIEKSGTIPIAKPSETEQSETDCDVGEALDASAPIEQPSFVSPPDSLVGQHIENVSSSHGKGKITKSEFESKVSASEQGGGDPKSALNASDNLKNESSDYTKPGDIDPTSVASPKDPEDIPTFDEWKKKVMEVEKEKSQSMHASSNGGSHATKKVQKNRNNYASVECGAKILAANPEAKSTSAILIENMDLYMLNPCSTKIWFVIELCEPIQVKQLDIANYELFSSTPKDFLVSISDRYPTNKWIKLGTFHGRDERNVQSFPLDEQMYAKYVKVELLSHFGSEHFCPLSLIRVFGTSMVEEYEEIADSQYHSERQELFDEDYDYPLDYNTGEDKSSKNLLGSATNAILNMVNIAANILGAKTEDLTEGNKSISENATATAAPKMPESTPVSTPVPSPEYVTTEVHTHDMEPSTPDTPKESPIVQLVQEEEEEASPSTVTLLGSGEQEDESSPWFESETQIFCSELTTICCISSFSEYIYKWCSVRVALYRQRSRTALSKGKDYLVLAQPPLLLPAESVDVSVLQPLSGELENTNIEREAETVVLGDLSSSMHQDDLVNHTVDAVELEPSHSQTLSQSLLLDITPEINPLPKIEVSESVEYEAGHIPSPVIPQESSVEIDNETEQKSESFSSIEKPSITYETNKVNELMDNIIKEDVNSMQIFTKLSETIVPPINTATVPDNEDGEAKMNIADTAKQTLISVVDSSSLPEVKEEEQSPEDALLRGLQRTATDFYAELQNSTDLGYANGNLVHGSNQKESVFMRLNNRIKALEVNMSLSGRYLEELSQRYRKQMEEMQKAFNKTIVKLQNTSRIAEEQDQRQTEAIQLLQAQLTNMTQLVSNLSATVAELKREVSDRQSYLVISLVLCVVLGLMLCMQRCRNTSQFDGDYISKLPKSNQYPSPKRCFSSYDDMNLKRRTSFPLMRSKSLQLTGKEVDPNDLYIVEPLKFSPEKKKKRCKYKIEKIETIKPEEPLHPIANGDIKGRKPFTNQRDFSNMGEVYHSSYKGPPSEGSSETSSQSEESYFCGISACTSLCNGQSQKTKTEKRALKRRRSKVQDQGKLIKTLIQTKSGSLPSLHDIIKGNKEITVGTFGVTAVSGHI

SEQ ID NO: 9094 - protein, 408 aa, Artificial Sequence
  Description of Artificial Sequence: Synthetic coding sequence
MPVISSRQDCDSATSTVTDILCAAEVKSSKGTEDRGRILGDSNLQVSKLLSQFPLKSTETSKVPDNKNVLDKTRVTKDFLQDNLFSGPGPKEPTGLSPFLLLPPRPPPARPDKLPELPAQKRQLPVFAKICSKPKADPAVERHHLMEWSPGTKEPKKGQGSLFLSQWPQSQKDACGEEGCCDAVGTASLTLPPKKPTCPAEKNLLYEFLGATKNPSGQPRLRNKVEVDGPELKFNAPVTVADKNNPKYTGNVFTPHFPTAMTSATLNQPLWLNLNYPPPPVFTNHSTFLQYQGLYPQQAARMPYQQALHPQLGCYSQQVMPYNPQQMGQQIFRSSYTPLLSYIPFVQPNYPYPQRTPPKMSANPRDPPLMAGDGPQYLFPQGYGFGSTSGGPLMHSPYFSSSGNGINF

SEQ ID NO: 9095 - protein, 598 aa, Artificial Sequence
  Description of Artificial Sequence: Synthetic coding sequence
MRGGGGCVLALGGQRGFQKERRRMASGNGLPSSSALVAKGPCALGPFPRYIWIHQDTPQDSLDKTCHEIWKRVQGLPEASQPWTSMEQLSVPVVGTLRGNELSFQEEALELSSGKDEISLLVEQEFLSLTKEHSILVEESSGELEVPGSSPEGTRELAPCILAPPLVAGSNERPRASIIVGDKLLKQKVAMPVISSRQDCDSATSTVTDILCAAEVKSSKGTEDRGRILGDSNLQVSKLLSQFPLKSTETSKVPDNKNVLDKTRVTKDFLQDNLFSGPGPKEPTGLSPFLLLPPRPPPARPDKLPELPAQKRQLPVFAKICSKPKADPAVERHHLMEWSPGTKEPKKGQGSLFLSQWPQSQKDACGEEGCCDAVGTASLTLPPKKPTCPAEKNLLYEFLGATKNPSGQPRLRNKVEVDGPELKFNAPVTVADKNNPKYTGNVFTPHFPTAMTSATLNQPLWLNLNYPPPPVFTNHSTFLQYQGLYPQQAARMPYQQALHPQLGCYSQQVMPYNPQQMGQQIFRSSYTPLLSYIPFVQPNYPYPQRTPPKMSANPRDPPLMAGDGPQYLFPQGYGFGSTSGGPLMHSPYFSSSGNGINF

SEQ ID NO: 9096 - protein, 141 aa, Artificial Sequence
  Description of Artificial Sequence: Synthetic coding sequence
MEPSHKDAETAAAAAAVAAADPRGASSSSGVVVQVREKKGPLRAAIPYMPFPVAVICLFLNTFVPGLGTFVSAFTVLCGARTDLPDRHVCCVFWLNIAAALIQILTAIVMVGWIMSIFWGMDMVILAISQGYKEQGIPQQL

SEQ ID NO: 9097 - protein, 141 aa, Artificial Sequence [sequence omitted]

SEQ ID NO: 9098 - protein, 212 aa, Artificial Sequence
  Description of Artificial Sequence: Synthetic coding sequence
MRSRLLLSVAHLPTIRETTEEMLLGGPGQEPPPSPSLDDYVRSISRLAQPTSVLDKATAQGQPRPPHRPAQACRKGRPAVSLRDITARFSGQQPTLPMADTVDPLDWLFGESQEKQPSQRDLPRRTGPSAGLWGPHRQMDSSKPMGAPRGRLCEARMPGHSLARPPQDGQQSSDLRSWTFGQSAQAMASRHRPRPSSVLRTLYSHLPVIHEL

SEQ ID NO: 9099 - protein, 127 aa, Artificial Sequence
  Description of Artificial Sequence: Synthetic coding sequence
MRSRLLLSVAHLPTIRETTEEMLLGGPGQEPPPSPSLDDYVRSISRLAQPTSVLDKATAQGQPRPPHRPAQACRKGRPAVSLLASGVHIDRWTAASPWGPPEGGSVKPGCLGIPWQDHRRMGSRALT

SEQ ID NO: 9100 - protein, 84 aa, Artificial Sequence
  Description of Artificial Sequence: Synthetic coding sequence
MRSRLLLSVAHLPTIRETTEEMLLGGPGQEPPPSPSLDDYVRSISRLAQPTSVLDKATAQGQPRPPHRPAQACRKGRPAVSLRD

SEQ ID NO: 9101 - protein, 167 aa, Artificial Sequence
  Description of Artificial Sequence: Synthetic coding sequence
LGLLVERQESEGLPRVRPPVHGRPQATAAGITGAMSTEGPSLASSPAISPLAFLSAPVTPGTLAEATDPLPMLIALACIFLLLATCLLFMTLCKPAALDPSRRRAHECMPHHPGSPSEPQLRLWKRLGSLRLSLHSFRHGRPTVPRQPLPGPEDNRSHCDYMESTKM

SEQ ID NO: 9102 - protein, 133 aa, Artificial Sequence
  Description of Artificial Sequence: Synthetic coding sequence
MSTEGPSLASSPAISPLAFLSAPVTPGTLAEATDPLPMLIALACIFLLLATCLLFMTLCKPAALDPSRRRAHECMPHHPGSPSEPQLRLWKRLGSLRLSLHSFRHGRPTVPRQPLPGPEDNRSHCDYMESTKM

SEQ ID NO: 9103 - protein, 133 aa, Artificial Sequence; identical to SEQ ID NO: 9102
  Description of Artificial Sequence: Synthetic coding sequence

SEQ ID NO: 9104 - protein, 155 aa, Artificial Sequence
  Description of Artificial Sequence: Synthetic coding sequence
MESLQTPQHRENQDKREKEYGVKHMPMGNNAGNLEPEKRKAVRVALSSATAAQNIPSSVHCGCSKQWRLRLPSESLQSRGQVMKRPNNILKLRNLDLLIYPWPELRRRQVASDLMSLLLLPAFSGLTWAPFLFLFTYLPPFLNLLTVGFVSYFLV

SEQ ID NO: 9105 - protein, 507 aa, Artificial Sequence
  Description of Artificial Sequence: Synthetic coding sequence
  MOD_RES (1)..(1): Any amino acid
XECPRGRSALLKGPPQEKPNRRSALLSVGEISELCPEITDFLCRDKKCIASHLLCDYKPDCSDRSDEAHCAHYTSTTGSCNFETSSGNWTTACSLTQDSEDDLDWAIGSRIPAKALIPDSDHTPGSGQHFLYVNSSGSKEGSVARITTSKSFPASLGMCTVRFWFYMIDPRSMGILKVYTIEESGLNILVWSVIGNKRTGWTYGSVPLSSNSPFKVAFEADLDGNEDIFIALDDISFTPECVTGGPVPVQPSPCEADQFSCIYTLQCVPLSGKCDGHEDCIDGSDEMDCPLSPTPPLCSNMEFPCSTDECIPSLLLCDGVPDCHFNEDELICSNKSCSNGALVCASSNSCIPAHQRCDGFADCMDFQLDESSCSECPLNYCRNGGTCVVEKNGPMCRCRQGWKGNRCHIKFNPPATDFTYAQNNTWTLLGIGLAFLMTHITVAVLCFLANRKVPIRKTEGSGNCAFVNPVYGNWSNPEKTESSVYSFSNPLYGTTSGSLETLSHHLK

SEQ ID NO: 9106 - protein, 1486 aa, Artificial Sequence
  Description of Artificial Sequence: Synthetic coding sequence
PRDHSLNASQGHFMFILKKSSSLWQVAKLQSPTFSQTGPGCILSFWFYNYGLSVGAAELQLHMENSHDSTVIWRVLYNQGKQWLEATIQLGRLSQPFHLSLDKVSLGIYDGVSAIDDIRFENCTLPLPAESCEGLDHFWCRHTRACIEKLRLCDLVDDCGDRTDEVNCAPELQCNFETGICNWEQDAKDDFDWTRSQGPTPTLNTGPMKDNTLGTAKGHYLYIESSEPQAFQDSAALLSPILNATDTKGCTFRFYYHMFGKRIYRLAIYQRIWSDSRGQLLWQIFGNQGNRWIRKHLNISSRQPFQILVEASVGDGFTGDIAIDDLSFMDCTLYPGNLPADLPTPPETSVPVTLPPHNCTDNEFICRSDGHCIEKMQKCDFKYDCPDKSDEASCVMEVCSFEKRSLCKWYQPIPVHLLQDSNTFRWGLGNGISIHHGEENHRPSVDHTQNTTDGWYLYADSSNGKFGDTADILTPIISLTGPKCTLVFWTHMNGATVGSLQVLIKKDNVTSKLWAQTGQQGAQWKRAEVFLGIRSHTQIVFRAKRGISYIGDVAVDDISFQDCSPLLSPERKCTDHEFMCANKHCIAKDKLCDFVNDCADNSDETTFICRTSSGRCDFEFDLCSWKQEKDEDFDWNLKASSIPAAGTEPAADHTLGNSSGHYIFIKSLFPQQPMRAARISSPVISKRSKNCKIIFHYHMYGNGIGALTLMQVSVTNQTKVLLNLTVEQGNFWRREELSLFGDEDFQLKFEGRVGKGQRGDIALDDIVLTENCLSLHDSVQEELAVPLPTGFCPLGYRECHNGKCYRLEQSCNFVDNCGDNTDENECGSSCTFEKGWCGWQNSQADNFDWVLGVGSHQSLRPPKDHTLGNENAILLMRRHKYPIRSVNLHTVKHVLKAQTVGNCSVSKLEARLLDFLSVPNENTFGSSDHTNWHFMYLEATAVGLRGDKAHFRSTMWRESSAACTMSFWYFVSAKATGSIQILIKRGRRRRRAPNPVLSGSPTIPRQGSQQLGGWRGGSARHRARAFPEPECPRGRSALLKGPPQEKPNRRSALLSVGEISELCPEITDFLCRDKKCIASHLLCDYKPDCSDRSDEAHCAHYTSTTGSCNFETSSGNWTTACSLTQDSEDDLDWAIGSRIPAKALIPDSDHTPGSGQHFLYVNSSGSKEGSVARITTSKSFPASLGMCTVRFWFYMIDPRSMGILKVYTIEESGLNILVWSVIGNKRTGWTYGSVPLSSNSPFKVAFEADLDGNEDIFIALDDISFTPECVTGGPVPVQPSPCEADQFSCIYTLQCVPLSGKCDGHEDCIDGSDEMDCPLSPTPPLCSNMEFPCSTDECIPSLLLCDGVPDCHFNEDELICSNKSCSNGALVCASSNSCIPAHQRCDGFADCMDFQLDESSCSDTWTLLGIGLAFLMTHITVAVLCFLANRKVPIRKTEGSGNCAFVNPVYGNWSNPEKTESSVYSFSNPLYGTTSGSLETLSHHLK

SEQ ID NO: 9107 - protein, 258 aa, Artificial Sequence
  Description of Artificial Sequence: Synthetic coding sequence
LKFEGRVGKGQRGDIALDDIVLTENCLSLHDSVQEELAVPLPTGFCPLGYRECHNGKCYRLEQSCNFVDNCGDNTDENECGSSCTFEKGWCGWQNSQADNFDWVLGVGSHQSLRPPKDHTLGNENGHFMYLEATAVGLRGDKAHFRSTMWRESSAACTMSFWYFVSAKATGSIQILIKTEKGLSKVWQESKQNPGNHWQKADILLGKLRNFEVIFQGIRTRDLGGGAAIDDIEFKNCTTVGEISELCPEITDFLCRDK

SEQ ID NO: 9108 - protein, 1473 aa, Artificial Sequence
  Description of Artificial Sequence: Synthetic coding sequence
MFILKKSSSLWQVAKLQSPTFSQTGPGCILSFWFYNYGLSVGAAELQLHMENSHDSTVIWRVLYNQGKQWLEATIQLGRLSQPFHLSLDKVSLGIYDGVSAIDDIRFENCTLPLPAESCEGLDHFWCRHTRACIEKLRLCDLVDDCGDRTDEVNCAPELQCNFETGICNWEQDAKDDFDWTRSQGPTPTLNTGPMKDNTLGTAKGHYLYIESSEPQAFQDSAALLSPILNATDTKGCTFRFYYHMFGKRIYRLAIYQRIWSDSRGQLLWQIFGNQGNRWIRKHLNISSRQPFQILVEASVGDGFTGDIAIDDLSFMDCTLYPGNLPADLPTPPETSVPVTLPPHNCTDNEFICRSDGHCIEKMQKCDFKYDCPDKSDEASCVMEVCSFEKRSLCKWYQPIPVHLLQDSNTFRWGLGNGISIHHGEENHRPSVDHTQNTTDGWYLYADSSNGKFGDTADILTPIISLTGPKCTLVFWTHMNGATVGSLQVLIKKDNVTSKLWAQTGQQGAQWKRAEVFLGIRSHTQIVFRAKRGISYIGDVAVDDISFQDCSPLLSPERKCTDHEFMCANKHCIAKDKLCDFVNDCADNSDETTFICRTSSGRCDFEFDLCSWKQEKDEDFDWNLKASSIPAAGTEPAADHTLGNSSGHYIFIKSLFPQQPMRAARISSPVISKRSKNCKIIFHYHMYGNGIGALTLMQVSVTNQTKVLLNLTVEQGNFWRREELSLFGDEDFQLKFEGRVGKGQRGDIALDDIVLTENCLSLHDSVQEELAVPLPTGFCPLGYRECHNGKCYRLEQSCNFVDNCGDNTDENECGSSCTFEKGWCGWQNSQADNFDWVLGVGSHQSLRPPKDHTLGNENAILLMRRHKYPIRSVNLHTVKHVLKAQTVGNCSVSKLEARLLDFLSVPNENTFGSSDHTNWHFMYLEATAVGLRGDKAHFRSTMWRESSAACTMSFWYFVSAKATGSIQILIKRGRRRRRAPNPVLSGSPTIPRQGSQQLGGWRGGSARHRARAFPEPECPRGRSALLKGPPQEKPNRRSALLSVGEISELCPEITDFLCRDKKCIASHLLCDYKPDCSDRSDEAHCAHYTSTTGSCNFETSSGNWTTACSLTQDSEDDLDWAIGSRIPAKALIPDSDHTPGSGQHFLYVNSSGSKEGSVARITTSKSFPASLGMCTVRFWFYMIDPRSMGILKVYTIEESGLNILVWSVIGNKRTGWTYGSVPLSSNSPFKVAFEADLDGNEDIFIALDDISFTPECVTGGPVPVQPSPCEADQFSCIYTLQCVPLSGKCDGHEDCIDGSDEMDCPLSPTPPLCSNMEFPCSTDECIPSLLLCDGVPDCHFNEDELICSNKSCSNGALVCASSNSCIPAHQRCDGFADCMDFQLDESSCSDTWTLLGIGLAFLMTHITVAVLCFLANRKVPIRKTEGSGNCAFVNPVYGNWSNPEKTESSVYSFSNPLYGTTSGSLETLSHHLK

SEQ ID NO: 9109 - protein, 350 aa, Artificial Sequence
  Description of Artificial Sequence: Synthetic coding sequence
MCTVRFWFYMIDPRSMGILKVYTIEESGLNILVWSVIGNKRTGWTYGSVPLSSNSPFKVAFEADLDGNEDIFIALDDISFTPECVTGGPVPVQPSPCEADQFSCIYTLQCVPLSGKCDGHEDCIDGSDEMDCPLSPTPPLCSNMEFPCSTDECIPSLLLCDGVPDCHFNEDELICSNKSCSNGALVCASSNSCIPAHQRCDGFADCMDFQLDESSCSECPLNYCRNGGTCVVEKNGPMCRCRQGWKGNRCHIKFNPPATDFTYAQNNTWTLLGIGLAFLMTHITVAVLCFLANRKVPIRKTEGSGNCAFVNPVYGNWSNPEKTESSVYSFSNPLYGTTSGSLETLSHHLK

SEQ ID NO: 9110 - protein, 105 aa, Artificial Sequence
  Description of Artificial Sequence: Synthetic coding sequence
MNLGVSMLRILFLLDVGGAQVLATGKTPGAEIDFKYALIGTAVGVAISAGFLALKICMIRRHLFDDDSSDLKSTPGGLSDTIPLKKRAPRRNHNFSKRDAQVIEL

SEQ ID NO: 9111 - protein, 480 aa, Artificial Sequence
  Description of Artificial Sequence: Synthetic coding sequence
MLGRFQPFSLVRSFRLGFEACCYPNQKCATQTIRPPDSRCLVQAVSQNFNFAKDVLDQWSQLEKDGLRGPYPALWKVSAKGEEDKWSFERMTQLSKKAASILSDTCALSHGDRLMIILPPTPEAYWICLACVRLGITFVPGSPQLTAKKIRYQLRMSKAQCIVANEAMAPVVNSAVSDCPTLKTKLLVSDKSYDGWLDFKKLIQVAPPKQTYMRTKSQDPMAIFFTKGTTGAPKMVEYSQYGLGMGFSQASRRWMDLQPTDVLWSLGDAFGGSLSLSAVLGTWFQGACVFLCHMPTFCPETVLNVLSRFPITTLSANPEMYQELLQHKCFTSYRFKSLKQCVAAGGPISPGVIEDWKRITKLDIYEGYGQTETGLLCATSKTIKLKPSSLGKPLPPYIVQIVDENSNLLPPGEEGNIAIRIKLNQPASLYCPHMVSWEEYASARGHMLYLTGDRGIMDEDGYFWWSGRVDDVANALGQRL

SEQ ID NO: 9112 - protein, 480 aa, Artificial Sequence; identical to SEQ ID NO: 9111
  Description of Artificial Sequence: Synthetic coding sequence

SEQ ID NO: 9113 - protein, 186 aa, Artificial Sequence
  Description of Artificial Sequence: Synthetic coding sequence
MSKAQCIVANEAMAPVVNSAVSDCPTLKTKLLVSDKSYDGWLDFKKLIQVAPPKQTYMRTKSQDPMAIFFTKGTTGAPKMVEYSQYGLGMGFSQASRRWMDLQPTDVLWSLGDAFGGSLSLSAVLGTWFQGACVFLCHMPTFCPETVLNVLSRFPITTLSANPEMYQELLQHKCFTRVYSVPLPKQ

SEQ ID NO: 9114 - protein, 506 aa, Artificial Sequence
  Description of Artificial Sequence: Synthetic coding sequence
MLGRFQPFSLVRSFRLGFEACCYPNQKCATQTIRPPDSRCLVQAVSQNFNFAKDVLDQWSQLEKDNGLQLHPCCCKRQDFILFHGCLFYIDGLRGPYPALWKVSAKGEEDKWSFERMTQLSKKAASILSDTCALSHGDRLMIILPPTPEAYWICLACVRLGITFVPGSPQLTAKKIRYQLRMSKAQCIVANEAMAPVVNSAVSDCPTLKTKLLVSDKSYDGWLDFKKLIQVAPPKQTYMRTKSQDPMAIFFTKGTTGAPKMVEYSQYGLGMGFSQASRRWMDLQPTDVLWSLGDAFGGSLSLSAVLGTWFQGACVFLCHMPTFCPETVLNVLSRFPITTLSANPEMYQELLQHKCFTSYRFKSLKQCVAAGGPISPGVIEDWKRITKLDIYEGYGQTETGLLCATSKTIKLKPSSLGKPLPPYIVQIVDENSNLLPPGEEGNIAIRIKLNQPASLYCPHMVSWEEYASARGHMLYLTGDRGIMDEDGYFWWSGRVDDVANALGQRL

SEQ ID NO: 9115 - protein, 121 aa, Artificial Sequence
  Description of Artificial Sequence: Synthetic coding sequence
MVRILANGEIVQDDDPRVRTTTQPPRGSIPRQSFFNRGHGAPPGGPGPRQQQAGARLGAAQSPFNDLNRQLVNMGFPQWHLGNHAVEPVTSILLLFLLMMLGVRGLLLVGLVYLVSHLSQR

SEQ ID NO: 9116 - protein, 103 aa, Artificial Sequence
  Description of Artificial Sequence: Synthetic coding sequence
MSPVLSGIHSIYSAWVTSVNITDCKPPSISGAAHQGPTAPGRMVRILANGEIVQDDDPRVRTTTQPPRGSIPRQSFFNRGHGAPPGGPGPRQQQAGARLGAAQ

SEQ ID NO: 9117 - protein, 307 aa, Artificial Sequence
  Description of Artificial Sequence: Synthetic coding sequence
ASPRRPRPARSPAPEVPLRVRRRHGRPHGPGGRQLALGIPALRSLPGCVPRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQDSENITAAALATGACIVGILCLPLILLLVYKQRQAASNRLAQELLAQDSNIQGIENPGFEASPPAQGIPEAKVRHPLSYVAQRQPSESGRHLLSEPSTPLSPPGPGDVFFPSLDPVPDSPNFEVI

SEQ ID NO: 9118 - protein, 311 aa, Artificial Sequence
  Description of Artificial Sequence: Synthetic coding sequence
MGVPTALEAGSWRWGSLLFALFLAASLGPVAAFKVATPYSLYVCPEGQNVTLTCRLLGPVDKGHDVTFYKTWYRSSRGEVQTCSERRPIRNLTFQDLHLHHGGHQAANTSHDLAQRHGLESASDHHGNFSITMRNLTLLDSGLYCCLVVEIRHHHSEHRVHGAMELQVQTGKDAPSNCVVYPSSSQDSENITAAALATGACIVGILCLPLILLLVYKQRQAASNRRAQELVRMDSNIQGIENPGFEASPPAQGIPEAKVRHPLSYVAQRQPSESGRHLLSEPSTPLSPPGPGDVFFPSLDPVPDSPNFEVI

SEQ ID NO: 9119 - protein, 144 aa, Artificial Sequence
  Description of Artificial Sequence: Synthetic coding sequence
  MOD_RES (1)..(1): Any amino acid
XTAGELPANSVSGFFKRMVKSEASNAATAYFRPARPLPSLVTVLGLGYFAWVVFWPQSIPYQNLGPLGPFTQYLVDHHHTLLCNGYWLAWLIHVGESLYAIVLCKHKGITSGRAQLLWFLQTFFFGIASLTILIAYKRKRQKQT

SEQ ID NO: 9120 - protein, 103 aa, Artificial Sequence
  Description of Artificial Sequence: Synthetic coding sequence
MATAAGATYFQRGSLFWFTVITLSFGYYTWVVFWPQSIPYQNLGPLGPFTQYLVDHHHTLLCNGYWLAWLIHVGESLYAIVLCKQNELRIRIKMRKLILRDSE

SEQ ID NO: 9121 - protein, 84 aa, Artificial Sequence
  Description of Artificial Sequence: Synthetic coding sequence
MATAAGATYFQRGSLFWFTVITLSFGYYTWVVFWPQSIPYQNLGPLGPFTQYLVDHHHTLLCNGYWLAWLIHVGESLYAIVLCK

SEQ ID NO: 9122 - protein, 103 aa, Artificial Sequence; identical to SEQ ID NO: 9120
  Description of Artificial Sequence: Synthetic coding sequence

SEQ ID NO: 9123 - protein, 123 aa, Artificial Sequence
  Description of Artificial Sequence: Synthetic coding sequence
MATAAGATYFQRGSLFWFTVITLSFGYYTWVVFWPQSIPYQNLGPLGPFTQYLVDHHHTLLCNGYWLAWLIHVGESLYAIVLCKHKGITSGRAQLLWFLQTFFFGIASLTILIAYKRKRQKQT

SEQ ID NO: 9124 - protein, 101 aa, Artificial Sequence
  Description of Artificial Sequence: Synthetic coding sequence
  MOD_RES (1)..(1): Any amino acid
XEFLRSVWVVFWPQSIPYQNLGPLGPFTQYLVDHHHTLLCNGYWLAWLIHVGESLYAIVLCKHKGITSGRAQLLWFLQTFFFGIASLTILIAYKRKRQKQT

SEQ ID NO: 9125 - protein, 94 aa, Artificial Sequence
  Description of Artificial Sequence: Synthetic coding sequence
SVELPLDADVQTSNLLITFLKYSSIVMQDTKDEHRLHSGKLCLIILTCIAEPMRHRKKAADKNLPCRPLVCAVLDLMVEFIVTHMMKEFPMDLY

SEQ ID NO: 9126 - protein, 198 aa, Artificial Sequence
  Description of Artificial Sequence: Synthetic coding sequence
MAQVEKRGGLLRKSSASKKPLKEKVVLMYDEIFMTEDPSKCSPRFWEELFLMKVNLEYLEGKLESLDGEELMKIKDNINCLFQHCIQALGEEHPIRVVNALQTLCALIRGVHQKNKSTSGFDIINMLMGFDKAELCMKVRHKLQMCLWMAASDSCSWTLSADKCTQRFGLRKIQMIEFGLAFRCFYFTDLLYLNKGKF

SEQ ID NO: 9127 - protein, 689 aa, Artificial Sequence
  Description of Artificial Sequence: Synthetic coding sequence
MAQVEKRGGLLRKSSASKKPLKEKVVLMYDEIFMTEDPSKCSPRFWEELFLMKVNLEYLEGKLESLDGEELMKIKDNINCLFQHCIQALGEEHPIRVVNALQTLCALIRGVHQKNKSTSGFDIINMLMGFDKAELCMKNLMESLDSLLCAEGSESLKSLCLKLLLCLVTVTDNISQNTILEYVMINSIFEAILQILSHPPSRREHGYDAVVLLALLVNYRKYESVNPYIVKLSIVDDEATLNGMGLVIAQALSEYNRQYKDKEEEHQSGFFSALTNMVGSMFIADAHEKISVQTNEAILLALYEAVHLNRNFITVLAQSHPEMGLVTTPVSPAPTTPVTPLGTTPPSSDVISSVELPLDADVQTSNLLITFLKYSSIVMQDTKDEHRLHSGKLCLIILTCIAEDQYANAFLHDDNMNFRVNLHRMPMRHRKKAADKNLPCRPLVCAVLDLMVEFIVTHMMKEFPMDLYIRCIQVVHKLLCYQKKCRVRLHYTWRELWSALINLLKFLMSNETVLLAKHNIFTLALMIVNLFNMFITYGDTFLPTPSSYDELYYEIIRMHQSFDNLYSMVLRLSTNAGQWKEAASKVTHALVNIRAIINHFNPKIESYAAVNHISQLSEEQVLEVVRANYDTLTLKLQDGLDQYERYSEQHKEAAFFKELVRSISTNVRRNLAFHTLSQEVLLKEFSTIS

SEQ ID NO: 9128 - protein, 94 aa, Artificial Sequence; identical to SEQ ID NO: 9125
  Description of Artificial Sequence: Synthetic coding sequence

SEQ ID NO: 9129 - protein, 79 aa, Artificial Sequence
  Description of Artificial Sequence: Synthetic coding sequence
MELEAMSRYTSPVNPAVFPHLTVVLLAIGMFFTAWFFVYEVTSTKYTRDIYKELLISLVASLFMGFGVLFLLLWVGIYV

SEQ ID NO: 9130 - protein, 79 aa, Artificial Sequence; identical to SEQ ID NO: 9129
  Description of Artificial Sequence: Synthetic coding sequence

SEQ ID NO: 9131 - protein, 782 aa, Artificial Sequence
  Description of Artificial Sequence: Synthetic coding sequence
MAAAAAAGPSPGSGPGDSPEGPEGEAPERRRKAHGMLKLYYGLSEGEAAGRPAGPDPLDPTDLNGAHFDPEVYLDKLRRECPLAQLMDSETDMVRQIRALDSDMQTLVYENYNKFISATDTIRKMKNDFRKMEDEMDRLATNMAVITDFSARISATLQDRHERITKLAGVHALLRKLQFLFELPSRLTKCVELGAYGQAVRYQGRAQAVLQQYQHLPSFRAIQDDCQVITARLAQQLRQRFREGGSGAPEQAECVELLLALGEPAEELCEEFLAHARGRLEKELRNLEAELGPSPPAPDVLEFTDHGGSGFVGGLCQVAAAYQELFAAQGPAGAEKLAAFARQLGSRYFALVERRLAQEQGGGDNSLLVRALDRFHRRLRAPGALLAAAGLADAATEIVERVARERLGHHLQGLRAAFLGCLTDVRQALAAPRVAGKEGPGLAELLANVASSILSHIKASLAAVHLFTAKEVSFSNKPYFRGEFCSQGVREGLIVGFVHSMCQTAQSFCDSPGEKGGATPPALLLLLSRLCLDYETATISYILTLTDEQFLVQDQFPVTPVSTLCAEARETARRLLTHYVKVQGLVISQMLRKSVETRDWLSTLEPRNVRAVMKRVVEDTTAIDVQVGLLYEEGVRKAQSSDSSKRTFSVYSSSRQQGRYAPSYTPSAPMDTNLLSNIQKLFSERIDVFSPVEFNKVSVLTGIIKISLKTLLECVRLRTFGRFGLQQVQVDCHFLQLYLWRFVADEELVHLLLDEVVASAALRCPDPVPMEPSVVEVICERG

SEQ ID NO: 9132 - protein, 197 aa, Artificial Sequence
  Description of Artificial Sequence: Synthetic coding sequence
MSARAPKELRLALPPCLLNRTFASPNASGSGNTGARGPGAVGSGTCITQVGQQLFQSFSSTLVLIVLVTLIFCLIVLSLSTFHIHKRRMKKRKMQRAQEEYERDHCSGSRGGGGLPRPGRQAPTHAKETRLERQPRDSPFCAPSNASSLSSSSPGLPCQGPCAPPPPPPASSPQGAHAASSCLDTAGEGLLQTVVLS

SEQ ID NO: 9133 - protein, 376 aa, Artificial Sequence
  Description of Artificial Sequence: Synthetic coding sequence
MGHQFLRGLLTLLLPPPPLYTRHRMLGPESVPPPKRSRSKLMAPPRIGTHNGTFHCDEALACALLRLLPEYRDAEIVRTRDPEKLASCDIVVDVGGEYDPRRHRYDHHQRSFTETMSSLSPGKPWQTKLSSAGLIYLHFGHKLLAQLLGTSEEDSMVGTLYDKMYENFVEEVDAVDNGISQWAEGEPRYALTTTLSARVARLNPTWNHPDQDTEAGFKRAMDLVQEEFLQRLDFYQHSWLPARALVEEALAQRFQVDPSGEIVELAKGACPWKEHLYHLESGLSPPVAIFFVIYTDQAGQWRIQCVPKEPHSFQSRLPLPEPWRGLRDEALDQVSGIPGCIFVHASGFTGGHHTREGALSMARATLAQRSYLPQIS

SEQ ID NO: 9134 - protein, 325 aa, Artificial Sequence
  Description of Artificial Sequence: Synthetic coding sequence
MGHQFLRGLLTLLLPPPPLYTRHRMLGPESVPPPKRSRSKLMAPPRIGTHNGTFHCDEALACALLRLLPEYRDAEIVRTRDPEKLASCDIVVDVGGEYDPRRHRYDHHQRSFTETMSSLSPGKPWQTKLSSAGLIYLHFGHKLLAQLLGTSEEDSMVGTLYDKAGFKRAMDLVQEEFLQRLDFYQHSWLPARALVEEALAQRFQVDPSGEIVELAKGACPWKEHLYHLESGLSPPVAIFFVIYTDQAGQWRIQCVPKEPHSFQSRLPLPEPWRGLRDEALDQVSGIPGCIFVHASGFTGGHHTREGALSMARATLAQRSYLPQIS

SEQ ID NO: 9135 - protein, 116 aa, Artificial Sequence
  Description of Artificial Sequence: Synthetic coding sequence
MNQTDKNQQEIPSYLNDEPPEGSMKDHPQQQPGMLSRVTGGIFSVTKGAVGATIGGVAWIGGKSLEVTKTAVTTVPSMGIGLVKGGVSAVAGGVTAVGSAVVNKVPLTGKKKDKSD

SEQ ID NO: 9136 - protein, 116 aa, Artificial Sequence; identical to SEQ ID NO: 9135
  Description of Artificial Sequence: Synthetic coding sequence

SEQ ID NO: 9137 - protein, 116 aa, Artificial Sequence; identical to SEQ ID NO: 9135
  Description of Artificial Sequence: Synthetic coding sequence

SEQ ID NO: 9138 - protein, 116 aa, Artificial Sequence; identical to SEQ ID NO: 9135
  Description of Artificial Sequence: Synthetic coding sequence

SEQ ID NO: 9139 - protein, 116 aa, Artificial Sequence; identical to SEQ ID NO: 9135
  Description of Artificial Sequence: Synthetic coding sequence

SEQ ID NO: 9140 - protein, 116 aa, Artificial Sequence; identical to SEQ ID NO: 9135
  Description of Artificial Sequence: Synthetic coding sequence

SEQ ID NO: 9141 - protein, 4246 aa, Artificial Sequence
  Description of Artificial Sequence: Synthetic coding sequence
MGLLLVFPLIQSQSRTDPSLCNITAEVLLNCLRDCQPLSLTKEPADCLNGIETLLCSWLEETSDTGRHIPHKQKENAAAALVALACARGSLKTFVHTVHLLQKQTDLGSLPVADVLYRLLLLEGGPGSPSCLLGGKHIVSWGYEDMLPAPDSNTGSSSENKDADLGRCLTADGLYLYTTNSVGRGVSKLGSGLHGTLRGFVYCRNEELEPGWVAFGSGSLLHRPVSFDNKPHSLFQVIDQNTLQVCQVVPMPANHLPIGSTMSTVHLSSDGTYFYWIWSPASLNEKTPKGHSVFMDIFELVVENGVFVANPLQERTILMRKEGESAKSINEMLLSRLSRYRASPSATLAALTGSTISNTLKEDQAANTSCGLPLKMLRKTPIYTCGTYLVMLVPPPGGSGSSATRSLFGGTSGLSSLKRACYDTVNNMLWTCSNDYIDQWCNPGNQAFHYVCQRLGVSHIITEPKEEAITTNEVINQLLHHVGAMCIHQLNLLATNPNLPITSVLGKQHPIEAHHLSSICDIMEKAMVNGDTCIIRCILVVFQVVFKFFFSPQTERNRDIIRRSGLLLWQLLMAPKDQICPEIQKEVCLAISSGLNILYPGETEINNLLKLVLTEGERNSGLSQLRDVILTNLAEQLQNNRFGSDEDDHYRLNDELLHYILKIVVRESCILITKCQTVSKDDFQKLLSTVPAASSCLRYLMAVQNHLLSNTILIKPDENDDSDSSLQGETLKVQELKVSILALATQILTGCDEVLEMLQQVTTALINSDIADREQRLKGLEQVTKATMLGHLLPVLLTSLMHPNLQTLIMADALMPQLVQLVLYTSQTALLLKTQCPVFAEVGCSPCGAPDQKCRLFPDERMLEEKEEPGFLTGLKIPAPWAAGKTVETVHPVRDNYKFKETVHIPGARCLYLRFDSRCSSQYDYDKLVIYAGPNTNSRKVAEYGGNTLGYGSRSVLGTGWPKDLVKCISPPSLNFKVEGDTVTFSFEMRSGREHNTPDKAMWGFACTVRAQESSEDVSGGLPFLVDLALGLSVLACSMLRILYNGPEITKEEEACQELLRSKLLQRCQWQVEANGVISPALTPSPSPLPLTIEEDREFTYPSDVLVPPVGNYFDLPRIRLPPGIMIKLREISGRARPQFRPSIKEVIQPDVMEEMVVSCVIKHLNLVDALQSLINFQYQEEHAEEYDLLCKIMGETFKKLNAMERQLQSVAELEQKWQSEVDDAMQGKLENNMPFFYDYHFNENKMKELELLCSMKEVSFDGNDLENMVLSLREKFLQEVNSLIQKPSHPLAKTKTLVKSLMNRAELLLHVTIAAQSGLTRSISGTPAETPACKSASETKVISHAVRQPVFLRSMSAPSDLEMIGNEDLEFTRANQRRRHVTSHRSSSFTLLQSLAIEDSRDKPTYSVLLGQLFAFIGTNPDQAVSSSSFLLAAQTRWRRGNTRKQALVHMRELLTAAVRVGGVTHLVGPVTMVLQGGPRIEELTCGGMVEQVQEAFGETMTSVVSLCARYPIACANSIGLLCTIPYTRSEEKCLVRSGLVQLMDRLCSLSNQTESSSSEKQTKKQKVATMAWAAFQVLANRCVEWEKEEGGSTEAVHSGLARQVSSLLTNHLARATECCGNQAAGNDALQDVLSLLNDLSRSHIGKAILSQPACVSKLLSLLLDQRPSPKLVLIILQLCRAALPLMSVEDCGNVELPPWSYSVPSLNSEQEDPSDPASKIASLLLAKLADYVVPGCQTVLSPTASEPDTTLTKTSPKNSLKGDKDPGEESEAVDGKLSIFIHKREDQSSHEVLQPLLSSSEGRPFRLGTGANMEKVVKMDRDMTKGGCCEVITEEAAAALRKATKWAQSGLIVSIGPPVESINPETVSGLSTGDKKKTAQTSICRERNSELARTDPVRPFISGHVANSMAAEVIALLHSLLMAPESNAAQIWTTTAEKVLSRALMYIPQLGKYAESILENGSSSGRKLAKLQRIARQAVAALCALGGFKETIKIGSEVQVLGRGISGSIGVVASINEQEGIATVRFPPIDCRKTSQASDTLTIPLSRLCVPRSEALPLHKLSITEKVVQAVQSMLLPQEGSLSIHTSLPATGDGSAPVMAVVRLLAEIRTRACLVMAQLLEDSLFCEEFIQQCPAAVEVLNLVAQECSAGERLAVVEVQCERLRMLYRDCARPPPPPLQADRRQPKEITWSPSRVFPPVRACMFSSHLTSVTFLADPSAGGGLPRGTFIYATSPLPVQAPSFYWEIEIVSYGDTDDDTGPIVSFGFTTEAEKRDGAWTNPVGTCLFHNNGRAVHYNGSSLLQWKSVRLDVTLSPGDVAGIGWERTEGTPPPPGQPAKGRVYFTYCGQRLSPYLEDVSGGMWPVVHIQKKNTKTRANFGSRPFAYAEGQAHRNAADLCTDLAEEISANFEALPFAMASDSDNDAGTSIASDPGTHGPPCRIAAVATAQQQYDSDTSCHYKVELSYENFITSGPDPHPPPIADDESDDDDDDDIPQEDHYALLVKAWETKVFPTIRRRFRNEAERKSGLDQIKGALQLGMVDIARQTVEFLYEENGGIPRDLYLPTIEDIKDEANKFTIDKVRKGLTVVTRSPDSNNVASSAVGTALPKFAIRGMLKTFGLHGVVLDVDSVNELVQVETYLRSEGVLVRYWYPIDMLERPPAGYRRTATNGLVTLDNTNLQIHRELLRCEAALARLYCRMALLNIFAPKLPHLFTRLFHIPAIRDITLEHLQLLSNQLLAPPLPDGTISSSSILLAQSLQHCIHSQNCSATDLFYQGNSQTVREWLNVAITRTLHQGEESLLELTKQICSFLQTAPEQFPSEEFPISESKVNMDVNFPGAAFVVVSCKESQSGFRKDSSLYKAPWARVLVYGLGHKVKRNGQLNLIEAACYPRDASPANTGLAPPPTADQYPSVVLSTDRVHIKLGVSPPPGAVLVLHSLPLEFPLAMAFAEQLLSWKSEDSEGKSEDEPDTIPTSVLLQVVELLGNFLWTTDMAACVKELVFHLLAELLRTVHTLEQRRHPAGLSSSIALQLNPCLAMLMALQSELHKLYDEETQNWVSGGACGGSGGAAAGDQGRFSTYFHALMEGCLAVAEVTLPTNMSVTASGVTSATAPNLSDSSSSSSSSPGQTPQSPSLLSKRKKVKMKREKASSSGKRQSSRTVDSDPTVLSIGGSKPEDMLWFHRALTLLIILRHLTRKDPQGLGVTSDAIADACQALVGPTAHSRLLVISGIPTHLDEGVVRGAIRKACNAHGGVFKDEIYIPLQEEDTKKPKDKAEGGDGKVEPEKTLAFPGTDSMEVSTSSSLTPAMSISASASTSQASICSSQGISQTVSDLSVDPLPAGLELPIPPGLLEPHAVSSQESLDISLCSTGSLGSLGSLGEPLDNAETASVSDMGSMYTVTSLDNQPLAARPIKGFAVVEIRSRAKIEKIRASLFNNNDLIGLSSLDGEDELMEMSTEEILTVSVVNQSLFDTQGSPGLEDYFNDKSIKGEKLVPGAREVLTEIFKSCAHSEQTLSLTPAKPIRVSDIYLSKEQINSQTPGNLLHLFFTNVRPPKKVLEDQLTQILRKYGVPKPKFDKSKYSKAGKEQHPVKVVSTKRPITKPPAKDKAVLNSVSRTALSEKKPTVKPKSPEKSKPDEKDPEKSPTKKQEVPEEKYLTLEGFHKFVIDRARQDIRSVWRAILSCGYDLHFERCACIDVRHAQKASRKWTLEMDVALVQYINQLCRHLAITPARLHPHEVYLDPADAADPRVACLLNVPIESLRLRFALLQSLNTTLETFFLPLVELRQTPMYTHSIAALLKEAKGLIFYDTKVTVMNRVLNATVQRTADHAAPEITLDPLEIVGGEIRASENSYFCQAARQLASVPSSQLCVKLASGGDPTYAFNIRFTGEEVHGTSGSFRHFLWQVCKELQSSSLSLLLLCPSSAVNKNKGKYILTPSPITYGEEQLLHFLGQLLGIAIRADVPLPLDLLPSFWKTLVGEPLDPEQDLQEADILTYNYVKKFESINDETELEALCAEIASQHLATESPDSPNKPCCRFTYLTMTGEEVELCSRGRHILVAWENKDIYAAAIRSLRLRELQNVECVTAVRAGLGSIIPLQLLTMLSPLEMELRTCGLPYINLEFLKAHTMYQVGLMETDQHIEFFWGALEMFTQEELCKFIKFACNQERIPFTCPCKDGGPDTAHVPPYPMKIAPPDGTAGSPDSRYIRVETCMFMIKLPQYSSLEIMLEKLRCAIHYREDPLSG

SEQ ID NO: 9142 - protein, 3996 aa, Artificial Sequence
  Description of Artificial Sequence: Synthetic coding sequence
MPANHLPIGSTMSTVHLSSDGTYFYWIWSPASLNEKTPKGHSVFMDIFELVVENGVFVANPLQERTILMRKEGESAKSINEMLLSRLSRYRASPSATLAALTGSTISNTLKEDQAANTSCGLPLKMLRKTPIYTCGTYLVMLVPPPGGSGSSATRSLFGGTSGLSSLKRACYDTVNNMLWTCSNDYIDQWCNPGNQAFHYVCQRLGVSHIITEPKEEAITTNEVINQLLHHVGAMCIHQLNLLATNPNLPITSVLGKQHPIEAHHLSSICDIMEKAMVNGDTCIIRCILVVFQVVFKFFFSPQTERNRDIIRRSGLLLWQLLMAPKDQICPEIQKEVCLAISSGLNILYPGETEINNLLKLVLTEGERNSGLSQLRDVILTNLAEQLQNNRFGSDEDDHYRLNDELLHYILKIVVRESCILITKCQTVSKDDFQKLLSTVPAASSCLRYLMAVQNHLLSNTILIKPDENDDSDSSLQGETLKVQELKVSILALATQILTGCDEVLEMLQQVTTALINSDIADREQRLKGLEQVTKATMLGHLLPVLLTSLMHPNLQTLIMADALMPQLVQLVLYTSQTALLLKTQCPVFAEVGCSPCGAPDQKCRLFPDERMLEEKEEPGFLTGLKIPAPWAAGKTVETVHPVRDNYKFKETVHIPGARCLYLRFDSRCSSQYDYDKLVIYAGPNTNSRKVAEYGGNTLGYGSRSVLGTGWPKDLVKCISPPSLNFKVEGDTVTFSFEMRSGREHNTPDKAMWGFACTVRAQESSEDVSGGLPFLVDLALGLSVLACSMLRILYNGPEITKEEEACQELLRSKLLQRCQWQVEANGVISPALTPSPSPLPLTIEEDREFTYPSDVLVPPVGNYFDLPRIRLPPGIMIKLREISGRARPQFRPSIKEVIQPDVMEEMVVSCVIKHLNLVDALQSLINFQYQEEHAEEYDLLCKIMGETFKKLNAMERQLQSVAELEQKWQSEVDDAMQGKLENNMPFFYDYHFNENKMKELELLCSMKEVSFDGNDLENMVLSLREKFLQEVNSLIQKPSHPLAKTKTLVKSLMNRAELLLHVTIAAQSGLTRSISGTPAETPACKSASETKVISHAVRQPVFLRSMSAPSDLEMIGNEDLEFTRANQRRRHVTSHRSSSFTLLQSLAIEDSRDKPTYSVLLGQLFAFIGTNPDQAVSSSSFLLAAQTRWRRGNTRKQALVHMRELLTAAVRVGGVTHLVGPVTMVLQGGPRIEELTCGGMVEQVQEAFGETMTSVVSLCARYPIACANSIGLLCTIPYTRSEEKCLVRSGLVQLMDRLCSLSNQTESSSSEKQTKKQKVATMAWAAFQVLANRCVEWEKEEGGSTEAVHSGLARQVSSLLTNHLARATECCGNQAAGNDALQDVLSLLNDLSRSHIGKAILSQPACVSKLLSLLLDQRPSPKLVLIILQLCRAALPLMSVEDCGNVELPPWSYSVPSLNSEQEDPSDPASKIASLLLAKLADYVVPGCQTVLSPTASEPDTTLTKTSPKNSLKGDKDPGEESEAVDGKLSIFIHKREDQSSHEVLQPLLSSSEGRPFRLGTGANMEKVVKMDRDMTKGGCCEVITEEAAAALRKATKWAQSGLIVSIGPPVESINPETVSGLSTGDKKKTAQTSICRERNSELARTDPVRPFISGHVANSMAAEVIALLHSLLMAPESNAAQIWTTTAEKVLSRALMYIPQLGKYAESILENGSSSGRKLAKLQRIARQAVAALCALGGFKETIKIGSEVQVLGRGISGSIGVVASINEQEGIATVRFPPIDCRKTSQASDTLTIPLSRLCVPRSEALPLHKLSITEKVVQAVQSMLLPQEGSLSIHTSLPATGDGSAPVMAVVRLLAEIRTRACLVMAQLLEDSLFCEEFIQQCPAAVEVLNLVAQECSAGERLAVVEVQCERLRMLYRDCARPPPPPLQADRRQPKEITWSPSRVFPPVRACMFSSHLTSVTFLADPSAGGGLPRGTFIYATSPLPVQAPSFYWEIEIVSYGDTDDDTGPIVSFGFTTEAEKRDGAWTNPVGTCLFHNNGRAVHYNGSSLLQWKSVRLDVTLSPGDVAGIGWERTEGTPPPPGQPAKGRVYFTYCGQRLSPYLEDVSGGMWPVVHIQKKNTKTRANFGSRPFAYAEGQAHRNAADLCTDLAEEISANFEALPFAMASDSDNDAGTSIASDPGTHGPPCRIAAVATAQQQYDSDTSCHYKVELSYENFITSGPDPHPPPIADDESDDDDDDDIPQEDHYALLVKAWETKVFPTIRRRFRNEAERKSGLDQIKGALQLGMVDIARQTVEFLYEENGGIPRDLYLPTIEDIKDEANKFTIDKVRKGLTVVTRSPDSNNVASSAVGTALPKFAIRGMLKTFGLHGVVLDVDSVNELVQVETYLRSEGVLVRYWYPIDMLERPPAGYRRTATNGLVTLDNTNLQIHRELLRCEAALARLYCRMALLNIFAPKLPHLFTRLFHIPAIRDITLEHLQLLSNQLLAPPLPDGTISSSSILLAQSLQHCIHSQNCSATDLFYQGNSQTVREWLNVAITRTLHQGEESLLELTKQICSFLQTAPEQFPSEEFPISESKVNMDVNFPGAAFVVVSCKESQSGFRKDSSLYKAPWARVLVYGLGHKVKRNGQLNLIEAACYPRDASPANTGLAPPPTADQYPSVVLSTDRVHIKLGVSPPPGAVLVLHSLPLEFPLAMAFAEQLLSWKSEDSEGKSEDEPDTIPTSVLLQVVELLGNFLWTTDMAACVKELVFHLLAELLRTVHTLEQRRHPAGLSSSIALQLNPCLAMLMALQSELHKLYDEETQNWVSGGACGGSGGAAAGDQGRFSTYFHALMEGCLAVAEVTLPTNMSVTASGVTSATAPNLSDSSSSSSSSPGQTPQSPSLLSKRKKVKMKREKASSSGKRQSSRTVDSDPTVLSIGGSKPEDMLWFHRALTLLIILRHLTRKDPQGLGVTSDAIADACQALVGPTAHSRLLVISGIPTHLDEGVVRGAIRKACNAHGGVFKDEIYIPLQEEDTKKPKDKAEGGDGKVEPEKTLAFPGTDSMEVSTSSSLTPAMSISASASTSQASICSSQGISQTVSDLSVDPLPAGLELPIPPGLLEPHAVSSQESLDISLCSTGSLGSLGSLGEPLDNAETASVSDMGSMYTVTSLDNQPLAARPIKGFAVVEIRSRAKIEKIRASLFNNNDLIGLSSLDGEDELMEMSTEEILTVSVVNQSLFDTQGSPGLEDYFNDKSIKGEKLVPGAREVLTEIFKSCAHSEQTLSLTPAKPIRVSDIYLSKEQINSQTPGNLLHLFFTNVRPPKKVLEDQLTQILRKYGVPKPKFDKSKYSKAGKEQHPVKVVSTKRPITKPPAKDKAVLNSVSRTALSEKKPTVKPKSPEKSKPDEKDPEKSPTKKQEVPEEKYLTLEGFHKFVIDRARQDIRSVWRAILSCGYDLHFERCACIDVRHAQKASRKWTLEMDVALVQYINQLCRHLAITPARLHPHEVYLDPADAADPRVACLLNVPIESLRLRFALLQSLNTTLETFFLPLVELRQTPMYTHSIAALLKEAKGLIFYDTKVTVMNRVLNATVQRTADHAAPEITLDPLEIVGGEIRASENSYFCQAARQLASVPSSQLCVKLASGGDPTYAFNIRFTGEEVHGTSGSFRHFLWQVCKELQSSSLSLLLLCPSSAVNKNKGKYILTPSPITYGEEQLLHFLGQLLGIAIRADVPLPLDLLPSFWKTLVGEPLDPEQDLQEADILTYNYVKKFESINDETELEALCAEIASQHLATESPDSPNKPCCRFTYLTMTGEEVELCSRGRHILVAWENKDIYAAAIRSLRLRELQNVECVTAVRAGLGSIIPLQLLTMLSPLEMELRTCGLPYINLEFLKAHTMYQVGLMETDQHIEFFWGALEMFTQEELCKFIKFACNQERIPFTCPCKDGGPDTAHVPPYPMKIAPPDGTAGSPDSRYIRVETCMFMIKLPQYSSLEIMLEKLRCAIHYREDPLSG

SEQ ID NO: 9143 - protein, 282 aa, Artificial Sequence
  Description of Artificial Sequence: Synthetic coding sequence
MESRMWPALLLSHLLPLWPLLLLPLPPPAQGSSSSPRTPPAPARPPCARGGPSAPRHVCVWERAPPPSRSPRVPRSRRQVLPGTAPPATPSGFEEGPPSSQYPWAIVWGPTVSREDGGDPNSANPGFLDYGFAAPHGLATPHPNSDSMRGDGDGLILGEAPATLRPFLFGGRGEGVDPQLYVTITISIIIVLVATGIIFKFCWDRSQKRRRPSGQQGALRQEESQQPLTDLSPAGVTVLGAFGDSPTPTPDHEEPRGGPRPGMPHPKGAPAFQLNRIPLVNL

SEQ ID NO: 9144 - protein, 256 aa, Artificial Sequence
  Description of Artificial Sequence: Synthetic coding sequence
MESRMWPALLLSHLLPLWPLLLLPLPPAPRHVCVWERAPPPSRSPRVPRSRRQVLPGTAPPATPSGFEEGPPSSQYPWAIVWGPTVSREDGGDPNSANPGFLDYGFAAPHGLATPHPNSDSMRGDGDGLILGEAPATLRPFLFGGRGEGVDPQLYVTITISIIIVLVATGIIFKFCWDRSQKRRRPSGQQGALRQEESQQPLTDLSPAGVTVLGAFGDSPTPTPDHEEPRGGPRPGMPHPKGAPAFQLNRIPLVNL

SEQ ID NO: 9145 - protein, 276 aa, Artificial Sequence
  Description of Artificial Sequence: Synthetic coding sequence
MESRMWPALLLSHLLPLWPLLLLPLPPPAQGSSSSPRTPPAPARPPCARGGPSAPRHVCVWERAPPPSRSPRVPRSRRQVLPGTAPPATPSGFEEGPPSSQYPWAIVWGPTVSREDGGDPNSANPGFLDYGFAAPHGLATPHPNSDSMRGDGDGLILGEAPATLRPFLFGGRGEGVDPQLYVTITISIIIVLVATGIIFKFCWDRSQKRRRPSGQQGALRQEESQQPLTDLSPAGVTVLGAFGDSPTPTPDHEEPRGGPRPGMPHPKGAPAFQLNR

SEQ ID NO: 9146 - protein, 282 aa, Artificial Sequence; identical to SEQ ID NO: 9143
  Description of Artificial Sequence: Synthetic coding sequence

SEQ ID NO: 9147 - protein, 163 aa, Artificial Sequence
  Description of Artificial Sequence: Synthetic coding sequence
MSWRPQPCCISSCCLTTDWVHLWYIWLLVVIGALLLLCGLTSLCFRCCCLSRQQNGEDGGPPPCEVTVIAFDHDSTLQSTITSLQSVFGPAARRILAVAHSHSSLGQLPSSLDTLPGYEEALHMSRFTVAMCGQKAPDLPPVPEEKQLPPTEKESTRIVDSWN

SEQ ID NO: 9148 - protein, 183 aa, Artificial Sequence
  Description of Artificial Sequence: Synthetic coding sequence
MGVRVHVVAASALLYFILLSGTRCEENCGNPEHCLTTDWVHLWYIWLLVVIGALLLLCGLTSLCFRCCCLSRQQNGEDGGPPPCEVTVIAFDHDSTLQSTITSLQSVFGPAARRILAVAHSHSSLGQLPSSLDTLPGYEEALHMSRFTVAMCGQKAPDLPPVPEEKQLPPTEKESTRIVDSWN

SEQ ID NO: 9149 - protein, 183 aa, Artificial Sequence; identical to SEQ ID NO: 9148
  Description of Artificial Sequence: Synthetic coding sequence

SEQ ID NO: 9150 - protein, 90 aa, Artificial Sequence
  Description of Artificial Sequence: Synthetic coding sequence
MGVRVHVVAASALLYFILLSGTRCEENCGNPEHCLTTDWVHLWYIWLLVVIGALLLLCGLTSLCFRCCCLSRQQNGEDGGPPPCEVTVIA

SEQ ID NO: 9151 - protein, 57 aa, Artificial Sequence
  Description of Artificial Sequence: Synthetic coding sequence
MPTGKQLADIGYKTFSTSMMLLTVYGGYLCSVRVYHYFQWRRAQRQAAEEQKTSGIM

SEQ ID NO: 9152 - protein, 57 aa, Artificial Sequence; identical to SEQ ID NO: 9151
  Description of Artificial Sequence: Synthetic coding sequence

SEQ ID NO: 9153 - protein, 57 aa, Artificial Sequence; identical to SEQ ID NO: 9151
  Description of Artificial Sequence: Synthetic coding sequence

SEQ ID NO: 9154 - protein, 57 aa, Artificial Sequence; identical to SEQ ID NO: 9151
  Description of Artificial Sequence: Synthetic coding sequence

SEQ ID NO: 9155 - protein, 225 aa, Artificial Sequence
  Description of Artificial Sequence: Synthetic coding sequence
MAQSDFLYPENPKRREEVNRLHQQLLDCLSDSFDVTNKLTEVLNMHLGCRLASIEMKRDGTIKENCDLIIQAIMKIQKELQKVDEALKDKLEPTLYRKLQDIKEKETDKIAIVQKVISVILGEATSAASAVAVKLVGSNVTTGIINKLVTVLAQIGASLLGSIGVAVLGLGIDMIVRAILGAVEKTQLQAAIKSYEKHLVEFKSASEKYNHAITEVINTVKHQMK

SEQ ID NO: 9156 - protein, 151 aa, Artificial Sequence
  Description of Artificial Sequence: Synthetic coding sequence
MEYVLEVKNSPRHLLKQFTVCDVPLYDICDYNVSRDRCQELGCCFYEGVCYKKAVPIYIHVFSALIVIIAGAFVITIIYRVIQESRKEKAIPVDVALPQKSSEKAELASSSSKLGLKPASPGPPSAGPSMKSDEDKDDVTGTITEAEETED

SEQ ID NO: 9157 - protein, 85 aa, Artificial Sequence
  Description of Artificial Sequence: Synthetic coding sequence
MEAGERIDASQLPHRVLETRGHAISILFGFWTSFICDTYIVLAWISKIKGSPDVSASSDEPYARIQQSRRQCHAEEDQSQVPEAG

SEQ ID NO: 9158 - protein, 707 aa, Artificial Sequence
  Description of Artificial Sequence: Synthetic coding sequence
MSPHGDGRGQAQGRAVRVGLRRSGGIRGGVAVFAAVAAVFTFTLPPSVPGGDSGELITAAHELGVAHPPGYPLFTLVAKLAITLFPFGSIAYRVNLLCGLFGAVAASLLFFTVFRLSGSSAGGILAAGVFSFSRLTWQWSIAAEVFSLNNLFVGLLMALTVHFEEAATAKERSKVAKIGAFCCGLSLCNQHTIILYVLCIIPWILFQLLKKKELSLGSLLKLSLYFSAGLLPYVHLPISSYLNHARWTWGDQTTLQGFLTHFLREEYGTFSLAKSEIGSSMSEILLSQVTNMRTELSFNIQALAVCANICLATKDRQNPSLVWLFTGMFCIYSLFFAWRANLDISKPLFMGVVERFWMQSNAVVAVLAGIGLAAVVSETNRVLNSNGLQCLEWLSATLFVVYQIYSNYSVCDQRTNYVIDKFAKNLLTSMPHDAIILLRGDLPGNSLRYMHYCEGLRPDISLVDQEMMTYEWYLPKMAKHLPGVNFPGNRWNPVEGILPSGMVTFNLYHFLEVNKQKETFVCIGIHEGDPTWKKNYSLWPWGSCDKLVPLEIVFNPEEWIKLTKSIYNWTEEYGRFDPSSWESVANEEMWQARMKTPFFIFNLAETAHMPSKVKAQLYAQAYDLYKEIVYLQKEHPVNWHKNYAIACERMLRLQARDADPEVLLSETIRHFRLYSQKAPNDPQQADILGALKHLRKELQSLRNRKNV

SEQ ID NO: 9159 - protein, 241 aa, Artificial Sequence
  Description of Artificial Sequence: Synthetic coding sequence
MMTYEWYLPKMAKHLPGVNFPGNRWNPVEGILPSGMVTFNLYHFLEVNKQKETFVCIGIHEGDPTWKKNYSLWPWGSCDKLVPLEIVFNPEEWIKLTKSIYNWTEEYGRFDPSSWESVANEEMWQARMKTPFFIFNLAETAHMPSKVKAQLYAQAYDLYKEIVYLQKEHPVNWHKNYAIACERMLRLQARDADPEVLLSETIRHFRLYSQKAPNDPQQADILGALKHLRKELQSLRNRKNV

SEQ ID NO: 9160 - protein, 409 aa, Artificial Sequence
  Description of Artificial Sequence: Synthetic coding sequence
MSPHGDGRGQAQGRAVRVGLRRSGGIRGGVAVFAAVAAVFTFTLPPSVPGGDSGELITAAHELGVAHPPGYPLFTLVAKLAITLFPFGSIAYRVNLLCGLFGAVAASLLFFTVFRLSGSSAGGILAAGVFSFSRLTWQWSIAAEVFSLNNLFVGLLMALTVHFEEAATAKERSKVAKIGAFCCGLSLCNQHTIILYVLCIIPWILFQLLKKKELSLGSLLKLSLYFSAGLLPYVHLPISSYLNHARWTWGDQTTLQGFLTHFLREEYGTFSLAKSEIGSSMSEILLSQVTNMRTELSFNIQALAVCANICLATKDRQNPSLVWLFTGMFCIYSLFFAWRANLDISKPLFMGVVERFWMQSNAVVAVLAGIGLAAVVSETNRVLNSNGLQCLEWLSATLFVVYQIYSNYR

SEQ ID NO: 9161 - protein, 131 aa, Artificial Sequence
  Description of Artificial Sequence: Synthetic coding sequence
MMNFRQRMGWIGVGLYLLASAAAFYYVFEISETYNRLALEHIQQHPEEPLEGTTWTHSLKAQLLSLPFWVWTVIFLVPYLQMFLFLYSCTRADPKTVGYCIIPICLAVICNRHQAFVKASNQISRLQLIDT

SEQ ID NO: 9162 - protein, 169 aa, Artificial Sequence
  Description of Artificial Sequence: Synthetic coding sequence
MLAFSEMPKPPDYSELSDSLTLAVGTGRFSGPLHRAWRMMNFRQRMGWIGVGLYLLASAAAFYYVFEISETYNRLALEHIQQHPEEPLEGTTWTHSLKAQLLSLPFWVWTVIFLVPYLQMFLFLYSCTRADPKTVGYCIIPICLAVICNRHQAFVKASNQISRLQLIDT

SEQ ID NO: 9163 - protein, 173 aa, Artificial Sequence
  Description of Artificial Sequence: Synthetic coding sequence
MMAQLFLLQANAVLPLSHEIKVKRQIRLPAPLYPPERNDSRSFQIPQDLREKGWEEGQQHFAGKAADAFPAPVQLEGLEAGQTTLASPEVGPWRPKRLSGVCLLSALLPDPCKTNGTFLLQKHHLPSLLAVILFPVIILTGASFAHLFVALFVSHLLLKLPLGAGMRMQRDAR

SEQ ID NO: 9164 - protein, 173 aa, Artificial Sequence; identical to SEQ ID NO: 9163
  Description of Artificial Sequence: Synthetic coding sequence

SEQ ID NO: 9165 - protein, 938 aa, Artificial Sequence
  Description of Artificial Sequence: Synthetic coding sequence
MPALEHMNQILHILFVFLPFLWALGTLPPPDALLLWAMEQVLEFGLGGSSMSTHLRLLVMFIMSAGTAIASYFIPSTVGVVLFMTGFGFLLSLNLSDMGHKIGTKSKDLPSGPEKHFSWKECLFYIIILVLALLETSLLHHFAGFSQISKSNSQAIVGYGLMILLIILWILREIQSVYIIGIFRNPFYPKDVQTVTVFFEKQTRLMKIGIVRRILLTLVSPFAMIAFLSLDSSLQGLHSVSVCIGFTRAFRMVWQNTENALLETVIVSTVHLISSTDIWWNRSLDTGLRLLLVGIIRDRLIQFISKLQFAVTVLLTSWTEKKQRRKTTATLCILNIVFSPFVLVIIVFSTLLSSPLLPLFTLPVFLVGFPRPIQSWPGAAGTTACVCADTVYYYQMVPRLTAVLQTAMAAGSLGLLLPGSHYLGRFQDRLMWIMILECGYTYCSINIKGLELQETSCHTAEARRVDEVFEDAFEQEYTRVCSLNEHFGNVLTPCTVLPVKLYSDARNVLSGIIDSHENLKEFKGDLIKVLVWILVQYCSKRPGMKENVHNTENKGKAPLMLPALNTLPPPKSPEDIDSLNSETFNDWSDDNIFDDEPTIKKVIEEKHQLKDLPGTNLFIPGSVESQRVGDHSTGTVPENDLYKAVLLGYPAVDKGKQEDMPYIPLMEFSCSHSHLVCLPAEWRTSCMPSSKMKEMSSLFPEDWYQFVLRQLECYHSEEKASNVLEEIAKDKVLKDFYVHTVMTCYFSLFGIDNMAPSPGHILRVYGGVLPWSVALDWLTEKPELFQLALKAFRYTLKLMIDKASLGPIEDFRELIKYLEEYERDWYIGLVSDEKWKEAILQEKPYLFSLGYDSNMGIYTGRVLSLQELLIQVGKLNPEAVRGQWANLSWELLYATNDDEERYSIQAHPLLLRNLTVQAAEPPLGYPIYSSKPLHIHLY

SEQ ID NO: 9166 - protein, 1172 aa, Artificial Sequence
  Description of Artificial Sequence: Synthetic coding sequence
MSPDVPLLNDYKQDFFLKRFPQTVLGGPRFKLGYCAPPYIYVNQIILFLMPWVWGGVGTLLYQLGILKDYYTAALSGGLMLFTAFVIQFTSLYAKNKSTTVERILTTDILAEEDEHEFTSCTGAETVKFLIPGKKYVANTVFHSILAGLACGLGTWYLLPNRITLLYGSTGGTALLFFFGWMTLCIAEYSLIVNTATETATFQTQDTYEIIPLMRPLYIFFFVSVDLAHRFVVNMPALEHMNQILHILFVFLPFLWALGTLPPPDALLLWAMEQVLEFGLGGSSMSTHLRLLVMFIMSAGTAIASYFIPSTVGVVLFMTGFGFLLSLNLSDMGHKIGTKSKDLPSGPEKHFSWKECLFYIIILVLALLETSLLHHFAGFSQISKSNSQAIVGYGLMILLIILWILREIQSVYIIGIFRNPFYPKDVQTVTVFFEKQTRLMKIGIVRRILLTLVSPFAMIAFLSLDSSLQGLHSVSVCIGFTRAFRMVWQNTENALLETVIVSTVHLISSTDIWWNRSLDTGLRLLLVGIIRDRLIQFISKLQFAVTVLLTSWTEKKQRRKTTATLCILNIVFSPFVLVIIVFSTLLSSPLLPLFTLPVFLVGFPRPIQSWPGAAGTTACVCADTVYYYQMVPRLTAVLQTAMAAGSLGLLLPGSHYLGRFQDRLMWIMILECGYTYCSINIKGLELQETSCHTAEARRVDEVFEDAFEQEYTRVCSLNEHFGNVLTPCTVLPVKLYSDARNVLSGIIDSHENLKEFKGDLIKVLVWILVQYCSKRPGMKENVHNTENKGKAPLMLPALNTLPPPKSPEDIDSLNSETFNDWSDDNIFDDEPTIKKVIEEKHQLKDLPGTNLFIPGSVESQRVGDHSTGTVPENDLYKAVLLGYPAVDKGKQEDMPYIPLMEFSCSHSHLVCLPAEWRTSCMPSSKMKEMSSLFPEDWYQFVLRQLECYHSEEKASNVLEEIAKDKVLKDFYVHTVMTCYFSLFGIDNMAPSPGHILRVYGGVLPWSVALDWLTEKPELFQLALKAFRYTLKLMIDKASLGPIEDFRELIKYLEEYERDWYIGLVSDEKWKEAILQEKPYLFSLGYDSNMGIYTGRVLSLQELLIQVGKLNPEAVRGQWANLSWELLYATNDDEERYSIQAHPLLLRNLTVQAAEPPLGYPIYSSKPLHIHLY

SEQ ID NO: 9167 - protein, 1172 aa, Artificial Sequence; identical to SEQ ID NO: 9166
  Description of Artificial Sequence: Synthetic coding sequence

SEQ ID NO: 9168 - protein, 298 aa, Artificial Sequence
  Description of Artificial Sequence: Synthetic coding sequence
MLPALNTLPPPKSPEDIDSLNSETFNDWSDDNIFDDEPTIKKVIEEKHQLKDLPGTNLFIPGSVESQRVGDHSTGTVPENDLYKAVLLGYPAVDKGKQEDMPYIPLMEFSCSHSHLVCLPAEWRTSCMPSSKMKEMSSLFPEDWYQFVLRQLECYHSEEKASNVLEEIAKDKVLKDFYVHTVMTCYFSLFGIDNMAPSPGHILRVYGGVLPWSVALDWLTEKPELFQLALKAFRYTLKLMIDKASLGPIEDFRELIKYLEEYERDWYIGLVSDEKWKEAILQEKPYLFSLGYDSNMYL

SEQ ID NO: 9169 - protein, 527 aa, Artificial Sequence
  Description of Artificial Sequence: Synthetic coding sequence
LCILNIVFSPFVLVIIVFSTLLSSPLLPLFTLPVFLVGFPRPIQSWPGAAGTTACVCADTVYYYQMVPRLTAVLQTAMAAGSLGLLLPGSHYLGRFQDRLMWIMILECGYTYCSINIKGLELQETSCHTAEARRVDEVFEDAFEQEYTRVCSLNEHFGNVLTPCTVLPVKLYSDARNVLSGIIDSHENLKEFKGDLIKVLVWILVQYCSKRPGMKENVHNTENKGKAPLMLPALNTLPPPKSPEDIDSLNSETFNDWSDDNIFDDEPTIKKVIEEKHQLKDLPGTNLFIPGSVESQRVGDHSTGTVPENDLYKAVLLGYPAVDKGKQEDMPYIPLMEFSCSHSHLVCLPAEWRTSCMPSSKMKEMSSLFPEDWYQFVLRQLECYHSEEKASNVLEEIAKDKVLKDFYVHTVMTCYFSLFGIDNMAPSPGHILRVYGGVLPWSVALDWLTEKPELFQLALKAFRYTLKLMIDKASLGPIEDFRELIKYLEEYERDWYIGLVSDEKWKEAILQEKPYLFSLGYDSNMYL

SEQ ID NO: 9170 - protein, 621 aa, Artificial Sequence
  Description of Artificial Sequence: Synthetic coding sequence
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAYKTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGVSNWGGYALACALYILYSCAVHSQYLRKAVGPSRAPGDQAWTQALPSVIKEEKMLGILVQHKVRSGVSGIVGMEVDGLPFHNTHAEMIQKLVDVTTAQV

SEQ ID NO: 9171 - protein, 159 aa, Artificial Sequence
  Description of Artificial Sequence: Synthetic coding sequence
MPFTLHLRSRLPSAIRSLILQKKPNIRNTSSMAGELRPASLVVLPRSLAPAFERFCQVNTGPLPLLGQSEPEKWMLPPQGAISETSLRDLHSAWHRTSLMTVAQERAALPTVLTPSPITWRLSWLRSLRSWRKSSPGEIPLALPSVHSIAQARNPPVQD

SEQ ID NO: 9172 - protein, 621 aa, Artificial Sequence; identical to SEQ ID NO: 9170
  Description of Artificial Sequence: Synthetic coding sequence

SEQ ID NO: 9173 - protein, 616 aa, Artificial Sequence
  Description of Artificial Sequence: Synthetic coding sequence
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGVSNWGGYALACALYILYSCAVHSQYLRKAVGPSRAPGDQAWTQALPSVIKEEKMLGILVQHKVRSGVSGIVGMEVDGLPFHNTHAEMIQKLVDVTTAQV

SEQ ID NO: 9174 - protein, 65 aa, Artificial Sequence
  Description of Artificial Sequence: Synthetic coding sequence
MPFTLHLRSRLPSAIRSLILQKKPNIRNTSSMAGELRPASLVVLPRSLAPAFERFCQVNTGPLPL

SEQ ID NO: 9175 - protein, 431 aa, Artificial Sequence
  Description of Artificial Sequence: Synthetic coding sequence
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAYKTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTP

SEQ ID NO: 9176 - protein, 159 aa, Artificial Sequence; identical to SEQ ID NO: 9171
  Description of Artificial Sequence: Synthetic coding sequence

SEQ ID NO: 9177 - protein, 621 aa, Artificial Sequence; identical to SEQ ID NO: 9170
  Description of Artificial Sequence: Synthetic coding sequence

SEQ ID NO: 9178 - protein, 109 aa, Artificial Sequence
  Description of Artificial Sequence: Synthetic coding sequence
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQ

SEQ ID NO: 9179 - protein, 201 aa, Artificial Sequence
  Description of Artificial Sequence: Synthetic coding sequence
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAYKTTVPCVTHAGFCCPLVVTMRPIPKDKLEGLVRACCSLGGEQGQPVHMGD

SEQ ID NO: 9180 - protein, 564 aa, Artificial Sequence
  Description of Artificial Sequence: Synthetic coding sequence
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQTTVPCVTHAGFCCPLVVTMRPIPKDKLEGLVRACCSLGELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVSNWGGYALACALYILYSCAVHSQYLRKAVGPSRAPGDQAWTQALPSVIKEEKMLGILVQHKVRSGVSGIVGMEVDGLPFHNTHAEMIQKLVDVTTAQV

SEQ ID NO: 9181 - protein, 125 aa, Artificial Sequence
  Description of Artificial Sequence: Synthetic coding sequence
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCS

SEQ ID NO: 9182 - protein, 581 aa, Artificial Sequence
  Description of Artificial Sequence: Synthetic coding sequence
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAYKTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVSNWGGYALACALYILYSCAVHSQYLRKAVGPSRAPGDQAWTQALPSVIKEEKMLGILVQHKVRSGVSGIVGMEVDGLPFHNTHAEMIQKLVDVTTAQV

SEQ ID NO: 9183 - protein, 25 aa, Artificial Sequence
  Description of Artificial Sequence: Synthetic coding sequence
MPFTLHLRSRLPSAIRSLILQKKPN

SEQ ID NO: 9184 - protein, 152 aa, Artificial Sequence
  Description of Artificial Sequence: Synthetic coding sequence
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAYK

SEQ ID NO: 9185 - protein, 202 aa, Artificial Sequence
  Description of Artificial Sequence: Synthetic coding sequence
MPFTLHLRSRLPSAIRSLILQKKPNIRNTSSMAGELRPASLVVLPRSLAPAFERFCQVNTGPLPLLGQSEPEKWMLPPQGAISETRMGHPQFWKYEFGACTGSLASLEQYSEQLKDMVAFFLGCSFSLEEALEKAGLPRRDPAGHSQAGAYKTTVPCVTHAGFCCPLVVTMRPIPKDKLEGLVRACCSLGGEQGQPVHMGDP

SEQ ID NO: 9186 - protein, 616 aa, Artificial Sequence; identical to SEQ ID NO: 9173
  Description of Artificial Sequence: Synthetic coding sequence

SEQ ID NO: 9187 - protein, 85 aa, Artificial Sequence
  Description of Artificial Sequence: Synthetic coding sequence
MPFTLHLRSRLPSAIRSLILQKKPNIRNTSSMAGELRPASLVVLPRSLAPAFERFCQVNTGPLPLLGQSEPEKWMLPPQGAISET

SEQ ID NO: 9188 - protein, 616 aa, Artificial Sequence; identical to SEQ ID NO: 9173
  Description of Artificial Sequence: Synthetic coding sequence

SEQ ID NO: 9189 - protein, 616 aa, Artificial Sequence; identical to SEQ ID NO: 9173
  Description of Artificial Sequence: Synthetic coding sequence

SEQ ID NO: 9190 - protein, 83 aa, Artificial Sequence
  Description of Artificial Sequence: Synthetic coding sequence
MPFTLHLRSRLPSAIRSLILQKKPNIRNTSSMAGELRPASLVVLPRSLAPAFERFCQVNTGPLPLLGQSEPEKWMLPPQGAIS

SEQ ID NO: 9191 - protein, 152 aa, Artificial Sequence; identical to SEQ ID NO: 9184
  Description of Artificial Sequence: Synthetic coding sequence

SEQ ID NO: 9192 - protein, 52 aa, Artificial Sequence
  Description of Artificial Sequence: Synthetic coding sequence
MPFTLHLRSRLPSAIRSLILQKKPNIRNTSSMAGELRPASLVVLPRSLAPAF

SEQ ID NO: 9193 - protein, 492 aa, Artificial Sequence
  Description of Artificial Sequence: Synthetic coding sequence
MVAFFLGCSFSLEEALEKAGAYKTTVPCVTHAGFCCPLVVTMRPIPKDKLEGLVRACCSLGGEQGQPVHMGDPELLGIKELSKPAYGDAMVCPPGEVPVFWPSPLTSLGAVSSCETPLAFASIPGCTVMTDLKDAKAPPGCLTPERIPEVHHISQDPLHYSIASVSASQKIRELESMIGIDPGNRGIGHLLCKDELLKASLSLSHARSVLITTGFPTHFNHEPPEETDGPPGAVALVAFLQALEKEVAIIVDQRAWNLHQKIVEDAVEQGVLKTQIPILTYQGGSVEAAQAFLCKNGDPQTPRFDHLVAIERAGRAADGNYYNARKMNIKHLVDPIDDLFLAAKKIPGISSTGVGDGGNELGMGKVKEAVRRHIRHGDVIACDVEADFAVIAGVSNWGGYALACALYILYSCAVHSQYLRKAVGPSRAPGDQAWTQALPSVIKEEKMLGILVQHKVRSGVSGIVGMEVDGLPFHNTHAEMIQKLVDVTTAQV

SEQ ID NO: 9194 - protein, 160 aa, Artificial Sequence
  Description of Artificial Sequence: Synthetic coding sequence
MRTAAGAVSPDSRPETRRQTRKNEEAAWGPRVCRAEREDNRKCPPSILKRSRPEHHRPEAKPQRTSRRVWFREPPAVTVHYIADKNATATVRVPGRPRPHGGSLLLQLCVCVLLVLALGLYCGRAKPVATALEDLRARLLGLVLHLRHVALTCWRGLLRL

SEQ ID NO: 9195 - protein, 160 aa, Artificial Sequence; identical to SEQ ID NO: 9194
  Description of Artificial Sequence: Synthetic coding sequence

SEQ ID NO: 9196 - protein, 774 aa, Artificial Sequence
  Description of Artificial Sequence: Synthetic coding sequence
MRGPIVLHICLAFCSLLLFSVATQCLAFPKIERRREIAHVHAEKGQSDKMNTDDLENSSVTSKQTPQLVVSEDPMMMSAVPSATSLNKAFSINKETQPGQAGLMQTERPGVSTPTESGVPSAEEVFGSSQPERISPESGLAKAMLTIAITATPSLTVDEKEELLTSTNFQPIVEEITETTKGFLKYMDNQSFATESQEGVGLGHSPSSYVNTKEMLTTNPKTEKFEADTDHRTTSFPGAESTAGSEPGSLTPDKEKPSQMTADNTQAAATKQPLETSEYTLSVEPETDSLLGAPEVTVSVSTAVPAASALSDEWDDTKLESVSRIRTPKLGDNEETQVRTEMSQTAQVSHEGMEGGQPWTEAAQVALGLPEGETHTGTALLIAHGNERSPAFTDQSSFTPTSLMEDMKVSIVNLLQSTGDFTESTKENDALFFLETTVSVSVYESEADQLLGNTMKDIITQEMTTAVQEPDATLSMVTQEQVATLELIRDSGKTEEEKEDPSPVSDVPGVTQLSRRWEPLATTISTTVVPLSFEVTPTVEEQMDTVTGPNEEFTPVLGSPVTPPGIMVGEPSISPALPALEASSERRTVVPSITRVNTAASYGLDQLESEEGQEDEDEEDEEDEDEEEEDEEEDEEDKDADSLDEGLDGDTELPGFTLPGITSQEPGLEEGNMDLLEGATYQVPDALEWEQQNQGLVRSWMEKLKDKAGYMSGMLVPVGVGIAGALFILGALYSIKVMNRRRRNGFKRHKRKQREFNSMQDRVMLLADSSEDEF

SEQ ID NO: 9197 - protein, 242 aa, Artificial Sequence
  Description of Artificial Sequence: Synthetic coding sequence
MAAALWGFFPVLLLLLLSGDVQSSEVPGAAAEGSGGSGVGIGDRFKIEGRAVVPGVKPQDWISAARVLVDGEEHVGFLKTDGSFVVHDIPSGSYVVEVVSPAYRFDPVRVDITSKGKMRARYVNYIKTSEVVRLPYPLQMKSSGPPSYFIKRESWGWTDFLMNPMVMMMVLPLLIFVLLPKVVNTSDPDMRREMEQSMNMLNSNHELPDVSEFMTRLFSSKSSGKSSSGSSKTGKSGAGKRR

SEQ ID NO: 9198 - protein, 531 aa, Artificial Sequence
  Description of Artificial Sequence: Synthetic coding sequence
MAVAPSFNMTNPQPAIEGGISEVEIISQQVDEETKSIAPVQLVNFAYRDLPLAAVDLSTAGSQLLSNLDEDYQREGSNWLKPCCGKRAAVWQVFLLSASLNSFLVACVILVVILLTLELLIDIKLLQFSSAFQFAGVIHWISLVILSVFFSETVLRIVVLGIWDYIENKIEVFDGAVIILSLAPMVASTVANGPRSPWDAISLIIMLRIWRVKRVIDAYVLPVKLEMEMVIQQYEKAKVIQDEQLERLTQICQEQGFEIRQLRAHLAQQDLDLAAEREAALQAPHVLSQPRSRFKVLEAGTWDEETAAESVVEELQPSQEATMKDDMNSYISQYYNGPSSDSGVPEPAVCMVTTAAIDIHQPNISSDLFSLDMPLKLGGNGTSATSESASRSSVTRAQSDSSQTLGSSMDCSTAREEPSSEPGPSPPPLPSQQQVEEATVQDLLSSLSEDPCPSQKALDPAPLARPSPAGSAQTSPELEHRVSLFNQKNQEGFTVFQIRPVIHFQPTVPMLEDKFRSLESKEQKLHRVPEA

SEQ ID NO: 9199 - protein, 83 aa, Artificial Sequence
  Description of Artificial Sequence: Synthetic coding sequence
MSFFQLLMKRKELIPLVVFMTVAAGGASSFAVYSLWKTDVILDRKKNPEPWETVDPTVPQKLITINQQWKPIEELQNVQRVTK

SEQ ID NO: 9200 - protein, 83 aa, Artificial Sequence; identical to SEQ ID NO: 9199
  Description of Artificial Sequence: Synthetic coding sequence

SEQ ID NO: 9201 - protein, 175 aa, Artificial Sequence
  Description of Artificial Sequence: Synthetic coding sequence
METWRKGSFRNASFFKQLSLGRPRRLRRQSSVLSQASTAGGDHEEYSNREVIRELQGRPDGRRLPLWGDEQPRATLLAPPKPPRLYRESSSCPNILEPPPAYTAAYSATLPSALSLSSALHQHSEKGLVDTPCFQRTPTPDLSDPFLSFKVDLGISLLEEVLQMLREQFPSEPSF

SEQ ID NO: 9202 - protein, 175 aa, Artificial Sequence; identical to SEQ ID NO: 9201
  Description of Artificial Sequence: Synthetic coding sequence

SEQ ID NO: 9203 - protein, 224 aa, Artificial Sequence
  Description of Artificial Sequence: Synthetic coding sequence
MPLTPEPPSGRVEGPPAWEAAPWPSLPCGPCIPIMLVLATLAALFILTTAVLAERLFRRALRPDPSHRAPTLVWRPGGELWIEPMGTARERSEDWYGSAVPLLTDRAPEPPTQVGTLEARATAPPAPSAPNSAPSNLGPQTVLEVPARSTFWGPQPWEGRPPATGLVSWAEPEQRPEASVQFGSPQARRQRPGSPDPEWGLQPRVTLEQISAFWKREGRTSVGF

SEQ ID NO: 9204 - protein, 468 aa, Artificial Sequence
  Description of Artificial Sequence: Synthetic coding sequence
MADDAGLETPLCSEQFGSGEARGCRAAADGSLQWEVGGWRWWGLSRAFTVKPEGRDAGEVGASGAPSPPLSGLQAVFLPQGFPDSVSPDYLPYQLWDSVQAFASSLSGSLATQAVLLGIGVGNAKATVSAATATWLVKDSTGMLGRIVFAWWKGSKLDCNAKQWRLFADILNDVAMFLEIMAPVYPICFTMTVSTSNLAKCIVSVAGGATRAALTVHQARRNNMADVSAKDSSQETLVNLAGLLVSLLMLPLVSGCPGFSLGCFFFLTALHIYANYRAVRALVMETLNEGRLRLVLKHYLQRGEVLDPTAANRMEPLWTGFWPAPSLSLGVPLHRLVSSVFELQQLVEGHQESYLLCWDQSQNQVQVVLNQKAGPKTILRAATHGLMLGALQGDGPLPAELEELRNRVRAGPKKESWVVVKETHEVLDMLFPKFLKGLQDAGWKTEKHQLEVDEWRATWLLSPEKKVL

SEQ ID NO: 9205 - protein, 194 aa, Artificial Sequence
  Description of Artificial Sequence: Synthetic coding sequence
MLGRIVFAWWKGSKLDCNAKQWRLFADILNDVAMFLEIMAPVYPICFTMTVSTSNLAKCIVSVAGGATRAALTVHQARRNNMADVSAKDSSQETLVNLAGLLVSLLMLPLVSGCPGFSLGCFFFLTALHIYANYRAVRALVMETLNEGRLRLVLKHYLQRGEVLDPTAANRMEPLWTGDPAPGLGSCVSTSPTA

SEQ ID NO: 9206 - protein, 422 aa, Artificial Sequence
  Description of Artificial Sequence: Synthetic coding sequence
MADDAGLETPLCSEQFGSGEARGCRAAADGSLPQGFPDSVSPDYLPYQLWDSVQAFASSLSGSLATQAVLLGIGVGNAKATVSAATATWLVKDSTGMLGRIVFAWWKGSKLDCNAKQWRLFADILNDVAMFLEIMAPVYPICFTMTVSTSNLAKCIVSVAGGATRAALTVHQARRNNMADVSAKDSSQETLVNLAGLLVSLLMLPLVSGCPGFSLGCFFFLTALHIYANYRAVRALVMETLNEGRLRLVLKHYLQRGEVLDPTAANRMEPLWTGFWPAPSLSLGVPLHRLVSSVFELQQLVEGHQESYLLCWDQSQNQVQVVLNQKAGPKTILRAATHGLMLGALQGDGPLPAELEELRNRVRAGPKKESWVVVKETHEVLDMLFPKFLKGLQDAGWKTEKHQLEVDEWRATWLLSPEKKVL

SEQ ID NO: 9207 - protein, 156 aa, Artificial Sequence
  Description of Artificial Sequence: Synthetic coding sequence
MADDAGLETPLCSEQFGSGEARGCRAAADGSLQWEVGGWRWWGLSRAFTVKPEGRDAGEVGASGAPSPPLSGLQAVFLPQGFPDSVSPDYLPYQLWDSVQAFASSLSGSLATQAVLLGIGVGNAKATVSAATATWLVKDSTGMLGRIVFAWWKGAS

SEQ ID NO: 9208 - protein, 963 aa, Artificial Sequence
  Description of Artificial Sequence: Synthetic coding sequence
MAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 9209 - protein, 870 aa, Artificial Sequence
  Description of Artificial Sequence: Synthetic coding sequence
MAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 9210 - protein, 1052 aa, Artificial Sequence
  Description of Artificial Sequence: Synthetic coding sequence
MAPAGVVTRAVRSGELPLTSMASAENEACAVRSVACPSQAWRLQKVLCGRCGAASCPSQTWRPRGAGSGGVRMGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 9211 - protein, 813 aa, Artificial Sequence
  Description of Artificial Sequence: Synthetic coding sequence
MPPLGVLVHEKSHLCDVNSFCLGKAGTATLAMSEKVRTRLEELDDFEEGSQKELLNLTQQDYVNRIEELNQSLKDAWASDQKVKALKIVIQAELVYERIFSMCVDSRSVLPDHFSPENANDTAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 9212 - protein, 273 aa, Artificial Sequence
  Description of Artificial Sequence: Synthetic coding sequence
MAPAGVVTRAVRSGELPLTSMASAENEACAVRSVACPSQAWRLQKVLCGRCGAASCPSQTWRPRGAGSGGVRMGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKDGGYSEPRSRHRTPAWTTEQSWDCHIGNVREGADPAGGAG

SEQ ID NO: 9213 - protein, 959 aa, Artificial Sequence
  Description of Artificial Sequence: Synthetic coding sequence
MAPAGVVTRAVRSGELPLTSMASAENEACAVRSVACPSQAWRLQKVLCGRCGAASCPSQTWRPRGAGSGGVRMGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 9214 - protein, 422 aa, Artificial Sequence
  Description of Artificial Sequence: Synthetic coding sequence
MLDLEVVPERSLGNEQWEFTLGMPLAQAVAILQKHCRIIKNVQVLYSEQSPLSHDLILNLTQDGIKLMFDAFNQRLKVIEVCDLTKVKLKYCGVHFNSQAIAPTIEQIDQSFGATHPGVYNSAEQLFHLNFRGLSFSFQLDSWTEAPKYEPNFAHGLASLQIPHGATVKRMYIYSGNSLQDTKAPMMPLSCFLGNVYAESVDVLRDGTGPAGLRLRLLAAGCGPGLLADAKMRVFERSVYFGDSCQDVLSMLGSPHKVFYKSEDKMKIHSPSPHKQVPSKCNDYFFNYFTLGVDILFDANTHKVKKFVLHTNYPGHYNFNIYHRCEFKIPLAIKKENADGQTETCTTYSKWDNIQELLGHPVEKPVVLHRSSSPNNTNPFGSTFCFGLQRMIFEVMQNNHIASVTLYGPPRPGSHLRTAELP

SEQ ID NO: 9215 - protein, 356 aa, Artificial Sequence
  Description of Artificial Sequence: Synthetic coding sequence
MGLMVRGGVTCRSQERLLGVGTGTASAQPPVTASPYCSFTGRSRADAPARAAGNGQPRLRAQVDLSSASSVLVTVLDAKALPLTLLSWGSLCATAQNHNNQEGAPAQPKGSMANQRALRFPPPSGSPPGLHTRMRLTSPPQPHFEPPPPTTVGAPRSLQGDWFGSDSRAVRALRLIGWASRSLHPLPGSRDRAHPAAEEEDDPDRPIEFSSSKANPHRWSVGHTMGKGHQRPWWKVLPLSCFLVALIIWCYLREESEADQWLRQEGSRQPPFGFDVTFARDCPGYACVLSTEGLGWWMGHLAMLIRVKAEQNLSRSETAPRLALDVQGFHRQDFSDPWGRFQLHCMLLDLPSLCIT

SEQ ID NO: 9216 - protein, 132 aa, Artificial Sequence
  Description of Artificial Sequence: Synthetic coding sequence
MNRVLCAPAAGAVRALRLIGWASRSLHPLPGSRDRAHPAAEEEDDPDRPIEFSSSKANPHRWSVGHTMGKGHQRPWWKVLPLSCFLVALIIWCYLREESEADQWLRQVWGEVPEPSDRSEEPETPAAYRART

SEQ ID NO: 9217 - protein, 132 aa, Artificial Sequence
  Description of Artificial Sequence: Synthetic coding sequence
MGAGVGVAGCTRGHRNWVPSQLPPREIKAGVSLAVVTEFAWVLAPRPKRATASALGTESPRFLDRPDFFDYPDSDQARLLAVAQFIGEKPIVFINSGSSPGLFHHILVGLLVVAFFFLLFQFCTHINFQKGA

SEQ ID NO: 9218 - protein, 319 aa, Artificial Sequence
  Description of Artificial Sequence: Synthetic coding sequence
MAPQRRAATKAPEGNGAAERRNRSSTKKDRAPREVQRLWQRPWLRTAGLGAGFVLTALLLWSSLGADDGVAEVLARRGEVVAGRFIEVPCSEDYDSHRRFEGCTPRKCGRGVTDVVITREEAERIRSVAEKGLSLGGSDGGASILDLHSGALSVGKHFVNLYRYFGDKIQNIFSEEDFRLYREVRQKVQLTIAEAFGISASSLHLTKPTFFSRINSTEARTAHDEYWHAHVDKVTYGSFDYTSLLYLSNYLEDFGGGRFMFMEEGANKTVEPRAGRVSFFTSGSENLHRVEKVHWGTRYAITIAFSCNPDHGIEDPAFP

SEQ ID NO: 9219 - protein, 331 aa, Artificial Sequence
  Description of Artificial Sequence: Synthetic coding sequence
MAPQRRAATKAPEGNGAAERRNRSSTKKDRAPREVQRLWQRPWLRTAGLGAGFVLTALLLWSSLGADDGVAEVLARRGEVVAGRFIEVPCSEDYDSHRRFEGCTPRKCGRGVTDVVITREEAERIRSVAEKGLSLGGSDGGASILDLHSGALSVGKHFVNLYRYFGDKIQNIFSEEDFRLYREVRQKVQLTIAEAFGISASSLHLTKPTFFSRINSTEARTAHDEYWHAHVDKVTYGSFDYTSLLYLSNYLEDFGGGRFMFMEEGANKTVEPRAGCFCFRMMSCGFQEVNGPRASEAAGAKAGVRCPPGTHHPPERGETHAILEAESIAYC

SEQ ID NO: 9220 - protein, 77 aa, Artificial Sequence
  Description of Artificial Sequence: Synthetic coding sequence
MAATDFVQEMRAVGERLLLKLQRLPQAEPVEIVAFSVIILFTATVLLLLLIACSCCCTHCCCPERRGRKVQVQPTPP

SEQ ID NO: 9221 - protein, 525 aa, Artificial Sequence
  Description of Artificial Sequence: Synthetic coding sequence
MAAAPPLRDRLSFLHRLPILLKGTSDDDVPCPGYLFEEIAKISHESPGSSQCLLEYLLSRLHSSSGHGKLKVLKILLYLCSHGSSFFLLILKRNSAFIQEAAAFAGPPDPLHGNSLYQKVRAAAQDLGSTLFSDTVLPLAPSQPLGTPPATGMGSQARPHSTLQGFGYSKEHGRTAVRHQPGQAGGGWDELDSGPSSQNSSQNSDLSRVSDSGSHSGSDSHSGASREPGDLAERVEVVALSDCQQELSLVRTVTRGPRAFLSREEAQHFIKACGLLNCEAVLQLLTCHLRGTSECTQLRALCAIASLGSSDLLPQEHILLRTRPWLQELSMGSPGPVTNKATKILRHFEASCGQLSPARGTSAEPGPTAALPGPSDLLTDAVPLPGSQVFLQPLSSTPVSSRSPAPSSGMPSSPVPTPPPDASPIPAPGDPSEAEARLAESRRWRPERIPGGTDSPKRGPSSCAWSRDSLFAGMELVACPRLVGAGAAAGESCPDAPRAPQTSSQRTAAKEPPGSEPSAFAFLNA

SEQ ID NO: 9222 - protein, 441 aa, Artificial Sequence
  Description of Artificial Sequence: Synthetic coding sequence
MGSQARPHSTLQGFGYSKEHGRTGSAGEAFLSTIQKAAEVVASAMRPGPESPSTRRLLPRGDTYQPAMMPSASHGPPTLGNLLPGAIPGPRAVRHQPGQAGGGWDELDSGPSSQNSSQNSDLSRVSDSGSHSGSDSHSGASREPGDLAERVEVVALSDCQQELSLVRTVTRGPRAFLSREEAQHFIKACGLLNCEAVLQLLTCHLRGTSECTQLRALCAIASLGSSDLLPQEHILLRTRPWLQELSMGSPGPVTNKATKILRHFEASCGQLSPARGTSAEPGPTAALPGPSDLLTDAVPLPGSQVFLQPLSSTPVSSRSPAPSSGMPSSPVPTPPPDASPIPAPGDPSEAEARLAESRRWRPERIPGGTDSPKRGPSSCAWSRDSLFAGMELVACPRLVGAGAAAGESCPDAPRAPQTSSQRTAAKEPPGSEPSAFAFLNA

SEQ ID NO: 9223 - protein, 357 aa, Artificial Sequence
  Description of Artificial Sequence: Synthetic coding sequence
MESSRGRPGPETDLLAVAEHQALVFGGGPGRTSSEPPAGLRVSGEEETENVGGANRHPRTSPKTSSCGVVHRPEREALENEPGPQGTLSGAGSRRGAPGAEHEPSLSSRHKNPAPPEGKPSSGRDCRRGGPGGGMDVEQQEEEDNDEEAAAGSRAGRSFSSRLQDSRSLDGLSEACGGAGSSGSAESGAGGGRRATISSPLELEGTVSRHGDLTHFVANNLQLKIRLSGAPPPPPSAPARPCPAPAPTPTPAIPPIDPEVLRDLERLSRELGGRVDRLLRGLGGAVQELTALSVGCIQTYRDAVDSLGEAVDMSIKGMYTLLARCEELERALQPVQGLARQVRDIRRTLEVLEALCK

SEQ ID NO: 9224 - protein, 113 aa, Artificial Sequence
  Description of Artificial Sequence: Synthetic coding sequence
MAGPAAAFRRLGALSGAAALGFASYGAHGAQFPDAYGKELFDKANKHHFLHSLALLGVPHCRKPLWAGLLLASGTTLFCTSFYYQALSGDPSIQTLAPAGGTLLLLGWLALAL

SEQ ID NO: 9225 - protein, 187 aa, Artificial Sequence
  Description of Artificial Sequence: Synthetic coding sequence
MYLQVETRTSSRLHLKRAPGIRSWSLLVGILSIGLAAAYYSGDSLGWKLFYVTGCLFVAVQNLEDWEEAIFDKSTGKVVLKTFSLYKKLLTLFRAGHDQVVVLLHDVRDVSVEEEKVRYFGKGYMVVLRLATGFSHPLTQSAVMGHRSDVEAIAKLITSFLELHCLESPTELSQSSDSEAGDPASQS

SEQ ID NO: 9226 - protein, 223 aa, Artificial Sequence
  Description of Artificial Sequence: Synthetic coding sequence
MWKPSPSSSPASWSCTALRAPQSCLRAATVRPVTLQARADSPTVPEPVHRPQDPWHIPGVPEPVHRPQDPWHIPGVPEPVHRPQDPWHIPGVPEPVHRPQDPWHIPGVPEPVHRPQDPWPWLQLVPPAELAYCLLMLLLAHCMKQQARPGHPDFLHREAWACLSAAGGLASPGLLLWATARPRASGEAGPGRALVGADAACCPRHSVLSLVDIPSGQVLPQGQ

SEQ ID NO: 9227 - protein, 261 aa, Artificial Sequence
  Description of Artificial Sequence: Synthetic coding sequence
AWRRRRSGTSGKATWWCSGLRRASPTPSRRVQSWATAVMWKPSPSSSPASWSCTALRAPQSCLRAATVRPVTLQARADSPTVPEPVHRPQDPWHIPGVPEPVHRPQDPWHIPGVPEPVHRPQDPWHIPGVPEPVHRPQDPWHIPGVPEPVHRPQDPWPWLQLVPPAELAYCLLMLLLAHCMKQQARPGHPDFLHREAWACLSAAGGLASPGLLLWATARPRASGEAGPGRALVGADAACCPRHSVLSLVDIPSGQVLPQGQ

SEQ ID NO: 9228 - protein, 173 aa, Artificial Sequence
  Description of Artificial Sequence: Synthetic coding sequence
MYLQVETRTSSRLHLKRAPGIRSWSLLVDSLGWKLFYVTGCLFVAVQNLEDWEEAIFDKSTGKVVLKTFSLYKKLLTLFRAGHDQVVVLLHDVRDVSVEEEKVRYFGKGYMVVLRLATGFSHPLTQSAVMGHRSDVEAIAKLITSFLELHCLESPTELSQSSDSEAGDPASQS

SEQ ID NO: 9229 - protein, 187 aa, Artificial Sequence; identical to SEQ ID NO: 9225
  Description of Artificial Sequence: Synthetic coding sequence

SEQ ID NO: 9230 - protein, 227 aa, Artificial Sequence
  Description of Artificial Sequence: Synthetic coding sequence
MGHRSDVEAIASSSPASWSCTALRAPQSCLRAATVRPVTLQARADSPTVPEPVHRPQDPWHIPGVPEPVHRPQDPWHIPGVPEPVHRPQDPWHIPGVPEPVHRPQDPWHIPGVPEPVHRPQDPWPWLQLVPPAELAYCLLMLLLAHCMKQQARPGHPDFLHREAWACLSAAGVSPALDSCFGPQQDLGRVERRARPALVGADAACCPRHSVLSLVDIPSGQVLPQGQ

SEQ ID NO: 9231 - protein, 275 aa, Artificial Sequence
  Description of Artificial Sequence: Synthetic coding sequence
MDTILVFSLIIASYDANKKDLRDSSCRLEQLPGIFPKDVRSIRELQMQETHTETKRTTFIQNRTIATLQCLGSDSKVKVNLVYLERRPKVKHILKNLRIIAAPRRNSSASSSCHLIPTSKFQTGSLLKGKAFLPGISQCKVLGASSETFPTTAPSITPGNKEGEKTTSTDTDENLEKRQKWSIVVKILIAVTLLLSGVAIIVFVIFEVPCPYQCLGARKLCQCQWLWRWQKKGGQPPGTAESKPDSQPQKVGQDAANSSNPKKAAEITVIHQTYF

SEQ ID NO: 9232 - protein, 159 aa, Artificial Sequence
  Description of Artificial Sequence: Synthetic coding sequence
MDTILVFSLIIASYDANKKDLRDSSCRLEQLPGIFPKDVRSIRELQMQETHTETKRTTFIQNRTIATLQCLGSDSKVKVNLVYLERRPKVKHILKNLRIIAAPRRNSSASSSCHLIPTSKFQTGSLLKGKVSMPRSQEAVPMPVVVEMAKEGRPATWDS

SEQ ID NO: 9233 - protein, 547 aa, Artificial Sequence
  Description of Artificial Sequence: Synthetic coding sequence
MSDNPPRMEVCPYCKKPFKRLKSHLPYCKMIGPTIPTDQKVYQSKPATLPRAKKMKGPIKDLIKAKGKELETENEERNSKLVVDKPEQTVKTFPLPAVGLERAATTKADKDIKNPIQPSFKMLKNTKPMTTFQEETKAQFYASEKTSPKRELAKDLPKSGESRCNPSEAGASLLVGSIEPSLSNQDRKYSSTLPNDVQTTSGDLKLDKIDPQRQELLVKLLDVPTGDCHISPKNVSDGVKRVRTLLSNERDSKGRDHLSGVPTDVTVTETPEKNTESLILSLKMSSLGKIQVMEKQEKGLTLGVETCGSKGNAEKSMSATEKQERTVMSHGCENFNTRDSVTGKESQGERPHLSLFIPRETTYQFHSVSQSSSQSLASLATTFLQEKKAEAQNHHCVPDVKALMESPEGQLSLEPKSDSQFQASHTGCQSPLCSAQRHTPQSPFTNHAAAAGRKTLRSCMGLEWFPELYPGYLGLGVLPGKPQCWNAMTQKPQLISPQGERLSQGWIRCNTTIRKSGFGGITMLFTGYFVLCCSWSFRRLKLQRWRK

SEQ ID NO: 9234 - protein, 573 aa, Artificial Sequence
  Description of Artificial Sequence: Synthetic coding sequence
MSDNPPRMEVCPYCKKPFKRLKSHLPYCKMIGPTIPTDQKVYQSKPATLPRAKKMKGPIKDLIKAKGKELETENEERNSKLVVDKPEQTVKTFPLPAVGLERAATTKADKDIKNPIQPSFKMLKNTKPMTTFQEETKAQFYASEKTSPKRELAKDLPKSGESRCNPSEAGASLLVGSIEPSLSNQDRKYSSTLPNDVQTTSGDLKLDKIDPQRQELLVKLLDVPTGDCHISPKNVSDGVKRVRTLLSNERDSKGRDHLSGVPTDVTVTETPEKNTESLILSLKMSSLGKIQVMEKQEKGLTLGVETCGSKGNAEKSMSATEKQERTVMSHGCENFNTRDSVTGKESQGERPHLSLFIPRETTYQFHSVSQSSSQSLASLATTFLQEKKAEAQNHHCVPDVKALMESPEGQLSLEPKSDSQFQASHTGCQSPLCSAQRHTPQSPFTNHAAAAGRKTLRSCMGLEWFPELYPGYLGLGVLPGKPQCWNAMTQKPQLISPQGERLSQGWIRCNTTIRKSGFGGITMLFTGYFVLCCSWSFRRLKKLCRPLPWKSTVPPCIGVAKTTGDCRSKTCLD

SEQ ID NO: 9235 - protein, 609 aa, Artificial Sequence
  Description of Artificial Sequence: Synthetic coding sequence
MSDNPPRMEVCPYCKKPFKRLKSHLPYCKMIGPTIPTDQKVYQSKPATLPRAKKMKGPIKDLIKAKGKELETENEERNSKLVVDKPEQTVKTFPLPAVGLERAATTKADKDIKNPIQPSFKMLKNTKPMTTFQEETKAQFYASEKTSPKRELAKDLPKSGESRCNPSEAGASLLVGSIEPSLSNQDRKYSSTLPNDVQTTSGDLKLDKIDPQRQELLVKLLDVPTGDCHISPKNVSDGVKRVRTLLSNERDSKGRDHLSGVPTDVTVTETPEKNTESLILSLKMSSLGKIQVMEKQEKGLTLGVETCGSKGNAEKSMSATEKQERTVMSHGCENFNTRDSVTGKESQGERPHLSLFIPRETTYQFHSVSQSSSQSLASLATTFLQEKKAEAQNHHCVPDVKALMESPEGQLSLEPKSDSQFQASHTGCQSPLCSAQRHTPQSPFTNHAAAAGRKTLRSCMGLEWFPELYPGYLGLGVLPGKPQCWNAMTQKPQLISPQGERLSQVSLLERSSTHIRSLEPPAGLTTSNFSLMRLLGAVQKGWIRCNTTIRKSGFGGITMLFTGYFVLCCSWSFRRLKKLCRPLPWKSTVPPCIGVAKTTGDCRSKTCLD

SEQ ID NO: 9236 - protein, 583 aa, Artificial Sequence
  Description of Artificial Sequence: Synthetic coding sequence
MSDNPPRMEVCPYCKKPFKRLKSHLPYCKMIGPTIPTDQKVYQSKPATLPRAKKMKGPIKDLIKAKGKELETENEERNSKLVVDKPEQTVKTFPLPAVGLERAATTKADKDIKNPIQPSFKMLKNTKPMTTFQEETKAQFYASEKTSPKRELAKDLPKSGESRCNPSEAGASLLVGSIEPSLSNQDRKYSSTLPNDVQTTSGDLKLDKIDPQRQELLVKLLDVPTGDCHISPKNVSDGVKRVRTLLSNERDSKGRDHLSGVPTDVTVTETPEKNTESLILSLKMSSLGKIQVMEKQEKGLTLGVETCGSKGNAEKSMSATEKQERTVMSHGCENFNTRDSVTGKESQGERPHLSLFIPRETTYQFHSVSQSSSQSLASLATTFLQEKKAEAQNHHCVPDVKALMESPEGQLSLEPKSDSQFQASHTGCQSPLCSAQRHTPQSPFTNHAAAAGRKTLRSCMGLEWFPELYPGYLGLGVLPGKPQCWNAMTQKPQLISPQGERLSQVSLLERSSTHIRSLEPPAGLTTSNFSLMRLLGAVQKGWIRCNTTIRKSGFGGITMLFTGYFVLCCSWSFRRLKLQRWRK

SEQ ID NO: 9237 - protein, 579 aa, Artificial Sequence
  Description of Artificial Sequence: Synthetic coding sequence
MSDNPPRMEVCPYCKKPFKRLKSHLPYCKMIGPTIPTDQKVYQSKPATLPRAKKMKGPIKDLIKAKGKELETENEERNSKLVVDKPEQTVKTFPLPAVGLERAATTKADKDIKNPIQPSFKMLKNTKPMTTFQEETKAQFYASEKTSPKRELAKDLPKSGESRCNPSEAGASLLVGSIEPSLSNQDRKYSSTLPNDVQTTSGDLKLDKIDPQRQELLVKLLDVPTGDCHISPKNVSDGVKRVRTLLSNERDSKGRDHLSGVPTDVTVTETPEKNTESLILSLKMSSLGKIQVMEKQEKGLTLGVETCGSKGNAEKSMSATEKQERTVMSHGCENFNTRDSVTGKESQGERPHLSLFIPRETTYQFHSVSQSSSQSLASLATTFLQEKKAEAQNHHCVPDVKALMESPEGQLSLEPKSDSQFQASHTGCQSPLCSAQRHTPQSPFTNHAAAAGRKTLRSCMGLEWFPELYPGYLGLGVLPGKPQCWNAMTQKPQLISPQGERLSQVSLLERSSTHIRSLEPPAGLTTSNFSLMRLLGAVQKGWIRCNTTIRKSGFGGITMLFTGYFVLCCSWSFRRLTLQ

SEQ ID NO: 9238 - protein, 74 aa, Artificial Sequence
  Description of Artificial Sequence: Synthetic coding sequence
MSANGAVWGRVRSRLRAFPERLAACGAEAAAYGRCVQASTAPGGRLSKDFCAREFEALRSCFAAAAKKTLEGGC

SEQ ID NO: 9239 - protein, 147 aa, Artificial Sequence
  Description of Artificial Sequence: Synthetic coding sequence
MLLRRVVEGGRAVAAAVRGSGARRFSSPDCCQRLPGGGSFLQRHHPGAQAPDGRRKFGTDHVEVGSQAGADGTRPPKASLPPELQPPTNCCMSGCPNCVWVEYADRLLQHFQDGGERALAALEEHVADENLKAFLRMEIRLHTRCGG

SEQ ID NO: 9240 - protein, 210 aa, Artificial Sequence
  Description of Artificial Sequence: Synthetic coding sequence
MVADIKGNEQIEKYSWREACDTGSSRMDRKHGKYILNVEHSENQPPITHPNDQEAHSSICWCLPSNDITSDVSPNLTGVCVNPGILAHSRCLQSESCNTQVKEYCRNDWSMWKVFLACLLACVIMTAIGVLIICLVNNKGSANSSIVIQLSTNDGECVTVKPGTPSPACPPTMTTTSTVPASTATESTTSTATAATTSTEPITVAPTDHL

SEQ ID NO: 9241 - protein, 101 aa, Artificial Sequence
  Description of Artificial Sequence: Synthetic coding sequence
MDQYVSTAPPRFPIAQLGTFKQDSAGMGRIFKGNLLQKKALTTFENEHHIRFFTLLVLFHVMVLLRNHSRIQGVSEDWKRANSIFRNFLRLKSSRNTAEAE

SEQ ID NO: 9242 - protein, 101 aa, Artificial Sequence; identical to SEQ ID NO: 9241
  Description of Artificial Sequence: Synthetic coding sequence

SEQ ID NO: 9243 - protein, 215 aa, Artificial Sequence
  Description of Artificial Sequence: Synthetic coding sequence
MDKVQSGFLILFLFLMECQLHLCLPYADGLHPTGNITGLPGSKRSQPPRNITKEPKVFFHKTQLPGIQGAASRSTAASPTNPMKFLRNKAIIRHRPALVKVILISSVAFSIALICGMAISYMIYRLAQAEERQQLESLYKNLRIPLLGDEEEGSEDEGESTHLLPENENELEKFIHSVIISKRSKNIKKKLKEEQNSVTENKTKNASHNGKMEDL

SEQ ID NO: 9244 - protein, 725 aa, Artificial Sequence
  Description of Artificial Sequence: Synthetic coding sequence
MATAATTTTTTTATVALTTSWDNATGRPTAEPDPILDNYVLLVVVMSLFVGGTLVVLSGVLLLCKRCWDVHQRLNRAMEEAEKTTTTYLDNGTHPAQDPDFRGEDPECQDAETERFLSTSSTGRRVSFNEAALFEQSRKTQDKGRQGGWQSTAAGASGMGGGRALMARCCRRYTLTEGDFHHLKNARLTHLHLPPLKIVTIHECDSGEASSATTPHPATSPKATLAIFQPPGKALTGRSVGPSSALPGDPYNSAAGATDFAEISPSASSDSGEGTSLDAGTRSTKAGGPGAAAGPGEAGPGSGAGTVLQFLTRLRRHASLDGASPYFKVKKWKLEPSQRAASLDTRGSPKRHHFQRQRAASESTEQEEGDAPQEDFIQYIARAGDAVAFPHPRPFLASPPPALGRLEAAEAAGGASPDSPPERGAGSAGPEQQQPPLEPDAERDAGPEQAQTSYRDLWSLRASLELHAAASDHSSSGNDRDSVRSGDSSGSGSGGAAPAFPPPSPPAPRPKDGEARRLLQMDSGYASIEGRGAGDDTEPPAAPARPRSPRAWPRRPRRDYSIDEKTDALFHEFLRHDPHFDDTPAAARHRARAHPHARKQWQRGRQHSDPGARAAPALAGTPAPPAGAARPARAPLRRGDSVDGPPDGRTLGGAGDDPAIPVIEEEPGGGGCPGSGLCVLPSGSVLDKLAAGLDERLFPPRLAEPVVATPALVAAAPTSPDHSPA

SEQ ID NO: 9245 - protein, 230 aa, Artificial Sequence
  Description of Artificial Sequence: Synthetic coding sequence
MPWTILLFAAGSLAIPAPSIRLVPPYPSSQEDPIHIACMAPGNFPGANFTLYRGGQVVQLLQAPTDQRGVTFNLSGGSSKAPGGPFHCQYGVLGELNQSQLSDLSEPVNVSFPVPTWILVLSLSLAGALFLLAGLVAVALVVRKVKLRNLQKKRDRESCWAQINFDSTDMSFDNSLFTVSAKTMPEEDPATLDDHSGTTATPSNSRTRKRPTSTSSSPETPEFSTFRACQ

SEQ ID NO: 9246 - protein, 404 aa, Artificial Sequence
  Description of Artificial Sequence: Synthetic coding sequence
MALSLPLGPRLGSEPLNHPPGAPREADIVGCTVCPASGEESTSPEQAQTLGQDSLGPPEHFQGGPRGNEPAAHPPRWSTPSSYEDPAGGKHCEHPISGLEVLEAEQNSLHLCLLGLGRRLQDLEQGLGHWALAQSGMVQLQALQVDLRGAAERVEALLAFGEGLAQRSEPRAWAALEQILRALGAYRDSIFRRLWQLQAQLVSYSLVFEEANTLDQDLEVEGDSDWPGPGGVWGPWAPSSLPTSTELEWDPAGDIGGLGPLGQKTARTLGVPCELCGQRGPQGRGQGLEEADTSHSRQDMLESGLGHQKRLARHQRHSLLRKPQDKKRQASPHLQDVRLEGNPGAPDPASRQPLTFLLILFLLFLLLVGAMFLLPASGGPCCSHARIPRTPYLVLSYVNGLPPV

SEQ ID NO: 9247 - protein, 291 aa, Artificial Sequence
  Description of Artificial Sequence: Synthetic coding sequence
MALSLPLGPRLGSEPLNHPPGAPREADIVGCTVCPASGEESTSPEQAQTLGQDSLGPPEHFQGGPRGNEPAAHPPRWSTPSSYEDPAGGKHCEVFEEANTLDQDLEVEGDSDWPGPGGVWGPWAPSSLPTSTELEWDPAGDIGGLGPLGQKTARTLGVPCELCGQRGPQGRGQGLEEADTSHSRQDMLESGLGHQKRLARHQRHSLLRKPQDKKRQASPHLQDVRLEGNPGAPDPASRQPLTFLLILFLLFLLLVGAMFLLPASGGPCCSHARIPRTPYLVLSYVNGLPPV

SEQ ID NO: 9248 - protein, 187 aa, Artificial Sequence
  Description of Artificial Sequence: Synthetic coding sequence
MEVEEIYKHQEVKMQAPAFRDKKQGVSAKNQGAHDPDYENITLAFKNQDHAKGGHSRPTSQVPAQCRPPSDSTQVPCWLYRAILSLYILLALAFVLCIILSAFIMVKNAEMSKELLGFKRELWNVSNSVQACEERQKRGWDSVQQSITMVRSKIDRLETTLAGIKNIDTKVQKILEVLQKMPQSSPQ

SEQ ID NO: 9249 - protein, 118 aa, Artificial Sequence
  Description of Artificial Sequence: Synthetic coding sequence
MVARVWSLMRFLIKGSVAGGAVYLVYDQELLGPSDKSQAALQKAGEVVPPAMYQFSQYVCQQTGLQIPQLPAPPKIYFPIRDSWNAGIMTVMSALSVAPSKAREYSKEGWEYVKARTK

SEQ ID NO: 9250 - protein, 197 aa, Artificial Sequence
  Description of Artificial Sequence: Synthetic coding sequence
MLPLLQLVPAKLLNSSCSLEKTLQCSCSFHGIPTPSVQWWMGGVPVGVDGMDGSLQVTSTMLGPWANSTISLTEEPEMGMRLLCEGKNQNGTHALSILLMSRKSSLAAQAFVKGLIQGAIYAGIVIALLFLCLLPLIVKHIRKKQAKKAAAIRAKKSSKVRASQELEMSLKPEEPGKPVVATFSESRILEKQDKRAS

SEQ ID NO: 9251 - protein, 130 aa, Artificial Sequence
  Description of Artificial Sequence: Synthetic coding sequence
METLGALLVLEFLLLSPVEAQQATEHRLKPWLVGLAAVVGFLFIVYLVLLANRLWCSKARAEDEEETTFRMESNLYQDQSEDKREKKEAKEKEEKRKKEKKTAKEGESNLGLDLEEKEPGDHERAKSTVM

SEQ ID NO: 9252 - protein, 371 aa, Artificial Sequence
  Description of Artificial Sequence: Synthetic coding sequence
MAWTKYQLFLAGLMLVTGSINTLSAKWADNFMAEGCGGSKEHSFQHPFLQAVGMFLGEFSCLAAFYLLRCRAAGQSDSSVDPQQPFNPLLFLPPALCDMTGTSLMYVALNMTSASSFQMLRGAVIIFTGLFSVAFLGRRLVLSQWLGILATIAGLVVVGLADLLSKHDSQHKLSEVITGDLLIIMAQIIVAIQMVLEEKFVYKHNVHPLRAVGTEGLFGFVILSLLLVPMYYIPAGSFSGNPRGTLEDALDAFCQVGQQPLIAVALLGNISSIAFFNFAGISVTKELSATTRMVLDSLRTVVIWALSLALGWEAFHALQILGFLILLIGTALYNGLHRPLLGRLSRGRPLAEESEQERLLGGTRTPINDAS

SEQ ID NO: 9253 - protein, 288 aa, Artificial Sequence
  Description of Artificial Sequence: Synthetic coding sequence
MGGQFHGRGLWREQGAQLPASLPPALNMTSASSFQMLRGAVIIFTGLFSVAFLGRRLVLSQWLGILATIAGLVVVGLADLLSKHDSQHKLSEVITGDLLIIMAQIIVAIQMVLEEKFVYKHNVHPLRAVGTEGLFGFVILSLLLVPMYYIPAGSFSGNPRGTLEDALDAFCQVGQQPLIAVALLGNISSIAFFNFAGISVTKELSATTRMVLDSLRTVVIWALSLALGWEAFHALQILGFLILLIGTALYNGLHRPLLGRLSRGRPLAEESEQERLLGGTRTPINDAS

SEQ ID NO: 9254 - protein, 284 aa, Artificial Sequence
  Description of Artificial Sequence: Synthetic coding sequence
MKTSAELHEQEKPPSSPRATGPGRLGHARGRGPDALRGGAAGPGRASSGAPRERKMAPHDPGSLTTLVPWAAALLLALGVERALALPEICTQCPGSVQNLSKVAFYCKTTRELMLHARCCLNQKGTILGLDLQNCSLEDPGPNFHQAHTTVIIDLQANPLKGDLANTFRGFTQLQTLILPQHVNCPGGINAWNTITSYIDNQICQGQKNLCNNTGDPEMCPENGSCVPDGPGLLQCVCADGFHGYKCMRQGSFSLLMFFGILGATTLSVSILLWATQRRKAKTS

SEQ ID NO: 9255 - protein, 171 aa, Artificial Sequence
  Description of Artificial Sequence: Synthetic coding sequence
MLHARCCLNQKGTILGLDLQNCSLEDPGPNFHQAHTTVIIDLQANPLKGDLANTFRGFTQLQTLILPQHVNCPGGINAWNTITSYIDNQICQGQKNLCNNTGDPEMCPENGSCVPDGPGLLQCVCADGFHGYKCMRQGSFSLLMFFGILGATTLSVSILLWATQRRKAKTS

SEQ ID NO: 9256 - protein, 75 aa, Artificial Sequence
  Description of Artificial Sequence: Synthetic coding sequence
MLHARCCLNQKGTILGLDLQNCSLEDPGPNFHQAHTTVIIDLQANPLKGDLANTFRGFTQLQTLILPQHVNCPGG

SEQ ID NO: 9257 - protein, 291 aa, Artificial Sequence
  Description of Artificial Sequence: Synthetic coding sequence
MALAARLLPQFLHSRSLPCGAVRLRTPAVAEVRLPSATLCYFCRCRLGLGAALFPRSARALAASALPAQGSRWPVLSSPGLPAAFASFPACPQRSYSTEEKPQQHQKTKMIVLGFSNPINWVRTRIKAFLIWAYFDKEFSITEFSEGAKQAFAHVSKLLSQCKFDLLEELVAKEVLHALKEKVTSLPDNHKNALAANIDEIVFTSTGDISIYYDEKGRKFVNILMCFWYLTSANIPSETLRGASVFQVKLGNQNVETKQLLSASYEFQREFTQGVKPDWTIARIEHSKLLE

SEQ ID NO: 9258 - protein, 291 aa, Artificial Sequence; identical to SEQ ID NO: 9257
  Description of Artificial Sequence: Synthetic coding sequence

SEQ ID NO: 9259 - protein, 441 aa, Artificial Sequence
  Description of Artificial Sequence: Synthetic coding sequence
MSVLLRSGLGPLCAVARAAIPFIWRGKYFSSGNEPAENPVTPMLRHLMYKIKSTGPITVAEYMKEVLTNPAKGYYVYRDMLGEKGDFITSPEISQIFGELLGIWFISEWMATGKSTAFQLVELGPGRGTLVGDILRVFTQLGSVLKNCDISVHLVEVSQKLSEIQALTLTKEKVPLERNAGSPVYMKGVTKSGIPISWYRDLHDVPKGYSFYLAHEFFDVLPVHKFQKTPQGWREVFVDIDPQVSDKLRFVLAPSATPAEAFIQHDETRDHVEVCPDAGVIIEELSQRIALTGGAALVADYGHDGTKTDTFRGFCDHKLHDVLIAPGTADLTADVDFSYLRRMAQGKVASLGPIKQHTFLKNMGIDVRLKVLLDKSNEPSVRQQLLQGYDMLMNPKKMGERFNFFALLPHQRLQGGRYQRNARQSKPFASVVAGFSELAWQ

SEQ ID NO: 9260 - protein, 530 aa, Artificial Sequence
  Description of Artificial Sequence: Synthetic coding sequence
MHPGRTTGKGPSTHTQIDQQPPRLLIVHIALPSWADICTNLCEALQNFFSLACSLMGPSRMSLFSLYMVQDQHECILPFVQVKGNFARLQTCISELRMLQREGCFRSQGASLRLAVEDGLQQFKQYSRHVTTRAALTYTSLEITILTSQPGKEVVKQLEEGLKDTDLARVRRFQVVEVTKGILEHVDSASPVEDTSNDESSILGTDIDLQTIDNDIVSMEIFFKAWLHNSGTDQEQIHLLLSSQCFSNISRPRDNPMCLKCDLQERLLCPSLLAGTADGSLRMDDPKGDFITLYQMASQSSASHYKLQVIKALKSSGLCESLTYGLPFILRPTSCWQLDWDELETNQQHFHALCHSLLKREWLLLAKGEPPGPGHSQRIPASTFYVIMPSHSLTLLVKAVATRELMLPSTFPLLPEDPHDDSLKNVESMLDSLELEPTYNPLHVQSHLYSHLSSIYAKPQGRLHPHWESRAPRKHPCKTGQLQTNRARATVAPLPMTPVPGRASKMPAASKSSSDAFFLPSEWEKDPSRP

SEQ ID NO: 9261 - protein, 179 aa, Artificial Sequence
  Description of Artificial Sequence: Synthetic coding sequence
MDDPKGDFITLYQMASQSSASHYKLQVIKALKSSGLCESLTYGLPFILRPTSCWQLDWDELETNQQHFHALCHSLLSMLDSLELEPTYNPLHVQSHLYSHLSSIYAKPQGRLHPHWESRAPRKHPCKTGQLQTNRARATVAPLPMTPVPGRASKMPAASKSSSDAFFLPSEWEKDPSRP

SEQ ID NO: 9262 - protein, 142 aa, Artificial Sequence
  Description of Artificial Sequence: Synthetic coding sequence
MHPGRTTGKGPSTHTQIDQQPPRLLIVHIALPSWADICTNLCEALQNFFSLACSLMGPSRMSLFSLYMVQDQHECILPFVQVKGNFARLQTCISELRMLQREGCFRSQGASLRLAVEDGLQQFKQYSRHVTTRAALTYTSLE

SEQ ID NO: 9263 - protein, 526 aa, Artificial Sequence
  Description of Artificial Sequence: Synthetic coding sequence
MHPGRTTGKGPSTHTQIDQQPPRLLIVHIALPSWADICTNLCEALQNFFSLACSLMGPSRMSLFSLYMVQDQHECILPFVQVKGNFARLQTCISELRMLQREGCFRSQGASLRLAVEDGLQQFKQYSRHVTTRAALTYTSLEITILTSQPGKEVVKQLEEGLKDTDLARVRRFQVVEVTKGILEHVDSASPVEDTSNDESSILGTDIDLQTIDNDIVSMEIFFKAWLHNSGTDQEQIHLLLSSQCFSNISRPRDNPMCLKCDLQERLLCPSLLAGTADGSLRMDDPKGDFITLYQMASQSSASHYKLQVIKALKSSGLCESLTYGLPFILRPTSCWQLDWDELETNQQHFHALCHSLLKREWLLLAKGEPPGPGHSQRIPASTFYVIMPSHSLTLLVKAVATRELMLPSTFPLLPEDPHDDSLKNVESMLDSLELEPTYNPLHVQSHLYSHLSSIYAKPQGRLHPHWESRAPRKTGQLQTNRARATVAPLPMTPVPGRASKMPAASKSSSDAFFLPSEWEKDPSRP

SEQ ID NO: 9264 - protein, 287 aa, Artificial Sequence
  Description of Artificial Sequence: Synthetic coding sequence
MEEKEDKHQQHKIEDAAITYVSENEEIKHEEKPGKSIHHSKSHVGRGRIYYAKFINTNARTYNEPFPYIDPKKGPEIQGDWWSHGKALEPVFLPPYDSKSTQRSDFQKPSCPLVLPVKHSKMQKPSCGIVPLASPGTSAELQNNFIEYISFIHQYDARKTPNEPLQGKRHGAFVQREIKPGSRPTVPKGAEVLLNTPGSRSSEQSKKTEKGNSAESRMISPGLCQQNSQELLEPKTHLSETDVRQAAKACPSTPESREKTSGATQTTVGDALFTRHKPLNPPIKKSE

SEQ ID NO: 9265 - protein, 121 aa, Artificial Sequence
  Description of Artificial Sequence: Synthetic coding sequence
MASCLALRMALLLVSGVLAPAVLTDDVPQEPVPTLWNEPAELPSGEGPVESTSPGREPVDTGPPAPTVAPGPEDSTAQERLDQGGGSLGPGAIAAIVIAALLATCVVLALVVVALRKFSAS

SEQ ID NO: 9266 - protein, 121 aa, Artificial Sequence; identical to SEQ ID NO: 9265
  Description of Artificial Sequence: Synthetic coding sequence

SEQ ID NO: 9267 - protein, 121 aa, Artificial Sequence; identical to SEQ ID NO: 9265
  Description of Artificial Sequence: Synthetic coding sequence

SEQ ID NO: 9268 - protein, 456 aa, Artificial Sequence
  Description of Artificial Sequence: Synthetic coding sequence
MSPWSWFLLQTLCLLPTGAASRRGAPGTANCELKPQQSELNSFLWTIKRDPPSYFFGTIHVPYTRVWDFIPDNSKEAFLQSSIVYFELDLTDPYTISALTSCQMLPQGENLQDVLPRDIYCRLKRHLEYVKLMMPLWMTPDQRGKGLYADYLFNAIAGNWERKRPVWVMLMVNSLTEVDIKSRGVPVLDLFLAQEAERLRKQTGAVEKVEEQCHPLNGLNFSQVPNFINATLPPQERITAQEIDSYLRRELIYKRNERIGKRVKALLEEFPDKGFFFAFGAGHFMGNNTVLDVLRREGYEVEHAPAGRPIHKGKSKKTSTRPTLSTIFAPKVPTLEVPAPEAVSSGHSTLPPLVSRPGSADTPSEAEQRFRKKRRRSQRRPRLRQFSDLWVRLEESDIVPQLQVPVLDRHISTELRLPRRGHSHHSQMVASSACLSLWTPVFWVLVLAFQTETPLL

SEQ ID NO: 9269 - protein, 505 aa, Artificial Sequence
  Description of Artificial Sequence: Synthetic coding sequence
MSPWSWFLLQTLCLLPTGAASRRGAPGTANCELKPQQSELNSFLWTIKRDPPSYFFGTIHVPYTRVWDFIPDNSKEAFLQSSIVYFELDLTDPYTISALTSCQMLPQGENLQDVLPRDIYCRLKRHLEYVKLMMPLWMTPDQRGKGLYADYLFNAIAGNWERKRPVWVMLMVNSLTEVDIKSRGVPVLDLFLAQEAERLRKQTGAVEKVEEQCHPLNGLNFSQVIFALNQTLLQQESLRAGSLQIPYTTEDLIKHYNCGDLSSVILSHDSSQVPNFINATLPPQERITAQEIDSYLRRELIYKRNERIGKRVKALLEEFPDKGFFFAFGAGHFMGNNTVLDVLRREGYEVEHAPAGRPIHKGKSKKTSTRPTLSTIFAPKVPTLEVPAPEAVSSGHSTLPPLVSRPGSADTPSEAEQRFRKKRRRSQRRPRLRQFSDLWVRLEESDIVPQLQVPVLDRHISTELRLPRRGHSHHSQMVASSACLSLWTPVFWVLVLAFQTETPLL

SEQ ID NO: 9270 - protein, 215 aa, Artificial Sequence
  Description of Artificial Sequence: Synthetic coding sequence
MRGLRWRYTRLPSQVEDTLSGEEGNEEEEEEEAAPDPAAAPEDPTVPQLTEASQVLSASEIRQLSFHFPPRVTGHPWSLVFCTSRDGFSLQSLYRRMEGCSGPVLLVLRDQDGQIFGAFSSSAIRLSKGFYGTGETFLFSFSPQLKVFKWTGSNSFFVKGDLDSLMMGSGSGRFGLWLDGDLFRGGSSPCPTFNNEVLARQEQFCIQELEAWLLS

SEQ ID NO: 9271 - protein, 566 aa, Artificial Sequence
  Description of Artificial Sequence: Synthetic coding sequence
MPGHPGAAEQLVKTGWRSWHLGFWKALAPLQAAWDAFSQPVPASCGQLLTQLLLCASLAAAAAGLVYHWLASLLLYPPGPSAMVATVCGLLVFLSLGLVPPVRCLFALSVPTLGMEQGRRLLLSYSTATLAIAVVPNVLANVGAAGQVLRCVTEGSLESLLNTTHQLHAASRALGPTGQAGSRGLTFEAQDNGSAFYLHMLRVTQQVLEDFSGLESLARAAALGTQRVVTGLFMLGLLVESAWYLHCYLTDLRFDNIYATQQLTQRLAQAQATHLLAPPPTWLLQAAQLRLSQEELLSCLLRLGLLALLLVATAVAVATDHVAFLLAQATVDWAQKLPTVPITLTVKYDVAYTVLGFIPFLFNQLAPESPFLSVHSSYQWELRLTSARCPLLPARRPRAAAPLAAGALQLLAGSTVLLEAYARRLRHAIAASFFTAQEARRVRHLHARLQRRHDRHQGQQLPLGDPSCVPTPRPACKPPAWIDYRLDALRTESSEGEGKELWSCRDLSCNLGPVPPPCVTLGKSLHLSEPRFLHLHNDSIFTIDVTYFPRRDVVRMEGNTGHDRPG

SEQ ID NO: 9272 - protein, 143 aa, Artificial Sequence
  Description of Artificial Sequence: Synthetic coding sequence
MSGGRRKEEPPQPQLANGALKVSVWSKVLRSDAAWEDKDEFLDVIYWFRQIIAVVLGVIWGVLPLRGFLGIAGSFGSSFTLPSIMTDGVQLPSAPYPVQRTLLITAQELDRWGTPAPWNLEDPCFLDRESVCWASVFSARVVT

SEQ ID NO: 9273 - protein, 129 aa, Artificial Sequence
  Description of Artificial Sequence: Synthetic coding sequence
MSGGRRKEEPPQPQLANGALKVSVWSKVLRSDAAWEDKDEFLDVIYWFRQIIAVVLGVIWGVLPLRGFLGIAGFCLINAGVLYLYFSNYLQIDEEEYGGTWELTKEGFMTSFALFMVIWIIFYTAIHYD

SEQ ID NO: 9274 - protein, 137 aa, Artificial Sequence
  Description of Artificial Sequence: Synthetic coding sequence
MSGGRRKEEPPQPQLANGALKVSVWSKVLRSDAAWEDKDEFLDVIYWFRQIIAVVLGVIWGVLPLRGFLGIAGFCLINAGVLYLYFSNYLQIDEEEYGGTWELTKEGFMTSFALFMVCVADSFTTGHLDHLLHCHPL

SEQ ID NO: 9275 - protein, 416 aa, Artificial Sequence
  Description of Artificial Sequence: Synthetic coding sequence
MSEADGLRQRRPLRPQVVTDDDGQAPEAKDGSSFSGRVFRVTFLMLAVSLTVPLLGAMMLLESPIDPQPLSFKEPPLLLGVLHPNTKLRQAERLFENQLVGPESIAHIGDVMFTGTADGRVVKLENGEIETIARFGSGPCKTRDDEPVCGRPLGIRAGPNGTLFVADAYKGLFEVNPWKREVKLLLSSETPIEGKNMSFVNDLTVTQDGRKIYFTDSSSKWQRRDYLLLVMEGTDDGRLLEYDTVTREVKVLLDQLRFPNGVQLSPAEDFVLVAETTMARIRRVYVSGLMKGGADLFVENMPGFPDNIRPSSSGGYWVGMSTIRPNPGFSMLDFLSERPWIKRMIFKLFSQETVMKFVPRYSLVLELSDSGAFRRSLHDPDGLVATYISEVHEHDGHLYLGSFRSPFLCRLSLQAV

SEQ ID NO: 9276 - protein, 289 aa, Artificial Sequence
  Description of Artificial Sequence: Synthetic coding sequence
MSEADGLRQRRPLRPQVVTDDDGQAPEAKDGSSFSGRVFRVTFLMLAVSLTVPLLGAMMLLESPIDPQPLSFKEPPLLLGVLHPNTKLRQAERLFENQLVGPESIAHIGDVMFTGTADGRVVKLENGEIETIARFGSGPCKTRDDEPVCGRPLGIRAGPNGTLFVADAYKGLFEVNPWKREVKLLLSSETPIEGKNMSFVNDLTVTQDGRKIYFTDSSSKWQRRDYLLLVMEGTDDGRLLEYDTVTREVKVLLDQLRFPNGVQLSPAEDFVLVAETTMARIRSSLVKRR

SEQ ID NO: 9277 - protein, 409 aa, Artificial Sequence
  Description of Artificial Sequence: Synthetic coding sequence
  MOD_RES (1)..(1): Any amino acid
XVVTDDDGQAPEAKDGSSFSGRVFRVTFLMLAVSLTVPLLGAMMLLESPIDPQPLSFKEPPLLLGVLHPNTKLRQAERLFENQLVGPESIAHIGDVMFTGTADGRVVKLENGEIETIARFGSGPCKTRDDEPVCGRPLGIRAGPNGTLFVADAYKGLFEVNPWKREVKLLLSSETPIEGKNMSFVNDLTVTQDGRKIYFTDSSSKWQRRDYLLLVMEGTDDGRLLEYDTVTREVKVLLDQLRFPNGVQLSPAEDFVLVAETTMARIRRVYVSGLMKGGADLFVENMPGFPDNIRPSSSGGYWVGMSTIRPNPGFSMLDFLSERPWIKRMIFKGSCAGCDLLFSQETVMKFVPRYSLVLELSDSGAFRRSLHDPDGLVATYISEVHEHDGHLYLGSFRSPFLCRLSLQAV

SEQ ID NO: 9278 - protein, 120 aa, Artificial Sequence
  Description of Artificial Sequence: Synthetic coding sequence
MMPSRTNLATGIPSSKVKYSRLSSTDDGYIDLQFKKTPPKIPYKAIALATVLFLIGAFLIIIGSLLLSGYISKGGADRAVPVLIIGILVFLPGFYHLRIAYYASKGYRGYSYDDIPDFDD

SEQ ID NO: 9279 - protein, 183 aa, Artificial Sequence
  Description of Artificial Sequence: Synthetic coding sequence
MQPWALPTVGELWVCGRPGAALRWSLVLSPRLEPSGVISAHCNLHLLASSDSSASASRLCQRVMMPSRTNLATGIPSSKVKYSRLSSTDDGYIDLQFKKTPPKIPYKAIALATVLFLIGAFLIIIGSLLLSGYISKGGADRAVPVLIIGILVFLPGFYHLRIAYYASKGYRGYSYDDIPDFDD

SEQ ID NO: 9280 - protein, 74 aa, Artificial Sequence
  Description of Artificial Sequence: Synthetic coding sequence
MMPSRTNLATGIPSSKVKYSRLSSTDDGYIDLQFKKTPPKIPYKAIALATVLFLIGAFLIIIGSLLLSGYISKG

SEQ ID NO: 9281 - protein, 120 aa, Artificial Sequence; identical to SEQ ID NO: 9278
  Description of Artificial Sequence: Synthetic coding sequence

SEQ ID NO: 9282 - protein, 120 aa, Artificial Sequence; identical to SEQ ID NO: 9278
  Description of Artificial Sequence: Synthetic coding sequence

SEQ ID NO: 9283 - protein, 120 aa, Artificial Sequence; identical to SEQ ID NO: 9278
  Description of Artificial Sequence: Synthetic coding sequence

SEQ ID NO: 9284 - protein, 120 aa, Artificial Sequence; identical to SEQ ID NO: 9278
  Description of Artificial Sequence: Synthetic coding sequence

SEQ ID NO: 9285 - protein, 120 aa, Artificial Sequence; identical to SEQ ID NO: 9278
  Description of Artificial Sequence: Synthetic coding sequence

SEQ ID NO: 9286 - protein, 252 aa, Artificial Sequence
  Description of Artificial Sequence: Synthetic coding sequence
MKMKLFQTICRQLRSSKFSVESAALVAFSTSSYSCGRKKKVNPYEEVDQEKYSNLVQSVLSSRGVAQTPGSVEEDALLCGPVSKHKLPNQGEDRRVPQNWFPIFNPERSDKPNASDPSVPLKIPLQRNVIPSVTRVLQQTMTKQQVFLLERWKQRMILELGEDGFKEYTSSSMWLNCGGLQRWITCPPTFHGCRALFPVLDQVASSTRRIYGKEKEPEYSETRIFRIGSKLLFGNIQHLLTVWEHILLFTPV

SEQ ID NO: 9287 - protein, 264 aa, Artificial Sequence
  Description of Artificial Sequence: Synthetic coding sequence
MKMKLFQTICRQLRSSKFSVESAALVAFSTSSYSCGRKKKVNPYEEVDQEKYSNLVQSVLSSRGVAQTPGSVEEDALLCGPVSKHKLPNQDVFLQGKRFHEALESILSPQETLKERDENLLKSGYIESVQHILKDVSGVRALESAVQHETLNYIGLLDCVAEYQGKLCVIDWKTSEKPKPFIQSTFDNPLQVVAYMGAMNHDTNYSFQVQCGLIVVAYKDGSPAHPHFMDAELCSQYWTKWLLRLEEYTEKKKNQNIQKPEYSE

SEQ ID NO: 9288 - protein, 344 aa, Artificial Sequence
  Description of Artificial Sequence: Synthetic coding sequence
MKMKLFQTICRQLRSSKFSVESAALVAFSTSSYSCGRKKKVNPYEEVDQEKYSNLVQSVLSSRGVAQTPGSVEEDALLCGPVSKHKLPNQGEDRRVPQNWFPIFNPERSDKPNASDPSVPLKIPLQRNVIPSVTRVLQQTMTKQQVFLLERWKQRMILELGEDGFKEYTSNVFLQGKRFHEALESILSPQETLKERDENLLKSGYIESVQHILKDVSGVRALESAVQHETLNYIGLLDCVAEYQGKLCVIDWKTSEKPKPFIQSTFDNPLQVVAYMGAMNHDTNYSFQVQCGLIVVAYKDGSPAHPHFMDAELCSQYWTKWLLRLEEYTEKKKNQNIQKPEYSE

SEQ ID NO: 9289 - protein, 441 aa, Artificial Sequence
  Description of Artificial Sequence: Synthetic coding sequence
MLLPGRARQPPTPQPVQHPGLRRQVEPPGQLLRLFYCTVLVCSKEISALTDFSGYLTKLLQNHTTYACDGDYLNLQCPRHSTISVQSAFYGQDYQMCSSQKPASQREDSLTCVAATTFQKVLDECQNQRACHLLVNSRVFGPDLCPGSSKYLLVSFKCQPNELKNKTVCEDQELKLHCHESKFLNIYSATYGRRTQERDICSSKAERLPPFDCLSYSALQVLSRRCYGKQRCKIIVNNHHFGSPCLPGVKKYLTVTYACVPKNILTAIDPAIANLKPSLKQKDGEYGINFDPSGSKVLRKDGILVSNSLAAFAYIRAHPERAALLFVSSVCIGLALTLCALVIRESCAKDFRDLQLGREQLVPGSDKVEEDSEDEEEEEDPSESDFPGELSGFCRTSYPIYSSIEAAELAERIERREQIIQEIWMNSGLDTSLPRNMGQFY

SEQ ID NO: 9290 - protein, 204 aa, Artificial Sequence
  Description of Artificial Sequence: Synthetic coding sequence
MGWDCRRTTVENPSPIRNCVNQEWPEGSSPGLTEGNTGLVRDLRPAHQDRSGTREDPAGQETTAITNPSPSLAADLAGDALPGCLGAAAHQGPLLDRSSESTLGPQALELEHCHERGCCRGCASFSPFPAPRCPSERLGAHSSRWAIRGRSKINPPPWAPACLPGGFPACLPAPKSSTDSASSCFKGGREFSDPLDIPGAGAMG

SEQ ID NO: 9291 - protein, 82 aa, Artificial Sequence
  Description of Artificial Sequence: Synthetic coding sequence
MGWDCRRTTVENPSPIRNCVNQEWPEGSSPGLTEGNTGLVRDLRPAHQDRSGTREDPAGQETTAITNPSPSCTSGASAGQKL

SEQ ID NO: 9292 - protein, 160 aa, Artificial Sequence
  Description of Artificial Sequence: Synthetic coding sequence
MTTQEDTTGLHQKTSLWTMSRPGAKKVMNSYFIAGCGPAVCYYAVSWLRQGFSINLTSFGRIPWPHAGVGTCPSPQSWISPFLQSHREHHYAKTSSHSQPSPQSLALCLAYSRCSINICQMTECISLASGCHQALREPGRSEESFWIPATPYISNIFSES

SEQ ID NO: 9293 - protein, 227 aa, Artificial Sequence
  Description of Artificial Sequence: Synthetic coding sequence
MVPTGWAGLGGAVVHGPGKLEKAVPSPRALDFLSVKWEAAMMNGKVPFFFSSESLGYFATGRPADNVMTTQEDTTGLHQKTSLWTMSRPGAKKVMNSYFIAGCGPAVCYYAVSWLRQGFSINLTSFGRIPWPHAGVGTCPSPQSWISPFLQSHREHHYAKTSSHSQPSPQSLALCLAYSRCSINICQMTECISLASGCHQALREPGRSEESFWIPATPYISNIFSES

SEQ ID NO: 9294 - protein, 276 aa, Artificial Sequence
  Description of Artificial Sequence: Synthetic coding sequence
MCIIFFKFDPRPVSKNAYRLILAANRDEFYSRPSKLADFWGNNNEILSGLDMEEGKEGGTWLGISTRGKLAALTNYLQPQLDWQARGRGELVTHFLTTDVDSLSYLKKVSMEGHLYNGFNLIAADLSTAKGDVICYYGNRGEPDPIVLTPGTYGLSNALLETPWRKLCFGKQLFLEAVERSQALPKDVLIASLLDVLNNEEAQLPDPAIEDQGGEYVQPMLSKYAAVCVRCPGYGTRTNTIILVDADGHVTFTERSMMDKDLSHWETRTYEFTLQS

SEQ ID NO: 9295 - protein, 214 aa, Artificial Sequence
  Description of Artificial Sequence: Synthetic coding sequence
MCIIFFKFDPRPVSKNAYRLILAANRDEFYSRPSKLADFWGNNNEILSGLDMEEGKEGGTWLGISTRGKLAALTNYLQPQLDWQARGRGTYGLSNALLETPWRKLCFGKQLFLEAVERSQALPKDVLIASLLDVLNNEEAQLPDPAIEDQGGEYVQPMLSKYAAVCVRCPGYGTRTNTIILVDADGHVTFTERSMMDKDLSHWETRTYEFTLQS

SEQ ID NO: 9296 - protein, 214 aa, Artificial Sequence; identical to SEQ ID NO: 9295
  Description of Artificial Sequence: Synthetic coding sequence

SEQ ID NO: 9297 - protein, 178 aa, Artificial Sequence
  Description of Artificial Sequence: Synthetic coding sequence
MAGHQHTWQAGSTHQLPAAAAGLAGPRASTAKGDVICYYGNRGEPDPIVLTPGTYGLSNALLETPWRKLCFGKQLFLEAVERSQALPKDVLIASLLDVLNNEEAQLPDPAIEDQGGEYVQPMLSKYAAVCVRCPGYGTRTNTIILVDADGHVTFTERSMMDKDLSHWETRTYEFTLQS

SEQ ID NO: 9298 - protein, 88 aa, Artificial Sequence
  Description of Artificial Sequence: Synthetic coding sequence
MCIIFFKFDPRPVSKNAYRLILAANRDEFYSRPSKLADFWGNNNEILSGLDMEEGKEGGTWLGISTRGKLAALTNYLQPQLDWQARGR

SEQ ID NO: 9299 - protein, 214 aa, Artificial Sequence; identical to SEQ ID NO: 9295
  Description of Artificial Sequence: Synthetic coding sequence

SEQ ID NO: 9300 - protein, 226 aa, Artificial Sequence
  Description of Artificial Sequence: Synthetic coding sequence
MCIIFFKFDPRPVSKNAYRLILAANRDEFYSRPSKLADFWGNNNEILSGLDMEEGKEGGTWLGISTRGKLAALTNYLQPQLDWQARGRGELVTHFLTTDVDSLSYLKKVSMEGHLYNGFNLIAADLSTAKGDVICYYGNRGEPDPIVLTPGTYGLSNALLETPWRKLCFGKQLFLEAVERSQALPKDVLIASLLDVLNNEEAQLPDPAIEDQGGEYVQPMLSKYAA

SEQ ID NO: 9301 - protein, 198 aa, Artificial Sequence
  Description of Artificial Sequence: Synthetic coding sequence
MPPKLLCAGRCVGQDGAAQAWHCPPGQGHSVWDAVRMPLGAGTPVNVQRREDSATEGSHRLILAANRDEFYSRPSKLADFWGNNNEILSGLDMEEGKEGGTWLGISTRGKLAALTNYLQPQLDWQARGRGELVTHFLTTDVDSLSYLKKVSMEGHLYNGFNLIAADLSTAKGDVICYYGNRGEPDPIVLTPEPTLSSW

SEQ ID NO: 9302 - protein, 276 aa, Artificial Sequence; identical to SEQ ID NO: 9294
  Description of Artificial Sequence: Synthetic coding sequence

SEQ ID NO: 9303 - protein, 165 aa, Artificial Sequence
  Description of Artificial Sequence: Synthetic coding sequence
MCIIFFKFDPRPVSKNAYRLILAANRDEFYSRPSKLADFWGNNNEILSGLDMEEGKEGGTWLGISTRGKLAALTNYLQPQLDWQARGRGELVTHFLTTDVDSLSYLKKVSMEGHLYNGFNLIAADLSTAKGDVICYYGNRGEPDPIVLTPGTYGLSNALLETPWR

SEQ ID NO: 9304 - protein, 281 aa, Artificial Sequence [sequence omitted]

SEQ ID NO: 9305 - protein, 107 aa, Artificial Sequence
  Description of Artificial Sequence: Synthetic coding sequence
MASGAARWLVLAPVRSGALRSGPSLRKDGDVSAAWSGSGRSLVPSRSVIVTRSGAILPKPVKMSFGLLRVFSIVIPFLYVGTLISKNFAALLEEHDIFVPEDDDDDD

SEQ ID NO: 9306 - protein, 567 aa, Artificial Sequence
  Description of Artificial Sequence: Synthetic coding sequence
MMAAVPPGLEPWNRVRIPKAGNRSAVTVQNPGAALDLCIAAVIKECHLVILSLKSQTLDAETDVLCAVLYSNHNRMGRHKPHLALKQVEQCLKRLKNMNLEGSIQDLFELFSSNENQPLTTKVCVVPSQPVVELVLMKVLGACKLLLRLLDCCCKTFLLTVKHLGLQEFIILNLVMVGLVSRLWVLYKGVLKRLILLYEPLFGLLQEVARIQPMPYFKDFTFPSDITEFLGQPYFEAFKKKMPIAFAAKGINKLLNKLFLINEQSPRASEETLLGISKKAKQMKINVQNNVDLGQPVKNKRVFKEESSEFDVRAFCNQLKHKATQETSFDFKCSQSRLKTTKYSSQKVIGTPHAKSFVQRFREAESFTQLSEEIQMAVVWCRSKKLKAQAIFLGNKLLKSNRLKHLEAQGTSLPKKLECIKTSICNHLLRGSGIKTSKHHLRQRRSQNKFLRRQRKPQRKLQSTLLREIQQFSQGTRKSATDTSAKWRLSHCTVHRTDLYPNSKQLLNSGVSMPVIQTKEKMIHENLRGIHENETDSWTVMQINKNSTSGTIKETDDIDDIFALMGV

SEQ ID NO: 9307 - protein, 497 aa, Artificial Sequence
  Description of Artificial Sequence: Synthetic coding sequence
MMAAVPPGLEPWNRVRIPKAGNRSAVTVQNPGAALDLCIAAVIKECHLVILSLKSQTLDAETDVLCAVLYSNHNRMGRHKPHLALKQVEQCLKRLKNMNLEGSIQDLFELFSSKVLYKGVLKRLILLYEPLFGLLQEVARIQPMPYFKDFTFPSDITEFLGQPYFEAFKKKMPIAFAAKGINKLLNKLFLINEQSPRASEETLLGISKKAKQMKINVQNNVDLGQPVKNKRVFKEESSEFDVRAFCNQLKHKATQETSFDFKCSQSRLKTTKYSSQKVIGTPHAKSFVQRFREAESFTQLSEEIQMAVVWCRSKKLKAQAIFLGNKLLKSNRLKHLEAQGTSLPKKLECIKTSICNHLLRGSGIKTSKHHLRQRRSQNKFLRRQRKPQRKLQSTLLREIQQFSQGTRKSATDTSAKWRLSHCTVHRTDLYPNSKQLLNSGVSMPVIQTKEKMIHENLRGIHENETDSWTVMQINKNSTSGTIKETDDIDDIFALMGV

SEQ ID NO: 9308 - protein, 431 aa, Artificial Sequence
  Description of Artificial Sequence: Synthetic coding sequence
MKVLGACKLLLRLLDCCCKTFLLTVKHLGLQEFIILNLVMVGLVSRLWVLYKGVLKRLILLYEPLFGLLQEVARIQPMPYFKDFTFPSDITEFLGQPYFEAFKKKMPIAFAAKGINKLLNKLFLINEQSPRASEETLLGISKKAKQMKINVQNNVDLGQPVKNKRVFKEESSEFDVRAFCNQLKHKATQETSFDFKCSQSRLKTTKYSSQKVIGTPHAKSFVQRFREAESFTQLSEEIQMAVVWCRSKKLKAQAIFLGNKLLKSNRLKHLEAQGTSLPKKLECIKTSICNHLLRGSGIKTSKHHLRQRRSQNKFLRRQRKPQRKLQSTLLREIQQFSQGTRKSATDTSAKWRLSHCTVHRTDLYPNSKQLLNSGVSMPVIQTKEKMIHENLRGIHENETDSWTVMQINKNSTSGTIKETDDIDDIFALMGV

SEQ ID NO: 9309 - protein, 214 aa, Artificial Sequence
  Description of Artificial Sequence: Synthetic coding sequence
MPKVLCKDSERLSPSHNFLKKSRWQLYGAGKKLKAQAIFLGNKLLKSNRLKHLEAQGTSLPKKLECIKTSICNHLLRGSGIKTSKHHLRQRRSQNKFLRRQRKPQRKLQSTLLREIQQFSQGTRKSATDTSAKWRLSHCTVHRTDLYPNSKQLLNSGVSMPVIQTKEKMIHENLRGIHENETDSWTVMQINKNSTSGTIKETDDIDDIFALMGV

SEQ ID NO: 9310 - protein, 162 aa, Artificial Sequence
  Description of Artificial Sequence: Synthetic coding sequence
MNSRTASARGWFSSRPPTSESDLEPATDGPASETTTLSPEATTFNDTRIPDAAGGTAGVGTMLLSFGIITVIGLAVALVLYIRKKKRLEKLRHQLMPMYNFDPTEEQDELEQELLEHGRDAASVQAATSVQAMQGKTTLPSQGPLQRPSRLVFTDVANAIHA

SEQ ID NO: 9311 - protein, 162 aa, Artificial Sequence; identical to SEQ ID NO: 9310
  Description of Artificial Sequence: Synthetic coding sequence

SEQ ID NO: 9312 - protein, 142 aa, Artificial Sequence
  Description of Artificial Sequence: Synthetic coding sequence
MNSRTASARGWFSSRPPTSESDLEPATDGPASETTTLSPEATTFNDTRIPDAAGGTAGVLYIRKKKRLEKLRHQLMPMYNFDPTEEQDELEQELLEHGRDAASVQAATSVQAMQGKTTLPSQGPLQRPSRLVFTDVANAIHA

SEQ ID NO: 9313 - protein, 162 aa, Artificial Sequence; identical to SEQ ID NO: 9310
  Description of Artificial Sequence: Synthetic coding sequence

SEQ ID NO: 9314 - protein, 904 aa, Artificial Sequence
  Description of Artificial Sequence: Synthetic coding sequence
MSYIKSNLELYQQYTAMAPKLLARISKLLMICQNAGISVPKGIRNIFEFTWEELISDPSVPTPSDILGLEVSFGAPLVVLMEPTFVQVPTLKKPLPPPPPAPPRPVLLATTGAAKRSTLSPTMARQVRTHQETLNRFQQQSIHLLTELLRLKMKAMVESMSVGANPLDITRRFVEASQLLHLNAKEMAFNCLISTAGRSGYSSGQLWKESLANMSAIGVNSPYQLIYHSSTACLSFSLSAGKEAKKKIGKSRTTEDVSMPPLHRGVGTPANSLEFSDPCPEAREKLQELCRHIEAERATWKGRNISYPMILRNYKAKMPSHLMLARKGDSQTPGLHYPPTAGAQTLSPTSHPSSANHHFSQHCQEGKAPKKAFKFHYTFYDGSSFVYYPSGNVAVCQIPTCCRGRTITCLFNDIPGFSLLALFNTEGQGCVHYNLKTSCPYVLILDEEGGTTNDQQGYVVHKWSWTSRTETLLSLEYKVNEEMKLKVLGQDSITVTFTSLNETVTLTVSANNCPHGMAYDKRLNRRISNMDDKVYKMSRALAEIKKRFQKTVTQFINSILLAAGLFTIEYPTKKEEEEFVRFKMRSRTHPERLPKLSLYSGESLLRSQSGHLESSIAETLKDEPESAPVSPVRKTTKIHTKAKVTSRGKAREGRSPTRWAALPSDCPLVLRKLMLKEDTRAGCKCLVKAPLVSDVELERFLLAPRDPSQVLVFGIISSQNYTSTGQLQWLLNTLYNHQQRGRGSPCIQCRYDSYRLLQYDLDSPLQEDPPLMVKKNSVVQGMILMFAGGKLIFGGRVLNGYGLSKQNLLKQIFRSQQDYKMGYFLPDDYKFSVPNSVLSLEDSESVKKAESEDIQGSSSSLALEDYVEKELSLEAEKTREPEVELHPLSRDSKITSWKKQASKK

SEQ ID NO: 9315 - protein, 782 aa, Artificial Sequence
  Description of Artificial Sequence: Synthetic coding sequence
MARQVRTHQETLNRFQQQSIHLLTELLRLKMKAMVESMSVGANPLDITRRFVEASQLLHLNAKEMAFNCLISTAGRSGYSSGQLWKESLANMSAIGVNSPYQLIYHSSTACLSFSLSAGKEAKKKIGKSRTTEDVSMPPLHRGVGTPANSLEFSDPCPEAREKLQELCRHIEAERATWKGRNISYPMILRNYKAKMPSHLMLARKGDSQTPGLHYPPTAGAQTLSPTSHPSSANHHFSQHCQEGKAPKKAFKFHYTFYDGSSFVYYPSGNVAVCQIPTCCRGRTITCLFNDIPGFSLLALFNTEGQGCVHYNLKTSCPYVLILDEEGGTTNDQQGYVVHKWSWTSRTETLLSLEYKVNEEMKLKVLGQDSITVTFTSLNETVTLTVSANNCPHGMAYDKRLNRRISNMDDKVYKMSRALAEIKKRFQKTVTQFINSILLAAGLFTIEYPTKKEEEEFVRFKMRSRTHPERLPKLSLYSGESLLRSQSGHLESSIAETLKDEPESAPVSPVRKTTKIHTKAKVTSRGKAREGRSPTRWAALPSDCPLVLRKLMLKEDTRAGCKCLVKAPLVSDVELERFLLAPRDPSQVLVFGIISSQNYTSTGQLQWLLNTLYNHQQRGRGSPCIQCRYDSYRLLQYDLDSPLQEDPPLMVKKNSVVQGMILMFAGGKLIFGGRVLNGYGLSKQNLLKQIFRSQQDYKMGYFLPDDYKFSVPNSVLSLEDSESVKKAESEDIQGSSSSLALEDYVEKELSLEAEKTREPEVELHPLSRDSKITSWKKQASKK

SEQ ID NO: 9316 - protein, 782 aa, Artificial Sequence; identical to SEQ ID NO: 9315
  Description of Artificial Sequence: Synthetic coding sequence

SEQ ID NO: 9317 - protein, 496 aa, Artificial Sequence
  Description of Artificial Sequence: Synthetic coding sequence
MFCHLRPMRRLCLEKIFPHWFPFSRALSGAEAVNALRPFYFAVHPDFFGQHPVEREINENSLKRLSVYLENLQKPGFKSLKPTQLTFYVRETDQSSSDGQEPFSTSGFRAVKFTLHTRDLLSTVLYILNSCSLSVEHIQSLNTNMHTQPLKEAKRMPDRPIKWDKSYYSFTGFKDPDEDLEQVSRVETTLTSWLDNNGKSAVKKLKNSLPLRKELDRLKDELSHQLQLSDIRWQRSWGIAHRCSQLHSLSRLAQQNLETLKKAKGCTIIFTDRSGMSAVGHVMLGTMDVHHHWTKLFERLPSYFDLQRRLMILEDQISYLLGGIQVVYIEELQPVLTLEEYYSLLDVFYNRLLKSRILFHPRSLRGLQMILNSDRYAPSLHELGHFNIPTLCDPANLQWFILTKAQQARENMKRKEELKVIENELIQASTKKFSLEKLYKEPSISSIQMVDCCKRLLEQSLPYLHGMHLCISHFYSVMQDGDLCIPWNWKNGEAIK

SEQ ID NO: 9318 - protein, 70 aa, Artificial Sequence
  Description of Artificial Sequence: Synthetic coding sequence
MFCHLRPMRRLCLEKIFPHWFPFSRALSGAEAVNALRPFYFAVHPDFFGQHPVERDDTWKSFQCPSDFSL

SEQ ID NO: 9319 - protein, 70 aa, Artificial Sequence; identical to SEQ ID NO: 9318
  Description of Artificial Sequence: Synthetic coding sequence

SEQ ID NO: 9320 - protein, 496 aa, Artificial Sequence; identical to SEQ ID NO: 9317
  Description of Artificial Sequence: Synthetic coding sequence

SEQ ID NO: 9321 - protein, 294 aa, Artificial Sequence
  Description of Artificial Sequence: Synthetic coding sequence
MAGQPAATGSPSADKDGMEPNVVARISQWADDHLRLVRNISTGMAIAGIMLLLRSIRLTSKFTSSSDIPVEFIRRNVKLRGRLRRITENGLEIEHIPITLPIIASLRKEPRGALLVKLAGVELAETGKAWLQKELKPSQLLWFQLLGKENSALFCYLLVSKGGYFSVNLNEEILRRGLGKTVLVKGLKYDSKIYWTVHRNLLKAELTALKKGEGIWKEDSEKESYLEKFKDSWREIWKKDSFLKTTGSDFSLKKESYYEKLKRTYEIWKDNMNNCSLILKFRELISRINFRRKG

SEQ ID NO: 9322 - protein, 251 aa, Artificial Sequence
  Description of Artificial Sequence: Synthetic coding sequence
MAIAGIMLLLRSIRLTSKFTSSSDIPVEFIRRNVKLRGRLRRITENGLEIEHIPITLPIIASLRKEPRGALLVKLAGVELAETGKAWLQKELKPSQLLWFQLLGKENSALFCYLLVSKGGYFSVNLNEEILRRGLGKTVLVKGLKYDSKIYWTVHRNLLKAELTALKKGEGIWKEDSEKESYLEKFKDSWREIWKKDSFLKTTGSDFSLKKESYYEKLKRTYEIWKDNMNNCSLILKFRELISRINFRRKG

SEQ ID NO: 9323 - protein, 294 aa, Artificial Sequence; identical to SEQ ID NO: 9321
  Description of Artificial Sequence: Synthetic coding sequence

SEQ ID NO: 9324 - protein, 170 aa, Artificial Sequence
  Description of Artificial Sequence: Synthetic coding sequence
MKTMATRKRCKLSRTGPEFENVIKRLLCARTFHTRIGGDLTHGIINRGRRANAEQMGLQGSAQHFNIFPLDLWTQGKKTEVQKREGTDSIPAAGRSGTANQPSIAPHRCLFSRGITALDGLKRGRGCNGAAHLVRGDAWKTKLGEPWVSIALALAGPGAILILELSWFLG

SEQ ID NO: 9325 - protein, 119 aa, Artificial Sequence
  Description of Artificial Sequence: Synthetic coding sequence
MKTMATRKRCKLSRTGPEFENVIKRLLCARTFHTRIGGDLTHGIINRGRRANAEQMGLQGSAQHFNIFPLDLWTQGDCMLVSLAKNKVNVFGAIINMAASVSGVIGGLKFSRTYYVKGI

SEQ ID NO: 9326 - protein, 119 aa, Artificial Sequence; identical to SEQ ID NO: 9325
  Description of Artificial Sequence: Synthetic coding sequence

SEQ ID NO: 9327 - protein, 119 aa, Artificial Sequence; identical to SEQ ID NO: 9325
  Description of Artificial Sequence: Synthetic coding sequence

SEQ ID NO: 9328 - protein, 78 aa, Artificial Sequence
  Description of Artificial Sequence: Synthetic coding sequence
MKTMATRKRCKLSRTGPEFENVIKRLLCARTFHTRIGGDLTHGIINRGRRANAEQMGLQGSAQHFNIFPLDLWTQGKK

SEQ ID NO: 9329 - protein, 214 aa, Artificial Sequence
  Description of Artificial Sequence: Synthetic coding sequence
MNNETTTLISLKEAMKRVDHKLQALETQFKELDFTKDNLMQKFEHHSKALASQAAQDEMWTAVRALQLTSMELNILYSYVIEVLICLHTRVLEKLPDLVRGLPTLASVLRRKVKNKRVRVVWESILEECGLQEGDITALCTFFIARGNKAEHYTAKVRQMYIRDVTFLITNMVKNQALQDSLLRAVQVIEKGKAVRTPEKQKSSLEELIPSVKN

SEQ ID NO: 9330 - protein, 164 aa, Artificial Sequence
  Description of Artificial Sequence: Synthetic coding sequence
MPSLAPDCPLLAMPEETQEDSVAPMMPSQRSRGPLAPNHVHEVCLHQVESISDLHSGAGTLRPYLTEEARPWDELLGVLPPSLCAQAGCSPVYRRGGFLLLLALLVLTCLVLALLAVYLSVLQSESLRILAHTLRTQEETLLKLRLASLSQLRRLNSSEAQAPS

SEQ ID NO: 9331 - protein, 72 aa, Artificial Sequence
  Description of Artificial Sequence: Synthetic coding sequence
MKVVGNYRVNTANSSTDTSGEHLTCLRSQLFVAYRNGRVDEAVSLGFLDCWIGGDLTNFKGCYLTNQLPIQF

SEQ ID NO: 9332 - protein, 290 aa, Artificial Sequence
  Description of Artificial Sequence: Synthetic coding sequence
MLGQRAGDGERPGLPGDGEGGVPARPGRRAERPPQRPAKVNKAVTCAAHLPGAAASRPLSPNKPDRVRPGQRDRIGAKRQRRRRADAGQARAASSRRVVPTAPEVLGAVASLPDRGRPTVARVATGSRLEGLFSAASLKLSALTQSLTRVRQAPTASGATIRLPASPVEMFLTSAFLTGFSFHCLYSGIGHGEDILASVEQITIVSRPLSGQRGAGPGNSAYTPRRSQGGPRAATTPGFRFPCRGLVRRAVLRLTVTVQDCILTALLAVSFHSIGVVIMTSSYLLGPVVK

SEQ ID NO: 9333 - protein, 70 aa, Artificial Sequence
  Description of Artificial Sequence: Synthetic coding sequence
MFTRAQVRRILQRVPGKQRFGIYRFLPFFFVLGGTMEWIMIKVRVGQETFYDVYRRKASERQYQRRLEDE

SEQ ID NO: 9334 - protein, 1062 aa, Artificial Sequence
  Description of Artificial Sequence: Synthetic coding sequence
MESQEFIVLYTHQKMKKSKVWQDGILKITHLGNKAILYDDKGACLESLFLKCLEVKPGDDLESDRYLITVEEVKVAGAIGIVKQNVNKEAPELNSRTFISSGRSLGCQPSGLKRKFTGFQGPRQVPKKMVIMESGESAASHEAKKTGPTIFSPFCSMPPLFPTVGKKDVNNILADPENIVTYKNRERNAMDFSSVFSPSFQINPEVLCEENYFCSPVNSGNKLSDSLLTNEPVKRDSLASHYSGVSQNIRSKAQILALLKSESSSSCEELNSEMTEHFPQKQPQGSLKIATKPKYLIQQEECAEMKSTENLYYQHQSENTMRNKSRWAMYLSSQSSPIHSSTVDGNDTERKPKAQEDDVNSNLKDLSLQKIIQFVETYAEERKKYNVDQSVGNNDPSWNQEVKLEIPSFNESSSLQVTCSSAENDGILSESDIQEDNKIPFNQNDKGCIKGSVLIKENAQEVNTCGTLEKEYEQSESSLPELKHLQIESSNNSRISDDITDMISESKMDNESLNSIHESLSNVTQPFLEVTFNLNNFETSDTEEESQESNKISQDSESWVKDILVNDGNSCFQKRSENTNCEEIEGEHLPFLTSVSDKPTVTFPVKETLPSQFCDKTYVGFDMGICKTENTGKEIEEYSDTLSNFESFKWTDAVYGDNKEDANKPIQEVRINYDFALPPNKSKGINMNLHIPHIQNQIAENSNLFSEDAQPQPFILGSDLDKNDEHVLPSTSSSDNSVQLLNTNQNHYECIALDKSNTHISNSLFYPLGKKHLISKDTEAHISEPEDLGKIRSPPPDHVEVETAREGKQYWNPRNSSELSGLVNTISILKSLCEHSTALDSLEILKKKNTVFQQGTQQTYEPDSPPEVRKPFITVVSPKSPHLHKDSQQILKEDEVELSEPLQSVQFSSSGSKEETAFQAVIPKQIERKTCDPKPVEFQGHQVKGSATSGVMVRGHSSQLGCSQFPDSTEYENFMTETPELPSTCMQIDFLQVTSPEENISTLSPVSTFSLNSRDEDFMVEFSETSLKARTLPDDLHFLNLEGSRYHIALISVYSFKMKFFI

SEQ ID NO: 9335 - protein, 915 aa, Artificial Sequence
  Description of Artificial Sequence: Synthetic coding sequence
MFQAILYDDKGACLESLFLKCLEVKPGDDLESDRYLITVEEVKVAGAIGIVKQNVNKEAPELNSRTFISSGRSLGCQPSGLKRKFTGFQGPRQVPKKMVIMESGESAASHEAKKTGPTIFSPFCSMPPLFPTVGKKDVNNILADPENIVTYKNRERNAMDFSSVFSPSFQINPEVLCEENYFCSPVNSGNKLSDSLLTNEPVKRDSLASHYSGVSQNIRSKAQILALLKSESSSSCEELNSEMTEHFPQKQPQGSLKIATKPKYLIQQEECAEMKSTENLYYQHQSENTMRNKSRWAMYLSSQSSPIHSSTVDGNDTERKPKAQEDDVNSNLKDLSLQKIIQFVETYAEERKKYNVDQSVGNNDPSWNQEVKLEIPSFNESSSLQVTCSSAENDGILSESDIQEDNKIPFNQNDKGCIKGSVLIKENAQEVNTCGTLEKEYEQSESSLPELKHLQIESSNNSRISDDITDMISESKMDNESLNSIHESLSNVTQPFLEVTFNLNNFETSDTEEESQESNKISQDSESWVKDILVNDGNSCFQKRSENTNCEEIEGEHLPFLTSVSDKPTVTFPVKETLPSQFCDKTYVGFDMGICKTENTGKEIEEYSDTLSNFESFKWTDAVYGDNKEDANKPIQEVRINYDFALPPNKSKGINMNLHIPHIQNQIAENSNLFSEDAQPQPFILGSDLDKNDEHVLPSTSSSDNSVQLLNTNQNHYECIALDKSNTHISNSLFYPLGKKHLISKDTEAHISEPEDLGKIRSPPPDHVEVETAREGKQYWNPRNSSELSGLVNTISILKSLCEHSTALDSLEILKKKNTVFQQGTQQTYEPDSPPEVRKPFITVVSPKSPHLHKDSQQKTVKKKIKPTLPLRIFINVSRFFCVQLKKMVRLMYINSFISFPLNIVVLSYIINNSS

SEQ ID NO: 9336 - protein, 174 aa, Artificial Sequence
  Description of Artificial Sequence: Synthetic coding sequence
MESQEFIVLYTHQKMKKSKVWQDGILKITHLGNKAILYDDKGACLESLFLKCLEVKPGDDLESDRYLITVEEVKVAGAIGIVKQNVNKEAPELNSRTFISSGRSLGCQPSGLKRKFTGFQGPRQVPKKMVIMESGESAASHEAKKTGPTIFSPFCSMPPLFPTVGKKDVNNILA

SEQ ID NO: 9337 - protein, 199 aa, Artificial Sequence
  Description of Artificial Sequence: Synthetic coding sequence
MTSLINSPINRRPLQNVEGNNRCQRKAKNYGNKYFIHCLDLEKITLSPRRKHDIEGGDKLNVKFSQLRSRRQRKAEPGACALGRVGSECIPEPGARRTAQAAGLRSVSGAANTKVRELKHFRFLGLLRSCRSEMEVDAPGVDGRDGLRERRGFSEGGRQNFDVRPQSGANGLPKHSYWLDLWLFILFDVVVFLFVYFLP

SEQ ID NO: 9338 - protein, 66 aa, Artificial Sequence
  Description of Artificial Sequence: Synthetic coding sequence
MEVDAPGVDGRDGLRERRGFSEGGRQNFDVRPQSGANGLPKHSYWLDLWLFILFDVVVFLFVYFLP

SEQ ID NO: 9339 - protein, 132 aa, Artificial Sequence
  Description of Artificial Sequence: Synthetic coding sequence
MCSAGELLRGGDGGERDEDGDALAEREAAGTGWDPGASPRRRGQRPKESEQDVEDSQNHTGEPVGDDYKKMGTLFGELNKNLINMGFTRMYFGERIVEPVIVIFFWVMLWFLGLQALGLVAVLCLVIIYVQQ

SEQ ID NO: 9340 - protein, 99 aa, Artificial Sequence
  Description of Artificial Sequence: Synthetic coding sequence
MAEGGFDPCECVCSHEHAMRRLINLLRQSQSYCTDTECLQELPGPSGDNGISVTMILVAWMVIALILFLLRPPNLRGSSLPGKPTSPHNGQDPPAPPVD

SEQ ID NO: 9341 - protein, 89 aa, Artificial Sequence
  Description of Artificial Sequence: Synthetic coding sequence
MAEGGFDPCECVCSHEHAMRRLINLLRQSQSYCTDTECLQELPGPSGDNGISVTMILVAWMVIALILFLLRPPNLRGSSLPGKPTSPHN

SEQ ID NO: 9342 - protein, 240 aa, Artificial Sequence
  Description of Artificial Sequence: Synthetic coding sequence
MYLRRAVSKTLALPLRAPPNPAPLGKDASLRRMSSNRFPGSSGSNMIYYLVVGVTVSAGGYYAYKTVTSDQAKHTEHKTNLKEKTKAEIHPFQGEKENVAETEKASSEAPEELIVEAEVVDAEESPSATVVVIKEASACPGHVEAAPETTAVSAETGPEVTDAAARETTEVNPETTPEVTNAALDEAVTIDNDKDTTKNETSDEYAELEEENSPAESESSAGDDLQEEASVGSEAASAQG

SEQ ID NO: 9343 - protein, 265 aa, Artificial Sequence
  Description of Artificial Sequence: Synthetic coding sequence
MAAAVPKRMRGPAQAKLLPGSAIQALVGLARPLVLALLLVSAALSSVVSRTDSPSPTVLNSHISTPNVNALTHENQTKPSISQISTTLPPTTSTKKSGGASVVPHPSPTPLSQEEADNNEDPSIEEEDLLMLNSSPSTAKDTLDNGDYGEPDYDWTTGPRDDDESDDTLEENRGYMEIEQSVKSFKMPSSNIEEEDSHFFFHLIIFAFCIAVVYITYHNKRKIFLLVQSRKWRDGLCSKTVEYHRLDQNVNEAMPSLKITNDYIF

SEQ ID NO: 9344 - protein, 165 aa, Artificial Sequence
  Description of Artificial Sequence: Synthetic coding sequence
MKTKPNLLFPKSAPPSLPRRVPRKVEEDLLMLNSSPSTAKDTLDNGDYGEPDYDWTTGPRDDDESDDTLEENRGYMEIEQSVKSFKMPSSNIEEEDSHFFFHLIIFAFCIAVVYITYHNKRKIFLLVQSRKWRDGLCSKTVEYHRLDQNVNEAMPSLKITNDYIF

SEQ ID NO: 9345 - protein, 215 aa, Artificial Sequence
  Description of Artificial Sequence: Synthetic coding sequence
MASETEKTHALLQTCSTESLISSLGLGAFCLVADRLLQFSTIQQNDWLRALSDNAVHCVIGMWSWAVVTGIKKKTDFGEIILAGFLASVIDVDHFFLAGSMSLKAALTLPRRPFLHCSTVIPVVVLTLKFTMHLFKLKDSWCFLPWMLFISWTSHHIRDGIRHGLWICPFGKTSPLPFWLYVIITSSLPHICSFVMYLTGTRQMMSSKHGVRIDV

SEQ ID NO: 9346 - protein, 215 aa, Artificial Sequence; identical to SEQ ID NO: 9345
  Description of Artificial Sequence: Synthetic coding sequence

SEQ ID NO: 9347 - protein, 176 aa, Artificial Sequence
  Description of Artificial Sequence: Synthetic coding sequence
MASETEKTHALLQTCSTESLISSLGLGAFCLVADRLLQFSTIQQNDWLRALSDNAVHCVIGMWSWAVVTGIKKKTDFGEIILAGFLASVIDVDHFFLAGSMSLKAALTLPRRPFLHCSTVIPVVVLTLKFTMHLFKLKDSWCFLPWMLFISWTSHHIRDGIRHGLWICPFGKTSPL

SEQ ID NO: 9348 - protein, 215 aa, Artificial Sequence; identical to SEQ ID NO: 9345
  Description of Artificial Sequence: Synthetic coding sequence

SEQ ID NO: 9349 - protein, 84 aa, Artificial Sequence
  Description of Artificial Sequence: Synthetic coding sequence
MHLFKLKDSWCFLPWMLFISWTSHHIRDGIRHGLWICPFGKTSPLPFWLYVIITSSLPHICSFVMYLTGTRQMMSSKHGVRIDV

SEQ ID NO: 9350 - protein, 333 aa, Artificial Sequence
  Description of Artificial Sequence: Synthetic coding sequence
MKGEAGHMLHNEKSKQEGHIWGSMRRTAFILGSGLLSFVAFWNSVTWHLQRFWGASGYFWQAQWERLLTTFEGKEWILFFIGAIQVPCLFFWSFNGLLLVVDTTGKPNFISRYRIQVGKNEPVDPVKLRQSIRTVLFNQCMISFPMVVFLYPFLKWWRDPCRRELPTFHWFLLELAIFTLIEEVLFYYSHRLLHHPTFYKKIHKKHHEWTAPIGVISLYAHPIEHAVSNMLPVIVGPLVMGSHLSSITMWFSLALIITTISHCGYHLPFLPSPEFHDYHHLKFNQCYGVLGVLDHLHGTDTMFKQTKAYERHVLLLGFTPLSESIPDSPKRME

SEQ ID NO: 9351 - protein, 310 aa, Artificial Sequence
  Description of Artificial Sequence: Synthetic coding sequence
MRRTAFILGSGLLSFVAFWNSVTWHLQRFWGASGYFWQAQWERLLTTFEGKEWILFFIGAIQVPCLFFWSFNGLLLVVDTTGKPNFISRYRIQVGKNEPVDPVKLRQSIRTVLFNQCMISFPMVVFLYPFLKWWRDPCRRELPTFHWFLLELAIFTLIEEVLFYYSHRLLHHPTFYKKIHKKHHEWTAPIGVISLYAHPIEHAVSNMLPVIVGPLVMGSHLSSITMWFSLALIITTISHCGYHLPFLPSPEFHDYHHLKFNQCYGVLGVLDHLHGTDTMFKQTKAYERHVLLLGFTPLSESIPDSPKRME

SEQ ID NO: 9352 - protein, 146 aa, Artificial Sequence
  Description of Artificial Sequence: Synthetic coding sequence
MRRTAFILGSGLLSFVAFWNSVTWHLQRFWGASGYFWQAQWERLLTTFEGKEWILFFIGAIQVPCLFFWSFNGLLLVVDTTGKPNFISRYRIQVGKNEPVDPVKLRQSIRTVLFNQCMISFPMVVFLYPFLKWWRDPCRRELPTFH

SEQ ID NO: 9353 - protein, 32 aa, Artificial Sequence
  Description of Artificial Sequence: Synthetic coding sequence
MKGEAGHMLHNEKSKQEGHIWGSMRRTAFILG

SEQ ID NO: 9354 - protein, 74 aa, Artificial Sequence
  Description of Artificial Sequence: Synthetic coding sequence
MFDIKAWAEYVVEWAAKDPYGFLTTVILALTPLFLASAVLSWKLAKMIEAREKEQKKKQKRQENIAKAKRLKKD

SEQ ID NO: 9355 - protein, 74 aa, Artificial Sequence; identical to SEQ ID NO: 9354
  Description of Artificial Sequence: Synthetic coding sequence

SEQ ID NO: 9356 - protein, 60 aa, Artificial Sequence
  Description of Artificial Sequence: Synthetic coding sequence
MDAVSQVPMEVVLPKHILDIWVIVLIILATIVIMTSLLLCPATAVIIYRMRTHPILSGAV

SEQ ID NO: 9357 - protein, 560 aa, Artificial Sequence
  Description of Artificial Sequence: Synthetic coding sequence
SVLKITLAVILTLLGLAILAILLTRWARCKQSEMYISRYSSEQSARLLDYEDGRGSRHAYSTQSDTSYDNRARYEAPFSPKIEKLAISKSSLALPQGSMSSIKCLQTTEEPPCIPCVMILIFYNVPATRGMGKVVRKHIMQTPGPIGKLPVFSVRSHPHTITGPPSAPRGKPVSTLLISNSVCSYLTQSFQFPEVRTIATKKRATTQGSVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 9358 - protein, 567 aa, Artificial Sequence [sequence omitted]

SEQ ID NO: 9359 - protein, 561 aa, Artificial Sequence
  Description of Artificial Sequence: Synthetic coding sequence
MTVLEITLAVILTLLGLAILAILLTRWARCKQSEMYISRYSSEQSARLLDYEDGRGSRHAYSTQSGNLCFQRSKRDYTPSTNSLVSMASKFSLGQTELILLLMCFILALSRSSIGSIKCLQTTEEPPSRTAGAMMQFTAPIPGATGPIKLSQKTIVQTPGPIVQYPGSNAGPPSAPRGPPMAPIIISQRTARIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 9360 - protein, 563 aa, Artificial Sequence
  Description of Artificial Sequence: Synthetic coding sequence
MTVLEITLAVILTLLGLAILAILLTRWARCKQSEMYISRYSSEQSARLLDYEDGRGSRHAYSTQSDTSYDNRERSKRDYTPSTNSLVSMASKFSLGQTELILLLMCFILALSRSSIGSIKCLQTTEEPPSRTAGAMMQFTAPIPGATGPIKLSQKTIVQTPGPIVQYPGSNAGPPSAPRGPPMAPIIISQRTARIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 9361 - protein, 563 aa, Artificial Sequence; identical to SEQ ID NO: 9360
  Description of Artificial Sequence: Synthetic coding sequence

SEQ ID NO: 9362 - protein, 562 aa, Artificial Sequence
  Description of Artificial Sequence: Synthetic coding sequence
MTVLEITLAVILTLLGLAILAILLTRWARCKQSEMYISRYSSEQSARLLDYEDGRGSRHAYSTQSDTSYDNRERSKRDYTPSTNSLALSRSSIALPQGSMSSIKCLQTTEEPPSRTAGAMMQFTAPIPGATGPIKLSQKTIVQTPGPIVQYPGSNVRSHPHTITGPPSAPRGPPMAPIIISQRTASQLAAPIRIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 9363 - protein, 561 aa, Artificial Sequence; identical to SEQ ID NO: 9359
  Description of Artificial Sequence: Synthetic coding sequence

SEQ ID NO: 9364 - protein, 560 aa, Artificial Sequence; identical to SEQ ID NO: 9357
  Description of Artificial Sequence: Synthetic coding sequence

SEQ ID NO: 9365 - protein, 567 aa, Artificial Sequence [sequence omitted]

SEQ ID NO: 9366 - protein, 547 aa, Artificial Sequence
  Description of Artificial Sequence: Synthetic coding sequence
MTVLEITLAVILTLLGLAILAILLTRWARCKQSEMYISRYSSEQSARLLDYEDGRGSRHAYSTQSERSKRDYTPSTNSLALSRSSIALPQGSMSSIKCLQTTEEPPSRTAGAMMQFTAPIPGATGPIKLSQKTIVQTPGPIVQYPGSNAGPPSAPRGPPMAPIIISQRTASQLAAPIRIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 9367 - protein, 101 aa, Artificial Sequence
  Description of Artificial Sequence: Synthetic coding sequence
MAASRYRRFLKLCEEWPVDETKRGRDLGAYLRQRVAQAFREGENTQYPRPRDTSFSGLSLEEYKLILSTDTLEELKEIDKGMWKKLQEKFAPKGPEEDHKA

SEQ ID NO: 9368 - protein, 126 aa, Artificial Sequence
  Description of Artificial Sequence: Synthetic coding sequence
MAASRYRRFLKLCEEWPVDETKRGRDLGAYLRQRVAQAFREGENTQVAEPEACDQMYESLARLHSNYYKHKYPRPRDTSFSGLSLEEYKLILSTDTLEELKEIDKGMWKKLQEKFAPKGPEEDHKA

SEQ ID NO: 9369 - protein, 496 aa, Artificial Sequence
  Description of Artificial Sequence: Synthetic coding sequence
MYQPSRGAARRLGPCLRAYQARPQVSGGEEGGRRGGGERPSSKPVRGAERALGSAQAQRHPPPLPTCALQRVDRLGVAGAGGRRCRACRARTSVLPGLRAVRRGQGQAAGRVCVAPDSPRLPVPRGDLKGRGREIRSPAAAPSRSSPAQTRPAGRPQQPARLALGERSWQEGRPVCTRFGPLRPGWQDGHAPSRDGASRTPSGTEDQLYPGTLPFPPLWPHSTTTTSPSSPLFWSPLPPRLPTQRLPQVPPLPLPQIQALSSAWVVLPPGKGEEGPGPELHSGCLDGLRSLFEGPPCPYPGAWIPFQVPGTAHPSPATPSGDPSMEEHLSVMYERLRQELPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHSPPTPVKKLLVGALVALGLSEPEPDLNLCSKP

SEQ ID NO: 9370 - protein, 181 aa, Artificial Sequence
  Description of Artificial Sequence: Synthetic coding sequence
MYQPSRGAARRLGPCLRAYQARPQLPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHSPPTPVKKLLVGALVALGLSEPEPDLNLCSKP

SEQ ID NO: 9371 - protein, 315 aa, Artificial Sequence
  Description of Artificial Sequence: Synthetic coding sequence
MYQPSRGAARRLGPCLRAYQARPQDQLYPGTLPFPPLWPHSTTTTSPSSPLFWSPLPPRLPTQRLPQVPPLPLPQIQALSSAWVVLPPGKGEEGPGPELHSGCLDGLRSLFEGPPCPYPGAWIPFQVPGTAHPSPATPSGDPSMEEHLSVMYERLRQELPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHSPPTPVKKLLVGALVALGLSEPEPDLNLCSKP

SEQ ID NO: 9372 - protein, 172 aa, Artificial Sequence
  Description of Artificial Sequence: Synthetic coding sequence
MEEHLSVMYERLRQELPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHSPPTPVKKLLVGALVALGLSEPEPDLNLCSKP

SEQ ID NO: 9373 - protein, 846 aa, Artificial Sequence
  Description of Artificial Sequence: Synthetic coding sequence
MCFLRRPGAPASWIWWRMLRQVLRRGLQSFCHRLGLCVSRHPVFFLTVPAVLTITFGLSALNRFQPEGDLERLVAPSHSLAKIERSLASSLFPLDQSKSQLYSDLHTPGRYGRVILLSPTGDNILLQAEGILQTHRAVLEMKDGRNSFIGHQLGGVVEVPNSKDQRVKSARAIQITYYLQTYGSATQDLIGEKWENEFCKLIRKLQEEHQELQLYSLASFSLWRDFHKTSILARSKVLVSLVLILTTATLSSSMKDCLRSKPFLGLLGVLTVCISIITAAGIFFITDGKYNSTLLGIPFFAMGHGTKGVFELLSGWRRTKENLPFKDRIADAYSDVMVTYTMTSSLYFITFGMGASPFTNIEAVKVFCQNMCVSILLNYFYIFSFFGSCLVFAGQLEQNRYHSIFCCKIPSAEYLDRKPVWFQTVMSDGHQQTSHHETNPYQHHFIQHFLREHYNEWITNIYVKPFVVILYLIYASFSFMGCLQISDGANIINLLASDSPSVSYAMVQQKYFSNYSPVIGFYVYEPLEYWNSSVQDDLRRLCSGFTAVSWVEQYYQFLKVSNVSANNKSDFISVLQSSFLKKPEFQHFRNDIIFSKAGDESNIIASRLYLVARTSRDKQKEITEVLEKLRPLSLSKSIRFIVFNPSFVFMDHYSLSVTVPVLIAGFGVLLVLILTFFLVIHPLGNFWLILSVTSIELGVLGLMTLWNVDMDCISILCLIYTLNFAIDHCAPLLFTFVLATEHTRTQCIKSSLQDHGTAILQNVTSFLIGLVPLLFVPSNLTFTLFKCLLLTGGCTLLHCFVILPVFLTFFPPSKKHHKKKKRAKRKEREEIECIEIQENPDHVTTV

SEQ ID NO: 9374 - protein, 311 aa, Artificial Sequence
  Description of Artificial Sequence: Synthetic coding sequence
  MOD_RES (1)..(1): Any amino acid
XCFLRRPGAPASWIWWRMLRQVLRRGLQSFCHRLGLCVSRHPVFFLTVPAVLTITFGLSALNRFQPEGDLERLVAPSHSLAKIERSLASSLFPLDQSKSQLYSDLHTPGRYGRVILLSPTGDNILLQAEGILQTHRAVLEMKDGRNSFIGHQLGGVVEVPNSKDQRVKSARAIQITYYLQTYGSATQDLIGEKWENEFCKLIRKLQEEHQELQLYSLASFSLWRDFHKTSILARSKVLVSLVLILTTATLSSSMKDCLRSKPFLGLLGVLTVCISIITAAGIFFITDGKYNSTLLGIPFFAMGISTEFTSS

SEQ ID NO: 9375 - protein, 294 aa, Artificial Sequence
  Description of Artificial Sequence: Synthetic coding sequence
MLRQVLRRGLQSFCHRLGLCVSRHPVFFLTVPAVLTITFGLSALNRFQPEGDLERLVAPSHSLAKIERSLASSLFPLDQSKSQLYSDLHTPGRYGRVILLSPTGDNILLQAEGILQTHRAVLEMKDGRNSFIGHQLGGVVEVPNSKDQRVKSARAIQITYYLQTYGSATQDLIGEKWENEFCKLIRKLQEEHQELQLYSLASFSLWRDFHKTSILARSKVLVSLVLILTTATLSSSMKDCLRSKPFLGLLGVLTVCISIITAAGIFFITDGKYNSTLLGIPFFAMGISTEFTSS

SEQ ID NO: 9376 - protein, 97 aa, Artificial Sequence
  Description of Artificial Sequence: Synthetic coding sequence
MSSAPEPPTFKKEPPKEKEFQSPGLRGVRTTTLFRAVNPELFIKPNKPVMAFGLVTLSLCVAYIGYLHAIQENKKDLYEAIDSEGHSYMRRKTSKWD

SEQ ID NO: 9377 - protein, 97 aa, Artificial Sequence; identical to SEQ ID NO: 9376
  Description of Artificial Sequence: Synthetic coding sequence

SEQ ID NO: 9378 - protein, 947 aa, Artificial Sequence
  Description of Artificial Sequence: Synthetic coding sequence
MSQPPIGGAAPATAAASPAAAATEARLHPEGSSRKQQRAQSPARPRDSSLRQTIAATRSPVGAGTKLNSVRQQQLQQQQQQGNKTGSRTGPPASIRGGGGGAEKATPLAPKGAAPGAVQPVAGAEAAPAATLAALGGRRPGPPEEPPRELESVPSKLGEPPPLGEGGGGGGEGGGAGGGSGEREGGAPQPPPPRGWRGKGVRAQQRGGSGGEGASPSPSSSSAGKTPGTGSRNSGSGVAGGGSGGGGSYWKEGCLQSELIQFHLKKERAAAAAAAAQMHAKNGGGSSSRSSPVSGPPAVCETLAVASASPMAAAAEGPQQSAEGSASGGGMQAAAPPSSQPHPQQLQEQEEMQEEMEKLREENETLKNEIDELRTEMDEMRDTFFEEDACQLQEMRHELERANKNCRILQYRLRKAERKRLRYAQTGEIDGELLRSLEQDLKVAKDVSVRLHHELENVEEKRTTTEDENEKLRQQLIEVEIAKQALQNELEKMKELSLKRRGSKDLPKSEKKAQQTPTEEDNEDLKCQLQFVKEEAALMRKKMAKIDKEKDRFEHELQKYRSFYGDLDSPLPKGEAGGPPSTREAELKLRLRLVEEEANILGRKIVELEVENRGLKAELDDLRGDDFNGSANPLMREQSESLSELRQHLQLVEDETELLRRNVADLEEQNKRITAELNKYKYKSGGHDSARHHDNAKTEALQEELKAARLQINELSGKVMQLQYENRVLMSNMQRYDLASHLGIRGSPRDSDAESDAGKKESDDDSRPPHRKREGPIGGESDSEEVRNIRCLTPTRSFYPAPGPWPKSFSDRQQMKDIRSEAERLGKTIDRLIADTSTIITEARIYVANGDLFGLMDEEDDGSRIREHELLYRINAQMKAFRKELQTFIDRLEVPKSADDRGAEEPISVSQMFQPIILLILILVLFSSLSYTTIFKLVFLFTLFFVL

SEQ ID NO: 9379 - protein, 10 aa, Artificial Sequence
  Description of Artificial Sequence: Synthetic coding sequence
MSQPPIGGAA

SEQ ID NO: 9380 - protein, 947 aa, Artificial Sequence; identical to SEQ ID NO: 9378
  Description of Artificial Sequence: Synthetic coding sequence

SEQ ID NO: 9381 - protein, 947 aa, Artificial Sequence; identical to SEQ ID NO: 9378
  Description of Artificial Sequence: Synthetic coding sequence

SEQ ID NO: 9382 - protein, 128 aa, Artificial Sequence
  Description of Artificial Sequence: Synthetic coding sequence
MALQVRVAPSKVVLQKFLLCVILFYTVYYVSLSMGCVMFEVHELNVLAPFDFKTNPSWLNINYKVLLVSTEVTYFVCGLFFVPVVEEWVWDYAISVTILHVAITSTVMLEFPLTSHWWAALGISKLLV

SEQ ID NO: 9383 - protein, 128 aa, Artificial Sequence; identical to SEQ ID NO: 9382
  Description of Artificial Sequence: Synthetic coding sequence

SEQ ID NO: 9384 - protein, 240 aa, Artificial Sequence
  Description of Artificial Sequence: Synthetic coding sequence
MAMASVKLLAGVLRKPDAWIGLWGVLRGTPSSYKLCTSWNRYLYFSSTKLRAPNYKTLFYNIFSLRLPGLLLSPECIFPFSVRLKSNIRSTKSTKKSLQKVDEEDSDEESHHDEMSEQEEELEDDPTVVKNYKDLEKAVQSFRYDVVLKTGLDIGRNKVEDAFYKGELRLNEEKLWKKSRTVKVGDTLDLLIGEDKEAGTETVMRILLKKVFEEKTESEKYRVVLRRWKSLKLPKKRMSK

SEQ ID NO: 9385 - protein, 240 aa, Artificial Sequence; identical to SEQ ID NO: 9384
  Description of Artificial Sequence: Synthetic coding sequence

SEQ ID NO: 9386 - protein, 245 aa, Artificial Sequence
  Description of Artificial Sequence: Synthetic coding sequence
MIISAMAMASVKLLAGVLRKPDAWIGLWGVLRGTPSSYKLCTSWNRYLYFSSTKLRAPNYKTLFYNIFSLRLPGLLLSPECIFPFSVRLKSNIRSTKSTKKSLQKVDEEDSDEESHHDEMSEQEEELEDDPTVVKNYKDLEKAVQSFRYDVVLKTGLDIGRNKVEDAFYKGELRLNEEKLWKKSRTVKVGDTLDLLIGEDKEAGTETVMRILLKKVFEEKTESEKYRVVLRRWKSLKLPKKRMSK

SEQ ID NO: 9387 - protein, 193 aa, Artificial Sequence
  Description of Artificial Sequence: Synthetic coding sequence
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHALSPPHSSTCENRAPEASKGGRAQDSRGPGPGTEPALCGSGPSSPQQAPPAVHSGPC

SEQ ID NO: 9388 - protein, 217 aa, Artificial Sequence
  Description of Artificial Sequence: Synthetic coding sequence
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGACPRNRFDHSLDLLCPPHIAPLVKTEPQRPVKEEEPKIPGDLDQEPSLLYADLDHLALSRPRRLSTADPADASTIYAVVV

SEQ ID NO: 9389 - protein, 241 aa, Artificial Sequence
  Description of Artificial Sequence: Synthetic coding sequence
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGSVYPQLLIPLLGAGLVLGLGALGLVWWLHRRLPPQPIRPLPRFAPLVKTEPQRPVKEEEPKIPGDLDQEPSLLYADLDHLALSRPRRLSTADPADASTIYAVVV

SEQ ID NO: 9390 - protein, 237 aa, Artificial Sequence
  Description of Artificial Sequence: Synthetic coding sequence
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGSVYPQLLIPLLGAGLVLGLGALGLVWWLHRRLPPQPIRPLPRFALSPPHSSTCENRAPEASKGGRAQDSRGPGPGTEPALCGSGPSSPQQAPPAVHSGPC

SEQ ID NO: 9391 - protein, 222 aa, Artificial Sequence
  Description of Artificial Sequence: Synthetic coding sequence
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGSVYPQLLIPLLGAGLVLGLGALGLVWWLHRRLPPQPIRPLPRFALSPPHSSTCENRAPEASKGGRAQDSRGPGPGTGKGMGMGRG

SEQ ID NO: 9392 - protein, 197 aa, Artificial Sequence
  Description of Artificial Sequence: Synthetic coding sequence
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHAPLVKTEPQRPVKEEEPKIPGDLDQEPSLLYADLDHLALSRPRRLSTADPADASTIYAVVV

SEQ ID NO: 9393 - protein, 197 aa, Artificial Sequence; identical to SEQ ID NO: 9392
  Description of Artificial Sequence: Synthetic coding sequence

SEQ ID NO: 9394 - protein, 217 aa, Artificial Sequence; identical to SEQ ID NO: 9388
  Description of Artificial Sequence: Synthetic coding sequence

SEQ ID NO: 9395 - protein, 237 aa, Artificial Sequence; identical to SEQ ID NO: 9390
  Description of Artificial Sequence: Synthetic coding sequence

SEQ ID NO: 9396 - protein, 193 aa, Artificial Sequence; identical to SEQ ID NO: 9387
  Description of Artificial Sequence: Synthetic coding sequence

SEQ ID NO: 9397 - protein, 241 aa, Artificial Sequence; identical to SEQ ID NO: 9389
  Description of Artificial Sequence: Synthetic coding sequence

SEQ ID NO: 9398 - protein, 241 aa, Artificial Sequence; identical to SEQ ID NO: 9389
  Description of Artificial Sequence: Synthetic coding sequence

SEQ ID NO: 9399 - protein, 197 aa, Artificial Sequence; identical to SEQ ID NO: 9392
  Description of Artificial Sequence: Synthetic coding sequence

SEQ ID NO: 9400 - protein, 193 aa, Artificial Sequence; identical to SEQ ID NO: 9387
  Description of Artificial Sequence: Synthetic coding sequence

SEQ ID NO: 9401 - protein, 217 aa, Artificial Sequence; identical to SEQ ID NO: 9388
  Description of Artificial Sequence: Synthetic coding sequence

SEQ ID NO: 9402 - protein, 193 aa, Artificial Sequence; identical to SEQ ID NO: 9387
  Description of Artificial Sequence: Synthetic coding sequence

SEQ ID NO: 9403 - protein, 237 aa, Artificial Sequence; identical to SEQ ID NO: 9390
  Description of Artificial Sequence: Synthetic coding sequence

SEQ ID NO: 9404 - protein, 237 aa, Artificial Sequence; identical to SEQ ID NO: 9390
  Description of Artificial Sequence: Synthetic coding sequence

SEQ ID NO: 9405 - protein, 197 aa, Artificial Sequence; identical to SEQ ID NO: 9392
  Description of Artificial Sequence: Synthetic coding sequence

SEQ ID NO: 9406 - protein, 217 aa, Artificial Sequence; identical to SEQ ID NO: 9388
  Description of Artificial Sequence: Synthetic coding sequence

SEQ ID NO: 9407 - protein, 241 aa, Artificial Sequence; identical to SEQ ID NO: 9389
  Description of Artificial Sequence: Synthetic coding sequence

SEQ ID NO: 9408 - protein, 193 aa, Artificial Sequence; identical to SEQ ID NO: 9387
  Description of Artificial Sequence: Synthetic coding sequence

SEQ ID NO: 9409 - protein, 193 aa, Artificial Sequence; identical to SEQ ID NO: 9387
  Description of Artificial Sequence: Synthetic coding sequence

SEQ ID NO: 9410 - protein, 237 aa, Artificial Sequence; identical to SEQ ID NO: 9390
  Description of Artificial Sequence: Synthetic coding sequence

SEQ ID NO: 9411 - protein, 217 aa, Artificial Sequence; identical to SEQ ID NO: 9388
  Description of Artificial Sequence: Synthetic coding sequence

SEQ ID NO: 9412 - protein, 241 aa, Artificial Sequence; identical to SEQ ID NO: 9389
  Description of Artificial Sequence: Synthetic coding sequence

SEQ ID NO: 9413 - protein, 197 aa, Artificial Sequence; identical to SEQ ID NO: 9392
  Description of Artificial Sequence: Synthetic coding sequence

SEQ ID NO: 9414 - protein, 237 aa, Artificial Sequence; identical to SEQ ID NO: 9390
  Description of Artificial Sequence: Synthetic coding sequence

SEQ ID NO: 9415 - protein, 197 aa, Artificial Sequence; identical to SEQ ID NO: 9392
  Description of Artificial Sequence: Synthetic coding sequence

SEQ ID NO: 9416 - protein, 217 aa, Artificial Sequence; identical to SEQ ID NO: 9388
  Description of Artificial Sequence: Synthetic coding sequence

SEQ ID NO: 9417 - protein, 241 aa, Artificial Sequence; identical to SEQ ID NO: 9389
  Description of Artificial Sequence: Synthetic coding sequence

SEQ ID NO: 9418 - protein, 326 aa, Artificial Sequence
  Description of Artificial Sequence: Synthetic coding sequence
MEFLWDFLNHQEGPRIRDHLSHGEINLHEFSKETTNQLLAFSLVLLLRFVDDCLLSVFKEKSAVELLISLAEGYSSRCHPVFQLKKQVLSCEESIRVWALLPFPEELTRQAVRLEDNSETNACHSLITKMTDELYHHMPENRCVLKDLDRLPTETWPQLLRELCSTPVPTLFCPRIVLEVLVVLRSISEQCRRVSSQVTVASELRHRQWVERTLRSRQRQNYLRMWSSIRLLSPVLSLILLLIALELVNIHAVCGKNAHEYQQYLKFVKSILQYTENLVAYTSYEKNKWNETINLTHTALLKMWTFSEKKQMLIHLAKKSTSKVLL

SEQ ID NO: 9419 - protein, 631 aa, Artificial Sequence
  Description of Artificial Sequence: Synthetic coding sequence
MEVLIGDPITTCLSPSVYDIICNLGFQLRENCDINSIVTQNGEVCWKTITDCVSYTESEQGLDYWGSVRLLGPVCEAVHSHFLSLTKGQFEIRYAPWFQWTSFPELFPEIFDALESLQSPAISLSLMKLTSCLERALGDVFLLIGKECPFLLRDLLSSEELAQVFSQSVMNVLKVFVGSPCGLNLRNVLWHGFASPEEIPPKYCSMMILLTAGLGQLLKSYLQNTKLTLAHRSFISLTNLEDLIVFPDVTYEVLSVLEEVMMKSAFILKIMLPYWEVALVKFKSHRFADCAILLLTQLETGLRNVFATLNRCPKRLLTAESTALYTTFDQILAKHLNDGKINQLPLFLGEPAMEFLWDFLNHQEGPRIRDHLSHGEINLHEFSKETTNQLLAFSLVLLLRFVDDCLLSVFKEKSAVELLISLAEGYSSRCHPVFQLKKQVLSCEESIRVWALLPFPEELTRQAVRLEDNSETNACHSLITKMTDELYHHMPENRCVLKDLDRLPTETPTSDTPLALAPRKPQPCRCRRRVRPSIRLLSPVLSLILLLIALELVNIHAVCGKNAHEYQQYLKFVKSILQYTENLVAYTSYEKNKWNETINLTHTALLKMWTFSEKKQMLIHLAKKSTSKVLL

SEQ ID NO: 9420 - protein, 678 aa, Artificial Sequence
  Description of Artificial Sequence: Synthetic coding sequence
MEVLIGDPITTCLSPSVYDIICNLGFQLRENCDINSIVTQNGEVCWKTITDCVSYTESEQGLDYWGSVRLLGPVCEAVHSHFLSLTKGQFEIRYAPWFQWTSFPELFPEIFDALESLQSPAISLSLMKLTSCLERALGDVFLLIGKECPFLLRDLLSSEELAQVFSQSVMNVLKVFVGSPCGLNLRNVLWHGFASPEEIPPKYCSMMILLTAGLGQLLKSYLQNTKLTLAHRSFISLTNLEDLIVFPDVTYEVLSVLEEVMMKSAFILKIMLPYWEVALVKFKSHRFADCAILLLTQLETGLRNVFATLNRCPKRLLTAESTALYTTFDQILAKHLNDGKINQLPLFLGEPAMEFLWDFLNHQEGPRIRDHLSHGEINLHEFSKETTNQLLAFSLVLLLRFVDDCLLSVFKEKSAVELLISLAEGYSSRCHPVFQLKKQVLSCEESIRVWALLPFPEELTRQAVRLEDNSETNACHSLITKMTDELYHHMPENRCVLKDLDRLPTETWPQLLRELCSTPVPTLFCPRIVLEVLVVLRSISEQCRRVSSQVTVASELRHRQWVERTLRSRQRQNYLRMWSSIRLLSPVLSLILLLIALELVNIHAVCGKNAHEYQQYLKFVKSILQYTENLVAYTSYEKNKWNETINLTHTALLKMWTFSEKKQMLIHLAKKSTSKVLL

SEQ ID NO: 9421 - protein, 552 aa, Artificial Sequence
  Description of Artificial Sequence: Synthetic coding sequence
MKLTSCLERALGDVFLLIGKECPFLLRDLLSSEELAQVFSQSVMNVLKVFVGSPCGLNLRNVLWHGFASPEEIPPKYCSMMILLTAGLGQLLKSYLQNTKLTLAHRSFISLTNLEDLIVFPDVTYEVLSVLEEVMMKSAFILKIMLPYWEVALVKFKSHRFADCAILLLTQLETGLRNVFATLNRCPKRLLTAESTALYTTFDQILAKHLNDGKINQLPLFLGEPAMEFLWDFLNHQEGPRIRDHLSHGEINLHEFSKETTNQLLAFSLVLLLRFVDDCLLSVFKEKSAVELLISLAEGYSSRCHPVFQLKKQVLSCEESIRVWALLPFPEELTRQAVRLEDNSETNACHSLITKMTDELYHHMPENRCVLKDLDRLPTETWPQLLRELCSTPVPTLFCPRIVLEVLVVLRSISEQCRRVSSQVTVASELRHRQWVERTLRSRQRQNYLRMWSSIRLLSPVLSLILLLIALELVNIHAVCGKNAHEYQQYLKFVKSILQYTENLVAYTSYEKNKWNETINLTHTALLKMWTFSEKKQMLIHLAKKSTSKVLL

SEQ ID NO: 9422 - protein, 605 aa, Artificial Sequence
  Description of Artificial Sequence: Synthetic coding sequence
MEVLIGDPITTCLSPSVYDIICNLGFQLRENCDINSIVTQNGEVCWKTITDCVSYTESEQGLDYWGSVRLLGPVCEAVHSHFLSLTKGQFEIRYAPWFQWTSFPELFPEIFDALESLQSPAISLSLMKLTSCLERALGDVFLLIGKECPFLLRDLLSSEELAQVFSQSVMNVLKVFVGSPCGLNLRNVLWHGFASPEEIPPKYCSMMILLTAGLGQLLKSYLQNTKLTLAHRSFISLTNLEDLIVFPDVTYEVLSVLEEVMMKSAFILKIMLPYWEVALVKFKSHRFADCAILLLTQLETGLRNVFATLNRCPKRLLTAESTALYTTFDQILAKHLNDGKINQLPLFLGEPAMEFLWDFLNHQEGPRIRDHLSHGEINLHEFSKETTNQLLAFSLVLLLRFVDDCLLSVFKEKSAVELLISLAEGYSSRCHPVFQLKKQVLSCEESIRVWALLPFPEELTRQAVRLEDNSETNACHSLITKMTDELYHHMPENRCVLKDLDRLPTETIRLLSPVLSLILLLIALELVNIHAVCGKNAHEYQQYLKFVKSILQYTENLVAYTSYEKNKWNETINLTHTALLKMWTFSEKKQMLIHLAKKSTSKVLL

SEQ ID NO: 9423 - protein, 330 aa, Artificial Sequence
  Description of Artificial Sequence: Synthetic coding sequence
MEGAPPGSLALRLLLFVALPASGWLTTGAPEPPPLSGAPQDGIRINVTTLKDDGDISKQQVVLNITYESGQVYVNDLPVNSGVTRISCQTLIVKNENLENLEEKEYFGIVSVRILVHEWPMTSGSSLQLIVIQEEVVEIDGKQVQQKDVTEIDILVKNRGVLRHSNYTLPLEESMLYSISRDSDILFTLPNLSKKESVSSLQTTSQYLIRNVETTVDEDVLPGKLPETPLRAEPPSSYKVMCQWMEKFRKDLCRFWSNVFPVFFQFLNIMVVGITGAAVVITILKVFFPVSEYKGILQLDKVDVIPVTAINLYPDGPEKRAENLEDKTCI

SEQ ID NO: 9424 - protein, 131 aa, Artificial Sequence
  Description of Artificial Sequence: Synthetic coding sequence
MTSGSSLQLIVIQEEVVEIDGKQVQQKDVTEIDILVKNRGVLRHSNYTLPLEESMLYSISRDSDILFTLPNLSKKESVSSLQTTSQYLIRNVETTVDEDVLPGKLPETPLRAEPPSSYKVLETVDSAPFRL

SEQ ID NO: 9425 - protein, 125 aa, Artificial Sequence
  Description of Artificial Sequence: Synthetic coding sequence
LQLIVIQEEVVEIDGKQVQQKDVTEIDILVKNRGVLRHSNYTLPLEESMLYSISRDSDILFTLPNLSKKESVSSLQTTSQYLIRNVETTVDEDVLPGKLPETPLRAEPPSSYKVLETVDSAPFRL

SEQ ID NO: 9426 - protein, 354 aa, Artificial Sequence
  Description of Artificial Sequence: Synthetic coding sequence
MDFILEDMDLAANEISIYDKLSETVDLVRQTGHQCGMSEKAIEKFIRQLLEKNEPQRPPPQYPLLIVVYKVLATLGLILLTAYFVIQPFSPLAPEPVLSGAHTWRSLIHHIRLMSLPIAKKYMSENKGVPLHGGDEDRPFPDFDPWWTNDCEQNESEPIPANCTGCAQKHLKVMLLEDAPRKFERLHPLVIKTGKPLLEEEIQHFLCQYPEATEGFSEGFFAKWWRCFPERWFPFPYPWRRPLNRSQMLRELFPVFTHLPFPKDASLNKCSFLHPEPVVGSKMHKMPDLFIIGSGEAMLQLIPPFQCRRHCQSVAMPIEPGDIGYVDTTHWKVYVIARGVQPLVICDGTAFSEL

SEQ ID NO: 9427 - protein, 241 aa, Artificial Sequence
  Description of Artificial Sequence: Synthetic coding sequence
MSLPIAKKYMSENKGVPLHGGDEDRPFPDFDPWWTNDCEQNESEPIPANCTGCAQKHLKVMLLEDAPRKFERLHPLVIKTGKPLLEEEIQHFLCQYPEATEGFSEGFFAKWWRCFPERWFPFPYPWRRPLNRSQMLRELFPVFTHLPFPKDASLNKCSFLHPEPVVGSKMHKMPDLFIIGSGEAMLQLIPPFQCRRHCQSVAMPIEPGDIGYVDTTHWKVYVIARGVQPLVICDGTAFSEL

SEQ ID NO: 9428 - protein, 347 aa, Artificial Sequence
  Description of Artificial Sequence: Synthetic coding sequence
MDLAANEISIYDKLSETVDLVRQTGHQCGMSEKAIEKFIRQLLEKNEPQRPPPQYPLLIVVYKVLATLGLILLTAYFVIQPFSPLAPEPVLSGAHTWRSLIHHIRLMSLPIAKKYMSENKGVPLHGGDEDRPFPDFDPWWTNDCEQNESEPIPANCTGCAQKHLKVMLLEDAPRKFERLHPLVIKTGKPLLEEEIQHFLCQYPEATEGFSEGFFAKWWRCFPERWFPFPYPWRRPLNRSQMLRELFPVFTHLPFPKDASLNKCSFLHPEPVVGSKMHKMPDLFIIGSGEAMLQLIPPFQCRRHCQSVAMPIEPGDIGYVDTTHWKVYVIARGVQPLVICDGTAFSEL

SEQ ID NO: 9429 - protein, 235 aa, Artificial Sequence
  Description of Artificial Sequence: Synthetic coding sequence
MDFILEDMDLAANEISIYDKLSETVDLVRQTGHQCGMSEKAIEKFIRQLLEKNEPQRPPPQYPLLIVVYKVLATLGLILLTAYFVIQPFSPLAPEPVLSGAHTWRSLIHHIRLMSLPIAKKYMSENKGVPLHGGDEDRPFPDFDPWWTNDCEQNESEPIPANCTGCAQKHLKVMLLEDAPRKFERLHPLVIKEIELCTGTASRAENQVERGKIKTKTMKLLSGGWLLSYLPFACM

SEQ ID NO: 9430 - protein, 241 aa, Artificial Sequence; identical to SEQ ID NO: 9427
  Description of Artificial Sequence: Synthetic coding sequence

SEQ ID NO: 9431 - protein, 234 aa, Artificial Sequence
  Description of Artificial Sequence: Synthetic coding sequence
DFILEDMDLAANEISIYDKLSETVDLVRQTGHQCGMSEKAIEKFIRQLLEKNEPQRPPPQYPLLIVVYKVLATLGLILLTAYFVIQPFSPLAPEPVLSGAHTWRSLIHHIRLMSLPIAKKYMSENKGVPLHGGDEDRPFPDFDPWWTNDCEQNESEPIPANCTGCAQKHLKVMLLEDAPRKFERLHPLVIKEIELCTGTASRAENQVERGKIKTKTMKLLSGGWLLSYLPFACM

SEQ ID NO: 9432 - protein, 216 aa, Artificial Sequence
  Description of Artificial Sequence: Synthetic coding sequence
MLASPARPTLRMLANHALSTPHCACSPAPAPRTASASRRRCVPVEARAAGVFGDRLAGVFGSRGLKHGGVQAPRPRVVRAEPRAGFAVVRSPRRLCGRSHAPQPPAHLGLGPGCFPAVAVVVPVPGSRAHRPFAALLVEGSFLGDPPIPPRRSGVLARGSAGADCLASSVTPGPSLWIPLLLVAGCVSCFVGLAVCVWMQARVSPAWPAGLFLLPR

SEQ ID NO: 9433 - protein, 118 aa, Artificial Sequence
  Description of Artificial Sequence: Synthetic coding sequence
MEDFATRTYGTSGLDNRPLFGETSAKDRIINLVVGSLTSLLILVTLISAFVFPQLPPKPLNIFFAVCISLSSITACILIYWYRQGDLEPKFRKLIYYIIFSIIMLCICANLYFHDVGR

SEQ ID NO: 9434 - protein, 118 aa, Artificial Sequence; identical to SEQ ID NO: 9433
  Description of Artificial Sequence: Synthetic coding sequence

SEQ ID NO: 9435 - protein, 5 aa, Artificial Sequence
  Description of Artificial Sequence: Synthetic coding sequence
MEDFA

SEQ ID NO: 9436 - protein, 234 aa, Artificial Sequence
  Description of Artificial Sequence: Synthetic coding sequence
MGPGGRVARLLAPLMWRRAVSSVAGSAVGAEPGLRLLAVQRLPVGAAFCRACQTPNFVRGLHSEPGLEERAEGTVNEGRPESDAADHTGPKFDIDMMVSLLRQENARDICVIQVPPEMRYTDYFVIVSGTSTRHLHAMAFYVVKMYKHLKCKRDPHVKIEGKDTDDWLCVDFGSMVIHLMLPETREIYELEKLWTLRSYDDQLAQIAPETVPEDFILGIEDDTSSVTPVELKCE

SEQ ID NO: 9437 - protein, 314 aa, Artificial Sequence
  Description of Artificial Sequence: Synthetic coding sequence
MFSINPLENLKVYISSRPPLVVFMISVSAMAIAFLTLGYFFKIKEIKSPEMAEDWNTFLLRFNDLDLCVSENETLKHLTNDTTTPESTMTSGQARASTQSPQALEDSGPVNISVSITLTLDPLKPFGGYSRNVTHLYSTILGHQIGLSGREAHEEINITFTLPTAWSSDDCALHGHCEQVVFTACMTLTASPGVFPVTVQPPHCVPDTYSNATLWYKIFTTARDANTKYAQDYNPFWCYKGAIGKVYHALNPKLTVIVPDDDRSLINLHLMHTSYFLFVMVITMFCYAVIKGRPSKLRQSNPEFCPEKVALAEA

SEQ ID NO: 9438 - protein, 72 aa, Artificial Sequence
  Description of Artificial Sequence: Synthetic coding sequence
MFSINPLENLKVYISSRPPLVVFMISVSAMAIAFLTLGYFFKIKEIKSPEMAEDWNTFLLRFNDLDLCVSEN

SEQ ID NO: 9439 - protein, 94 aa, Artificial Sequence
  Description of Artificial Sequence: Synthetic coding sequence
MFSINPLENLKVYISSRPPLVVFMISVSAMAIAFLTLGYFFKIKEIKSPEMAEDWNTFLLRFNDLDLCVSENETLKHLTNDTTTPESTMTSGQA

SEQ ID NO: 9440 - protein, 139 aa, Artificial Sequence
  Description of Artificial Sequence: Synthetic coding sequence
MFSINPLENLKVYISSRPPLVVFMISVSAMAIAFLTLGYFFKIKEIKSPEMAEDWNTFLLRFNDLDLCVSENETLKHLTNDTTTPESTMTSGQARASTQSPQALEDSGPVNISVSITLTLDPLKPFGGYSRNVTHLYST

SEQ ID NO: 9441 - protein, 146 aa, Artificial Sequence
  Description of Artificial Sequence: Synthetic coding sequence
MMWQKYAGSRRSMPLGARILFHGVFYAGGFAIVYYLIQKFHSRALYYKLAVEQLQSHPEAQEALGPPLNIHYLKLIDRENFVDIVDAKLKIPVSGSKSEGLLYVHSSRGGPFQRWHLDEVFLELKDGQQIPVFKLSGENGDEVKKE

SEQ ID NO: 9442 - protein, 146 aa, Artificial Sequence; identical to SEQ ID NO: 9441
  Description of Artificial Sequence: Synthetic coding sequence

SEQ ID NO: 9443 - protein, 146 aa, Artificial Sequence; identical to SEQ ID NO: 9441
  Description of Artificial Sequence: Synthetic coding sequence

SEQ ID NO: 9444 - protein, 146 aa, Artificial Sequence; identical to SEQ ID NO: 9441
  Description of Artificial Sequence: Synthetic coding sequence

SEQ ID NO: 9445 - protein, 146 aa, Artificial Sequence; identical to SEQ ID NO: 9441
  Description of Artificial Sequence: Synthetic coding sequence

SEQ ID NO: 9446 - protein, 113 aa, Artificial Sequence
  Description of Artificial Sequence: Synthetic coding sequence
MMWQKYAGSRRSMPLGARILFHGVFYAGGFAIVYYLIQKFHSRALYYKLAVEQLQSHPEAQEALGPPLNIHYLKLIDRENFVDIVDAKLKIPVSGSKSEGLLYVHSSRGGPFQ

SEQ ID NO: 9447 - protein, 88 aa, Artificial Sequence
  Description of Artificial Sequence: Synthetic coding sequence
MMWQKYAGSRRSMPLGARILFHGVFYAGGFAIVYYLIQKFHSRALYYKLAVEQLQSHPEAQEALGPPLNIHYLKLIDRENFVDIVDAK

SEQ ID NO: 9448 - protein, 146 aa, Artificial Sequence; identical to SEQ ID NO: 9441
  Description of Artificial Sequence: Synthetic coding sequence

SEQ ID NO: 9449 - protein, 146 aa, Artificial Sequence; identical to SEQ ID NO: 9441
  Description of Artificial Sequence: Synthetic coding sequence

SEQ ID NO: 9450 - protein, 146 aa, Artificial Sequence; identical to SEQ ID NO: 9441
  Description of Artificial Sequence: Synthetic coding sequence

SEQ ID NO: 9451 - protein, 244 aa, Artificial Sequence
  Description of Artificial Sequence: Synthetic coding sequence
MGDLFSLFWEVDPPPIPVNCAIPNQDYECWKDDSCGTIGSFLLWYFVIVFVLMFFSRASVWMSEDKKDEGSGTSTSVRKASKETSCKRQSKDSAWDPSQTMKKPKQNQLTPVTNSEVALVNAYPEQRRARRQSQFNEVNQNQHDSDTTEYGSEESNSEASSWKESESEHHPSPDSIKRRKMAQRQRNLGSYQMSERHCLHCKALRTNEWLAHHSRQKPSVTPPMKRDSQEESSISDINKKFSKF

SEQ ID NO: 9452 - protein, 131 aa, Artificial Sequence
  Description of Artificial Sequence: Synthetic coding sequence
MTHSSQDTGSCGIQEDGKLYVVDSINDLNKLNLCPAGSQHLFPLEDKIPVLGTNSGNGSRSLFFVGLLIVLIVSLALVFFVIFLIVQTGNKMDDVSRRLTAEGKDIDDLKRINNMIVKRLNQLNQLDSEQN

SEQ ID NO: 9453 - protein, 59 aa, Artificial Sequence
  Description of Artificial Sequence: Synthetic coding sequence
MTHSSQDTGSCGIQEDGKLYVVDSINDLNKLNLCPAGSQHLFLLRQSSKNFPKRSKEIA

SEQ ID NO: 9454 - protein, 131 aa, Artificial Sequence; identical to SEQ ID NO: 9452
  Description of Artificial Sequence: Synthetic coding sequence

SEQ ID NO: 9455 - protein, 113 aa, Artificial Sequence
  Description of Artificial Sequence: Synthetic coding sequence
MAALGSPSHTFRGLLRELRYLSAATGRPYRDTAAYRYLVKAFRAHRVTSEKLCRAQHELHFQAATYLCLLRSIRKHVALHQEFHGKGERSVEESAGLVGLKLPHQPGGKGWEP

SEQ ID NO: 9456 - protein, 1026 aa, Artificial Sequence
  Description of Artificial Sequence: Synthetic coding sequence
MVCRPVFPCRRRFCPRPFLVGLVVAICLFYQTLTLRGSRKLTAAAPGAVPHTSTETQASRCKKGFSQDKQCFLLSGNAQETRKVKESMETHFGSHGRRAILYRPPFYSKTELQLHQHILTQHGYTVVIAEERLNAGLGPGLLEQGDLGSWDLLICLSSKKAEGTPCISKEVMCQLGLHQKANRLPEIQQPLCRKEGLCQIVRRFPELQLPVSPSVCLDQGMQLKPSTSSHLLKTVKPRVWKPGDWSREQLNETTVLAPHETIFRAEDLSVILKAYVLVTSLTPLRAFIHSTGTVWNPPKKKRFTVKLQTFFETFLRASSPQQAFDIMKEAIGKLLLAAEVFSETSTLGPKTFHRCRFCFQLLTFDIGYGSFMYPVVLQVHEHLNFQDYDNMDFEDQNTEEFLLNDTFNFLFPNESSLSIFSEIFQRLYRSDVFKGENYQKELNQCLSLEEINSIMTFIKELGSLGQFQLLFPSTTPGIQSLMHEFYDVANPVGNPGSVLTQYWSLLNVFEQFQFMNKKTQPHPLEWNSFTEDKNIEKPQVPFDAIENKKAAVPQIKNENKEIHCSDDENTPCHIKQIFTHPHLELNPDFHPKIKDYYCEVPFDVVTVTIGVETPKCLCKVHLYEQAGPSFASYPLGLGMNKISIFVVDESPAHGETLITYKLTIYREDRPSLPLFEAFTACGFVQDCGLLIHPEETCGLQPISSDYIEAILQSELKRCPSGDMKGQWIVPCLSCSDNRTCDWREITWQPHNCQYGVLTKPQLQQCLGGRKILFIGDSTNRGIMYYLIERLNETLQEWQKVHGTKFYHNVNGGKTLISYSYYPQFWISPSLRPTFENALEHLLQRSRPLENTGQTVLVVGGVQWLNSNHLQIIHKVLKRENLLNILVIIKTLGIGFHLPVDGVHFLTQSEVQNLWKENLIILDTAKKHGYEVVDTFTITMGRYKEFLQGKCGCHFHEVVKSKLSKEYNFIKMKRSRNHIMGRYFSNQSKLQQGTVTNFRSPYHVRGPINQVCSEILLSRMCANKRTM

SEQ ID NO: 9457 - protein, 202 aa, Artificial Sequence
  Description of Artificial Sequence: Synthetic coding sequence
MVCRPVFPCRRRFCPRPFLVGLVVAICLFYQTLTLRGSRKLTAAAPGAVPHTSTETQASRCKKGFSQDKQCFLLSGNAQETRKVKESMETHFGSHGRRAILYRPPFYSKTELQLHQHILTQHGYTVVIAEERLNAGLGPGLLEQGDLGSWDLLICLSSKKAEGTPCISKEVMCQLGLHQKQLRRREERQRPGSPASRRLSVR

SEQ ID NO: 9458 - protein, 549 aa, Artificial Sequence
  Description of Artificial Sequence: Synthetic coding sequence
MVCRPVFPCRRRFCPRPFLVGLVVAICLFYQTLTLRGSRKLTAAAPGAVPHTSTETQASRCKKGFSQDKQCFLLSGNAQETRKVKESMETHFGSHGRRAILYRPPFYSKTELQLHQHILTQHGYTVVIAEERLNAGLGPGLLEQGDLGSWDLLICLSSKKAEGTPCISKEVMCQLGLHQKANRLPEIQQPLCRKEGLCQIVRRFPELQLPVSPSVCLDQGMQLKPSTSSHLLKTVKPRVWKPGDWSREQLNETTVLAPHETIFRAEDLSVILKAYVLVTSLTPLRAFIHSTGTVWNPPKKKRFTVKLQTFFETFLRASSPQQAFDIMKEAIGKLLLAAEVFSETSTLGPKTFHRCRFCFQLLTFDIGYGSFMYPVVLQVHEHLNFQDYDNMDFEDQNTEEFLLNDTFNFLFPNESSLSIFSEIFQRLYRSDVFKGENYQKELNQCLSLEEINSIMTFIKELGSLGQFQLLFPSTTPGIQSLMHEFYDVANPVGNPGSVLTQYWSLLNVFEQFQFMNKKTQPHPLEWNSFTEDKNIEKPQVPFDAIENKK

SEQ ID NO: 9459 - protein, 783 aa, Artificial Sequence
  Description of Artificial Sequence: Synthetic coding sequence
MVCRPVFPCRRRFCPRPFLVGLVVAICLFYQTLTLRGSRKLTAAAPGAVPHTSTETQASRCKKGFSQDKQCFLLSGNAQETRKVKESMETHFGSHGRRAILYRPPFYSKTELQLHQHILTQHGYTVVIAEERLNAGLGPGLLEQGDLGSWDLLICLSSKKAEGTPCISKEVMCQLGLHQKANRLPEIQQPLCRKEGLCQIVRRFPELQLPVSPSVCLDQGMQLKPSTSSHLLKTVKPRVWKPGDWSREQLNETTVLAPHETIFRAEDLSVILKAYVLVTSLTPLRAFIHSTGTVWNPPKKKRFTVKLQTFFETFLRASSPQQAFDIMKEAIGKLLLAAEVFSETSTLGPKTFHRCRFCFQLLTFDIGYGSFMYPVVLQVHEHLNFQDYDNMDFEDQNTEEFLLNDTFNFLFPNESSLSIFSEIFQRLYRSDVFKGENYQKELNQCLSLEEINSIMTFIKELGSLGQFQLLFPSTTPGIQSLMHEFYDVANPVGNPGSVLTQYWSLLNVFEQFQFMNKKTQPHPLEWNSFTEDKNIEKPQVPFDAIENKKAAVPQIKNENKEIHCSDDENTPCHIKQIFTHPHLELNPDFHPKIKDYYCEVPFDVVTVTIGVETPKCLCKVHLYEQAGPSFASYPLGLGMNKISIFVVDESPAHGETLITYKLTIYREDRPSLPLFEAFTACGFVQDCGLLIHPEETCGLQPISSDYIEAILQSELKRCPSGDMKGQWIVPCLSCSDNRTCDWREITWQPHNCQYGVLTKPQLQQCLGGRKLGVDVQRVPRSRN

SEQ ID NO: 9460 - protein, 115 aa, Artificial Sequence
  Description of Artificial Sequence: Synthetic coding sequence
MMAVMTPSDGLSQLSVPHLTHQRLWSLSCLAMLFQAVLILSAPQMSCLLKCFYALDPLHPVMSEEFSAQYRHMMDQRYRTRIHEGYISQVKGAYLRIVHKKPISYAKSFPKEMGN

SEQ ID NO: 9461 - protein, 99 aa, Artificial Sequence
  Description of Artificial Sequence: Synthetic coding sequence
MGECPHLVDVRLGHRSLATGPEQSDICHTGSEARWTTTWYGSLSFSRHKYKMLADLTPGVEMSCRHWARWLTPVIPALWKAEAGGLPELRSSRPAWTTW

SEQ ID NO: 9462 - protein, 107 aa, Artificial Sequence
  Description of Artificial Sequence: Synthetic coding sequence
MAGGYGVMGDDGSIDYTVHEAWNEATNVYLIVILVSFGLFMYAKRNKRRIMRIFSVPPTEETLSEPNFYDTISKIRLRQQLEMYSISRKYDYQQPQNQADSVQLSLE

SEQ ID NO: 9463 - protein, 107 aa, Artificial Sequence; identical to SEQ ID NO: 9462
  Description of Artificial Sequence: Synthetic coding sequence

SEQ ID NO: 9464 - protein, 107 aa, Artificial Sequence; identical to SEQ ID NO: 9462
  Description of Artificial Sequence: Synthetic coding sequence

SEQ ID NO: 9465 - protein, 107 aa, Artificial Sequence; identical to SEQ ID NO: 9462
  Description of Artificial Sequence: Synthetic coding sequence

SEQ ID NO: 9466 - protein, 107 aa, Artificial Sequence; identical to SEQ ID NO: 9462
  Description of Artificial Sequence: Synthetic coding sequence

SEQ ID NO: 9467 - protein, 216 aa, Artificial Sequence
  Description of Artificial Sequence: Synthetic coding sequence
MWPPCGTLRTLALARSRGARACSGDGGVSYTQGQSPEPRTREYFYYVDHQGQLFLDDSKMKNFITCFKDPQFLVTFFSRLRPNRSGRYEAAFPFLSPCGRERNFLRCEDRPVVFTHLLTADHGPPRLSYCGGGEALAVPFEPARLLPLAANGRLYHPAPERAGGVGLVRSALAFELSACFEYGPGAPALPSHVRWQGRRLALTMDLAPLLLAARSP

SEQ ID NO: 9468 - protein, 86 aa, Artificial Sequence
  Description of Artificial Sequence: Synthetic coding sequence
MGRKDAATIKLPVDQYRKQIGKQDYKKTKPILRATKLKAEAKKTAIGIKEVGLVLAAILALLLAFYAFFYLRLTTDVDPDLDQDED

SEQ ID NO: 9469 - protein, 75 aa, Artificial Sequence
  Description of Artificial Sequence: Synthetic coding sequence
MGRKDAATIKLPVDQYRKQIGKQDYKKTKPILRATKLKAEAKKTAIGIKEVGLVLAAILALLLAFYAFFYLRLTT

SEQ ID NO: 9470 - protein, 86 aa, Artificial Sequence; identical to SEQ ID NO: 9468
  Description of Artificial Sequence: Synthetic coding sequence

SEQ ID NO: 9471 - protein, 86 aa, Artificial Sequence; identical to SEQ ID NO: 9468
  Description of Artificial Sequence: Synthetic coding sequence

SEQ ID NO: 9472 - protein, 86 aa, Artificial Sequence; identical to SEQ ID NO: 9468
  Description of Artificial Sequence: Synthetic coding sequence

SEQ ID NO: 9473 - protein, 86 aa, Artificial Sequence; identical to SEQ ID NO: 9468
  Description of Artificial Sequence: Synthetic coding sequence

SEQ ID NO: 9474 - protein, 86 aa, Artificial Sequence; identical to SEQ ID NO: 9468
  Description of Artificial Sequence: Synthetic coding sequence

SEQ ID NO: 9475 - protein, 86 aa, Artificial Sequence; identical to SEQ ID NO: 9468
  Description of Artificial Sequence: Synthetic coding sequence

SEQ ID NO: 9476 - protein, 8 aa, Artificial Sequence
  Description of Artificial Sequence: Synthetic coding sequence
MGRKDAAT

SEQ ID NO: 9477 - protein, 86 aa, Artificial Sequence; identical to SEQ ID NO: 9468
  Description of Artificial Sequence: Synthetic coding sequence

SEQ ID NO: 9478 - protein, 86 aa, Artificial Sequence; identical to SEQ ID NO: 9468
  Description of Artificial Sequence: Synthetic coding sequence

SEQ ID NO: 9479 - protein, 127 aa, Artificial Sequence
  Description of Artificial Sequence: Synthetic coding sequence
MNFILFIFIPGVFSLKSSTLKPTIEALPNVLPLNEDVNKQEEKNEDHTPNYAPANEKNGNYYKDIKQYVFTTQNPNGTESEISVRATTDLNFALKNDKTVNATTYEKSTIEEETTTSEPSHKNIQSI

SEQ ID NO: 9480 - protein, 294 aa, Artificial Sequence
  Description of Artificial Sequence: Synthetic coding sequence
MNFILFIFIPGVFSLKSSTLKPTIEALPNVLPLNEDVNKQEEKNEDHTPNYAPANEKNGNYYKDIKQYVFTTQNPNGTESEISVRATTDLNFALKNDKTVNATTYEKSTIEEETTTSEPSHKNIQRSTPNVPAFWTMLAKAINGTAVVMDDKDQLFHPIPESDVNATQGENQPDLEDLKIKIMLGISLMTLLLFVVLLAFCSATLYKLRHLSYKSCESQYSVNPELATMSYFHPSEGVSDTSFSKSAESSTFLGTTSSDMRRSGTRTSESKIMTDIISIGSDNEMHENDESVTR

SEQ ID NO: 9481 - protein, 265 aa, Artificial Sequence
  Description of Artificial Sequence: Synthetic coding sequence
MNFILFIFIPGVFSLKSSTLKPTIEALPNVLPLNEDVNKQEEKNEDHTPNYAPANEKNGNYYKDIKQYVFTTQNPNGTESEISVRATTDLNFALKNGSTPNVPAFWTMLAKAINGTAVVMDDKDQLFHPIPESDVNATQGENQPDLEDLKIKIMLGISLMTLLLFVVLLAFCSATLYKLRHLSYKSCESQYSVNPELATMSYFHPSEGVSDTSFSKSAESSTFLGTTSSDMRRSGTRTSESKIMTDIISIGSDNEMHENDESVTR

SEQ ID NO: 9482 - protein, 112 aa, Artificial Sequence
  Description of Artificial Sequence: Synthetic coding sequence
MGSRLSQPFESYITAPPGTAAAPAKPAPPATPGAPTSPAEHRLLKTCWSCRVLSGLGLMGAGGYVYWVARKPMKMGYPPSPWTITQMVIGLSIATWGIVVMADPKGKAYRVV

SEQ ID NO: 9483 - protein, 403 aa, Artificial Sequence
  Description of Artificial Sequence: Synthetic coding sequence
MSTSTSPAAMLLRRLRRLSWGSTAVQLFILTVVTFGLLAPLACHRLLHSYFYLRHWHLNQMSQEFLQQSLKEGEAALHYFEELPSANGSVPIVWQATPRPWLVITIITVDRQPGFHYVLQVVSQFHRLLQQCGPQCEGHQLFLCNVERSVSHFDAKLLSKYVPVANRYEGTEDDYGDDPSTNSFEKEKQDYVYCLESSLQTYNPDYVLMVEDDAVPEEQIFPVLEHLLRARFSEPHLRDALYLKLYHPERLQHYINPEPMRILEWVGVGMLLGPLLTWIYMRFASRPGFSWPVMLFFSLYSMGLVELVGRHYFLELRRLSPSLYSVVPASQCCTPAMLFPAPAARRTLTYLSQVYCHKGFGKDMALYSLLRAKGERAYVVEPNLVKHIGLFSSLRYNFHPSLL

SEQ ID NO: 9484 - protein, 403 aa, Artificial Sequence; identical to SEQ ID NO: 9483
  Description of Artificial Sequence: Synthetic coding sequence

SEQ ID NO: 9485 - protein, 403 aa, Artificial Sequence; identical to SEQ ID NO: 9483
  Description of Artificial Sequence: Synthetic coding sequence

SEQ ID NO: 9486 - protein, 229 aa, Artificial Sequence
  Description of Artificial Sequence: Synthetic coding sequence
MDSLDRSCQDWCDRKQHWLEIGPPDLVERKGSLTLRSHHKKYSKPVLVYSWHRDREAFPKGYDIEGPEKVKKLCNSTYRRLGTDESPIWTSETHEKLSQMCLNTEWVEMKSKALLNEETVSSGIIERVTGLPATGFGAVFPRHPPDWSKMCALTTYSEDYVPPYDYQPHAYPCQDDYSIVHRKCRSQFTDLNGSKRFGINTWHDESGIYANSDVKQKLYPLTSGPIVPI

SEQ ID NO: 9487 - protein, 423 aa, Artificial Sequence
  Description of Artificial Sequence: Synthetic coding sequence
MDRGQPSLEPAAAAPRASGRCVIAPVRAVLRLRRRVCVLRKRRLLQPGGGPDVGTGAPRPGCSPRAPRADLDQPKFFTFDSPAELPSRTPRKKRRRSRLVLYPETSRKYRPRVEHRSRAQRCLLLLVAIVGFQVLNAIENLDDNAQRYDLDGLEKALQRAVFGQPAAVSRIVALMRDYLATHVHSRPLLLALHGPSGVGKSHVGRLLARHFRSVLEDSALVLQYHARHHCPEARAAQDCREELARRVADVVARAEAEEKTPLLVLDDVELMPRPLLDELHGFLQPQRSHHFHNAIYVLLSGAGGAEVTRFVLQNASRALPLRPDGFRSAEAAAAQAEEDLRASLLAVLSREHPLWQAAAIVPFLLLDKRDVVSCFRDEMAGEGFFPDQARAENLAAQLSFYRVAGREFAVTGCKQVVATVNLL

SEQ ID NO: 9488 - protein, 1646 aa, Artificial Sequence
  Description of Artificial Sequence: Synthetic coding sequence
MWHGNHVQPGATHRPNQGLEMLQGLGIGMKAFHNFNYFLFFYNVLLGLGACLSRLLISCLLGMWLIARIDRTIMQSGYEGADMGFSAWIGMLYMDHYHINPVLVSFCHILITNHREKKLQQSTKYWCLNQSAESLRICAMRGGENRPPARVQSSSEELELRHQSLDAFPGRRLPGRGIQPAAKMSSVGKVTQVPNGKAYQQIFQAEVQLVHSLAATRKRAAERSVTLKSGRIPMMKKVETPEGEVMSPRQQKWMHSLPNDWIMENPVLHREKERAKREKARESENTIAAREVRGLMDTIVPEKISTSTFQRQAEHKRKSYESALASFQEEIAQVGKEMEPLIVDTGGLFLKKLTESDEEMNRLFLKVENDTNLEDYTIQALLELWDKVAGRLLLRKQEIKELDEALHSLEFSRTDKLKSVLKKYAEVIEKTSYLMRPEVYRLINEEAMVMNYALLGNRKALAQLFVNLMESTLQQELDSRHRWQGLVDTWKALKKEALLQSFSEFMASESIHTPPAVTKELEVMLKTQNVLQQRRLKHLCTICDLLPPSYSKTQLTEWHSSLNSLNKELDTYHVDCMMRIRLLYEKTWQECLMHVQNCKKQLLDWKAFTEEEAETLVNQFFFQMVGALQGKVEEDLELLDKSFETLADQTEWQSSHLFKYFQEVVQLWEAHQSELLVQELELEKRMEQHRQKHSLESQVQEAHLDRLLDQLRQQSDKETLAFHLEKVKDYLKNMKSRYECFHTLLTKEVMEYPAIMLKELNSYSSALSQYFFVREIFEQNLAGEVIFKFRQPEAHEKPSQKRVKKLRKKQGSKEDMTRSEESISSGTSTARSVEEVEEENDQEMESFITEEVLGQQKKSPLHAKMDESKEGSIQGLEEMQVEREGSLNPSLNEENVKGQGEKKEESEEEDEKEEEEEEEKLEEEKEEKEAQEEQESLSVGEEEDKEEGLEEIYYEDMESFTISSGNTYFVFVPLEEEHCRKSHSTFSAMFINDTSSAKFIEQVTIPSRLILEIKKQLFSEGGNFSPKEINSLCSRLEKEAARIELVESVIMLNMEKLENEYLDQANDVINKFESKFHNLSVDLIFIEKIQRLLTNLQVKIKCQVAKSNSQTNGLNFSLQQLQNKIKTCQESRGEKTTVTTEELLSFVQTWKEKLSQRIQYLNCSLDRVSMTELVFTNTILKDQEEDSDILTSSEALEEEAKLDVVTPESFTQLSRVGKPLIEDPAVDVIRKLLQLPNTKWPTHHCDKDPSQTGFKRHRCQPENSGKKAVPSASATSAGSLQTTHPPLSHSFTPHPKPNKMERKYRVLGDKPPPAAEDFKGIILTLLWESSENLLTVAEEFYRKEKRPVTRPDCMCDTFDQCAENISKKILEYQSQANKYHNSCLIELRIQIRRFEELLPQVCWLVMENFKEHHWKKFFTSVKEIRGQFEEQQKRLEKRKDKNAQKLHLNLGHPVHFQEMESLHLSEEERQEELDSMIRMNKEKLEECTRRNGQVFITNLATFTEKFLLQLDEVVTIDDVQVARMEPPKQKLSMLIRRKLAGLSLKEESEKPLIERGSRKWPGIKPTEVTIQNKILLQPTSSISTTKTTLGHLAAVEARDAVYLKYLASFEEELKRIQDDCTSQIKEAQRWKDSWKQSLHTIQGLYV

SEQ ID NO: 9489 - protein, 1701 aa, Artificial Sequence
  Description of Artificial Sequence: Synthetic coding sequence
MRGGENRPPARVQSSSEELELRHQSLDAFPGRRLPGRGIQPAAKMSSVGKVTQVPNGKAYQQIFQAEVQLVHSLAATRKRAAERSVTLKSGRIPMMKKVETPEGEVMSPRQQKWMHSLPNDWIMENPVLHREKERAKREKARESENTIAAREVRGLMDTIVPEKISTSTFQRQAEHKRKSYESALASFQEEIAQVGKEMEPLIVDTGGLFLKKLTESDEEMNRLFLKVENDTNLEDYTIQALLELWDKVAGRLLLRKQEIKELDEALHSLEFSRTDKLKSVLKKYAEVIEKTSYLMRPEVYRLINEEAMVMNYALLGNRKALAQLFVNLMESTLQQELDSRHRWQGLVDTWKALKKEALLQSFSEFMASESIHTPPAVTKELEVMLKTQNVLQQRRLKHLCTICDLLPPSYSKTQLTEWHSSLNSLNKELDTYHVDCMMRIRLLYEKTWQECLMHVQNCKKQLLDWKAFTEEEAETLVNQFFFQMVGALQGKVEEDLELLDKSFETLADQTEWQSSHLFKYFQEVVQLWEAHQSELLVQELELEKRMEQHRQKHSLESQVQEAHLDRLLDQLRQQSDKETLAFHLEKVKDYLKNMKSRYECFHTLLTKEVMEYPAIMLKELNSYSSALSQYFFVREIFEQNLAGEVIFKFRQPEAHEKPSQKRVKKLRKKQGSKEDMTRSEESISSGTSTARSVEEVEEENDQEMESFITEEVLGQQKKSPLHAKMDESKEGSIQGLEEMQVEREGSLNPSLNEENVKGQGEKKEESEEEDEKEEEEEEEKLEEEKEEKEAQEEQESLSVGEEEDKEEGLEEIYYEDMESFTISSGNTYFVFVPLEEEHCRKSHSTFSAMFINDTSSAKFIEQVTIPSRLILEIKKQLRAGFFEHLEKWFDQCSLNTRVTVATKINELDSELELHLHLHQPRAQQIEKDIHNVRAAELLLHQEQLDSHCAGVTETLKKKRLMFCQFQEEQNVRSKNFRLKIYDMEHIFLNATRSQKLVTLSNTLHQELLSYVDVTQVSLRSFRQYLEESLGKLRYSNIEFIKHCRLFSEGGNFSPKEINSLCSRLEKEAARIELVESVIMLNMEKLENEYLDQANDVINKFESKFHNLSVDLIFIEKIQRLLTNLQVKIKCQVAKSNSQTNGLNFSLQQLQNKIKTCQESRGEKTTVTTEELLSFVQTWKEKLSQRIQYLNCSLDRVSMTELVFTNTILKDQEEDSDILTSSEALEEEAKLDVVTPESFTQLSRVGKPLIEDPAVDVIRKLLQLPNTKWPTHHCDKDPSQTGRGAWACGSRGSSEAGAGGAVCSPPVLCSCPGPSSPKGFKRHRCQPENSGKKAVPSASATSAGSFTPHPKPNKMERKYRVLGDKPPPAAEDFKGIILTLLWESSENLLTVAEEFYRKEKRPVTRPDCMCDTFDQCAENISKKILEYQSQANKYHNSCLIELRIQIRRFEELLPQVCWLVMENFKEHHWKKFFTSVKEIRGQFEEQQKRLEKRKDKNAQKLHLNLGHPVHFQEMESLHLSEEERQEELDSMIRMNKEKLEECTRRNGQVFITNLATFTEKFLLQLDEVVTIDDVQVARMEPPKQKLSMLIRRKLAGLSLKEESEKPLIERGSRKWPGIKPTEVTIQNKILLQPTSSISTTKTTLGHLAAVEARDAVYLKYLASFEEELKRIQDDCTSQIKEAQRWKDSWKQSLHTIQGLYV

SEQ ID NO: 9490 - protein, 220 aa, Artificial Sequence
  Description of Artificial Sequence: Synthetic coding sequence
MWHGNHVQPGATHRPNQGLEMLQGLGIGILTISIVVGLMILQMCIAASFFLQPKLGTADKQKPLALNNRKAFHNFNYFLFFYNVLLGLGACLSRLLISCLLGMWLIARIDRTIMQSGYEGADMGFSAWIGMLYMDHYHINPVLVSFCHILITNHREKKLQQSTKYWCLNQSAGPHVSARSRTRWFLLQTLIDNPRLTMHRKLKLGHSSQESQILMACSES

SEQ ID NO: 9491 - protein, 682 aa, Artificial Sequence
  Description of Artificial Sequence: Synthetic coding sequence
MWHGNHVQPGATHRPNQGLEMLQGLGIGMKAFHNFNYFLFFYNVLLGLGACLSRLLISCLLGMWLIARIDRTIMQSGYEGADMGFSAWIGMLYMDHYHINPVLVSFCHILITNHREKKLQQSTKYWCLNQSAESLRICAMRGGENRPPARVQSSSEELELRHQSLDAFPGRRLPGRGIQPAAKMSSVGKVTQVPNGKAYQQIFQAEVQLVHSLAATRKRAAERSVTLKSGRIPMMKKVETPEGEVMSPRQQKWMHSLPNDWIMENPVLHREKERAKREKARESENTIAAREVRGLMDTIVPEKISTSTFQRQAEHKRKSYESALASFQEEIAQVGKEMEPLIVDTGGLFLKKLTESDEEMNRLFLKVENDTNLEDYTIQALLELWDKVAGRLLLRKQEIKELDEALHSLEFSRTDKLKSVLKKYAEVIEKTSYLMRPEVYRLINEEAMVMNYALLGNRKALAQLFVNLMESTLQQELDSRHRWQGLVDTWKALKKEALLQSFSDLLPPSYSKTQLTEWHSSLNSLNKELDTYHVDCMMRIRLLYEKTWQECLMHVQNCKKQLLDWKAFTEEEAETLVNQFFFQMVGALQGKVEEDLELLDVRAGDCSTGELRNPSRLWQIRQSGRVHTSSSISRRWYNCGRHTRASCWCRSWSWRRGWSSTGRSTAWRARCRRPTSIGSWTN

SEQ ID NO: 9492 - protein, 903 aa, Artificial Sequence
  Description of Artificial Sequence: Synthetic coding sequence
MRGGENRPPARVQSSSEELELRHQSLDAFPGRRLPGRGIQPAAKMSSVGKVTQVPNGKAYQQIFQAEVQLVHSLAATRKRAAERSVTLKSGRIPMMKKVETPEGEVMSPRQQKWMHSLPNDWIMENPVLHREKERAKREKARESENTIAAREVRGLMDTIVPEKISTSTFQRQAEHKRKSYESALASFQEEIAQEMEPLIVDTGGLFLKKLTESDEEMNRLFLKVENDTNLEDYTIQALLELWDKVAGRLLLRKQEIKELDEALHSLEFSRTDKLKSVLKKYAEVIEKTSYLMRPEVYRLINEEAMVMNYALLGNRKALAQLFVNLMESTLQQELDSRHRWQGLVDTWKALKKEALLQSFSEFMASESIHTPPAVTKELEVMLKTQNVLQQRRLKHLCTICDLLPPSYSKTQLTEWHSSLNSLNKELDTYHVDCMMRIRLLYEKTWQECLMHVQNCKKQLLDWKAFTEEEAETLVNQFFFQMVGALQGKVEEDLELLDKSFETLADQTEWQSSHLFKYFQEVVQLWEAHQSELLVQELELEKRMEQHRQKHSLESQVQEAHLDRLLDQLRQQSDKETLAFHLEKVKDYLKNMKSRYECFHTLLTKEVMEYPAIMLKELNSYSSALSQYFFVREIFEQNLAGEVIFKFRQPEAHEKPSQKRVKKLRKKQGSKEDMTRSEESISSGTSTARSVEEVEEENDQEMESFITEEVLGQQKKSPLHAKMDESKEGSIQGLEEMQVEREGSLNPSLNEENVKGQGEKKEESEEEDEKEEEEEEEKLEEEKEEKEAQEEQESLSVGEEEDKEEGLEEIYYEDMESFTISSGNTYFVFVPLEEEHCRKSHSTFSAMFINDTSSAKFIEQVTIPSRLILEIKKHRAWWCVPVIPATQEAEAGESPEPRRRRLQ

SEQ ID NO: 9493 - protein, 1701 aa, Artificial Sequence; identical to SEQ ID NO: 9489
  Description of Artificial Sequence: Synthetic coding sequence

SEQ ID NO: 9494 - protein, 899 aa, Artificial Sequence
  Description of Artificial Sequence: Synthetic coding sequence
GRPAAVVAGPALAALRESLRICAMRGGENRPPARVQSSSEELELRHQSLDAFPGRRLPGRGIQPAAKMSSVGKVTQVPNGKAYQQIFQAEVQLVHSLAATRKRAAERSVTLKSGRIPMMKKVETPEGEVMSPRQQKWMHSLPNDWIMENPVLHREKERAKREKARESENTIAAREVRGLMDTIVPEKISTSTFQRQAEHKRKSYESALASFQEEIAQVGKEMEPLIVDTGGLFLKKLTESDEEMNRLFLKVENDTNLEDYTIQALLELWDKVAGRLLLRKQEIKELDEALHSLEFSRTDKLKSVLKKYAEVIEKTSYLMRPEVYRLINEEAMVMNYALLGNRKALAQLFVNLMESTLQQELDSRHRWQGLVDTWKALKKEALLQSFSEFMASESIHTPPAVTKELEVMLKTQNVLQQRRLKHLCTICDLLPPSYSKTQLTEWHSSLNSLNKELDTYHVDCMMRIRLLYEKTWQECLMHVQNCKKQLLDWKAFTEEEAETLVNQFFFQMVGALQGKVEEDLELLDKSFETLADQTEWQSSHLFKYFQEVVQLWEAHQSELLVQELELEKRMEQHRQKHSLESQVQEAHLDRLLDQLRQQSDKETLAFHLEKVKDYLKNMKSRYECFHTLLTKEVMEYPAIMLKELNSYSSALSQYFFVREIFEQNLAGEVIFKFRQPEAHEKPSQKRVKKLRKKQGSKEDMTRSEESISSGTSTARSVEEVEEENDQEMESFITEEVLGQQKKSPLHAKMDESKEGSIQGLEEMQVEREGSLNPSLNEENVKGQGEKKEESEEEDEKEEEEEEEKLEEEKEEKEAQEEQESLSVGEEEDKEEGLEEIYYEDMESFTISSGNTYFVFVPLEEEHCRKSHSTFSAMFINDTSSAKFIEQVTIPSRLILEIKK

SEQ ID NO: 9495 - protein, 194 aa, Artificial Sequence
  Description of Artificial Sequence: Synthetic coding sequence
MAKRRAAEPVTFHVPWKRLLLCDFAEQPPPPPLWIRPPGVAHAGQLLGVPEQHRKRKIDAGTMAEPSASPSKRRDSGDNSAPSGQEREDHGLETGDPPLPPPPVLPGPGEELPGARLPGGGGDDGAGRAGPPRGDWGVASRQHNEEFWQYNTFQYWRNPLPPIDLADIEDLSEDTLTEATLQGRNEGAEVDMES

SEQ ID NO: 9496 - protein, 147 aa, Artificial Sequence
  Description of Artificial Sequence: Synthetic coding sequence
MGFIFSKSMNESMKNQKEFMLMNARLQLERQLIMQSEMRERQMAMQIAWSREFLKYFGTFFGLAAISLTAGAIKKKKPAFLVPIVPLSFILTYQYDLGYGTLLERMKGEAEDILETEKSKLQLPRGMITFESIEKARKEQSRFFIDK

SEQ ID NO: 9497 - protein, 161 aa, Artificial Sequence
  Description of Artificial Sequence: Synthetic coding sequence
MKKIEISGTCLSFHLLFGLEIRMRRIVFAGVILFRLLGVILFRLLGVILFGRLGDLGTCQTKPGQYWKEEVHIQDVGGLICRACNLSLPFHGCLLDLGTCQAEPGQYCKEEVHIQGGIQWYSVKGCTKNTSECFKSTLVKRILQLHELVTTHCCNHSLCNF

SEQ ID NO: 9498 - protein, 127 aa, Artificial Sequence
  Description of Artificial Sequence: Synthetic coding sequence
MGVGFTELEYLAPWLRPPFSDLGTCQTKPGQYWKEEVHIQDVGGLICRACNLSLPFHGCLLDLGTCQAEPGQYCKEEVHIQGGIQWYSVKGCTKNTSECFKSTLVKRILQLHELVTTHCCNHSLCNF

SEQ ID NO: 9499 - protein, 170 aa, Artificial Sequence
  Description of Artificial Sequence: Synthetic coding sequence
MQNRTGLILCALALLMGFLMVCLGAFFISWGSIFDCQGSLIAAYLLLPLGFVILLSGIFWSNYRQVTESKGVLRHMLRQHLAHGALPVATVDRPDFYPPAYEESLEVEKQSCPAEREASGIPPPLYTETGLEFQDGNDSHPEAPPSYRESIAGLVVTAISEDAQRRGQEC

SEQ ID NO: 9500 - protein, 1445 aa, Artificial Sequence
  Description of Artificial Sequence: Synthetic coding sequence
MGNLVIPLGKGRAGRVESGQRIPPPAPRPSVECTGDDIALQMEKMLFPLKSPSATWLSPSSTPWMMDFILTSVCGLVLLFLLLLYVHSDPPSPPPGRKRSSREPQRERSGRSRSRKISALKACRILLRELEETRDLNYLLESHLRKLAGEGSSHLPLGGDPLGDVCKPVPAKAHQPHGKCMQDPSPASLSPPAPPAPLASTLSPGPMTFSEPFGPHSTLSASGPPEPLLPLKCPATQPHVVFPPSPQPHGPLASSPPPPDSSLAGLQCGSTTCPVPQSSPLHNQVLPPPTRVISGLGCSSDPIWDLYCWREAATTWGLSTYSHGKSQPRHLPDHTSEASFWGDPTPKHMEVGGCTFIHPDVQKLLETLIAKRALMKMWQEKERKRADHPHMTSLGKEWDITTLNPFWNVSTQPQQLPRPQQVSDATTVGNHLQQKRSQLFWDLPSLNSESLATTVWVSRNPSSQNAHSVPLDKASTSLPGEPEVEASSQLSQAPPQPHHMAQPQHFTPAWPQSQPPPLAEIQTQAHLSPPVPSLGCSSPPQIRGCGASYPTSQERTQSVIPTGKEYLEWPLKKRPKWKRVLPSLLKKSQAVLSQPTAHLPQERPASWSPKSAPILPGVVTSPELPEHWWQGRNAIHQEQSCGPPSRLQASGDLLQPDGEFPGRPQSQAEDTQQALLPSQPSDFAGKGRKDVQKTGFRSSGRFSDKGCLGSKLGPDPSRDQGSGRTSVKALDEDKEAEGDLRRSWKYQSVSSTPRDPDKEHLENKLQIHLARKVGEIKEGWIPMPVRRSWLMAKCAVPKSDTHRKPGKLASWRGGKAHVNTSQELSFLHPCTQQILEVHLVRFCVRHSWGTDLQSLEPINVWSGEAQAPPFPQSTFTPWASWVSRVESVPKVPIFLGKRPQNGPGDNRTTSKSVPTVSGPLAAPPPEQEGVQRPPRGSQSADTHGRSEAFPTGHKGRGCSQPPTCSLVGRTWQSRTVLESGKPKPRLEGSMGSEMAGNEAWLESESMSPGDPCSSRALQVLSIGSQWARAEDALQALKVGEKPPTWEVTLGASVRASSGSVQEDLRSTGALGTTGNPSASSVCVAQDPEQLHLKAQVVSEIALIVQVDSEEQLPGRAPGILLQDGATGLCLPGRHMDMLTAADRLPTQAPLSTSQSVSGKNMTASQGPCALLWKGGDSPGQQEPGSPKAKAPQKSQKTLGCADKGEAHRRPRTGEQGHRSKGPRTSEASGRSHPAQAREIGDKQERKYNQLQLEKGQTPPESHFQRKISHHPQGLHPRKGGTRWEDVLQKGKPGADAFQSWGSGPPRQFMDCMADKAWTISRVVGQILVDKLGLQWGRGPSEVNRHKGDFRAQENVPSCCHRGHCHQERSREMRALACSPKATPKGHHCPVKNRGIRDRDSSWAPPPREPVSPAGPHHHRPRMASTSGGPHPQLQELMSAQRCLAS

SEQ ID NO: 9501 - protein, 586 aa, Artificial Sequence
  Description of Artificial Sequence: Synthetic coding sequence
MEVGGCTFIHPDVQKLLETLIAKRALMKMWQEKERKRADHPHMTSLGKEWDITTLNPFWNVSTQPQQLPRPQQVSDATTVGNHLQQKRSQLFWDLPSLNSESLATTVWVSRNPSSQNAHSVPLDKASTSLPGEPEVEASSQLSQAPPQPHHMAQPQHFTPAWPQSQPPPLAEIQTQAHLSPPVPSLGCSSPPQIRGCGASYPTSQERTQSVIPTGKEYLEWPLKKRPKWKRVLPSLLKKSQAVLSQPTAHLPQERPASWSPKSAPILPGVVTSPELPEHWWQGRNAIHQEQSCGPPSRLQASGDLLQPDGEFPGRPQSQAEDTQQALLPSQPSDFAGKGRKDVQKTGFRSSGRFSDKGCLGSKLGPDPSRDQGSGRTSVKALDEDKEAEGDLRRSWKYQSVSSTPRDPDKEHLENKLQIHLARKVGEIKEGWIPMPVRRSWLMAKCAVPKSDTHRKPGKLASWRGGKAHVNTSQELSFLHPCTQQILEVHLVRFCVRHSWGTDLQSLEPINVWSGEAQAPPFPQSTFTPWASWVSRVESVPKVPIFLGKRPQNGPGDNRTTSKSVPTVSGPLAATGVTATKNVAER

SEQ ID NO: 9502 - protein, 342 aa, Artificial Sequence
  Description of Artificial Sequence: Synthetic coding sequence
MACEPQVDPGATGPLPPSSPGWSALPGGSPPGWGQELHNGQVLTVLRIDNTCAPISFDLGAAEEQLQTWGIQVPADQYRSLAESALLEPQVRRYIIYNSRPMRLAFAVVFYVVVWANIYSTSQMFALGNHWAGMLLVTLAAVSLTLTLVLVFERHQKKANTNTDLRLAAANGALLRHRVLLGVTDTVEGCQSVIQLWFVYFDLENCVQFLSDHVQEMKTSQESLLRSRLSQLCVVMETGVSPATAEGPENLEDAPLLPGNSCPNERPLMQTELHQLVPEAEPEEMARQLLAVFGGYYIRLLVTSQLPQAMGTRHTNSPRIPCPCQLIEAYILGTGCCPFLAR

SEQ ID NO: 9503 - protein, 343 aa, Artificial Sequence
  Description of Artificial Sequence: Synthetic coding sequence
MACEPQVDPGATGPLPPSSPGWSALPGGSPPGWGQELHNGQVLTVLRIDNTCAPISFDLGAAEEQLQTWGIQQVPADQYRSLAESALLEPQVRRYIIYNSRPMRLAFAVVFYVVVWANIYSTSQMFALGNHWAGMLLVTLAAVSLTLTLVLVFERHQKKANTNTDLRLAAANGALLRHRVLLGVTDTVEGCQSVIQLWFVYFDLENCVQFLSDHVQEMKTSQESLLRSRLSQLCVVMETGVSPATAEGPENLEDAPLLPGNSCPNERPLMQTELHQLVPEAEPEEMARQLLAVFGGYYIRLLVTSQLPQAMGTRHTNSPRIPCPCQLIEAYILGTGCCPFLAR

SEQ ID NO: 9504 - protein, 711 aa, Artificial Sequence
  Description of Artificial Sequence: Synthetic coding sequence
MARSRSRSPRWKHRSLSPVPRNAEHYKQRHSHGHYGCEYRKDPKRPVAWRMDSEKHGQSKPRIPSRGNIYYQSYEHRSPSPNIRNSLENVYMYKPHRGYSPGRGDSNRRAQYMPKYSEGIPYKEHERNSYPQKVQGGHSPDDHRVRGSGKGGKPPQRSIADSFRFEGKWHEDELRHQRIQEEKYSQSTRRGSEDFETRSSFQKRYPEDRDFRKYGHTSKRPKDVERYESREPARNPKWKPEHSLPPYQEDTDQWNLGPQTYRHAEREHPETSSATKVSYDYRHKRPKLLDGDQDFSDGRTQKYCKEEDRKYSFQKGPLNRELDCFNTGRGRETQDGQVKEPFKPSKKDSIACTYSNKNDVDLRSSNDKWKEKIKKEGDCRKESNSSSNQLDKSQKLPDVKPSPINLRKKSLTVKVDVKKTVDTFRVASSYSTERQMSHDLVAVGRKSENFHPVFEHLDSTQNTENKPTGEFAQEIITIIHQVKANYFPSPGITLHERFSTMQDIHKADVNEIPLNSDPEIHRRIDMSLAELQSKQAVIYESEQTLIKIIDPNDLRHDIERRRKERLQNEDEHIFHIASAAERDDQNSSFSKVKNVHTDGFQKPTHFIKSNFRKCIEKPYMNYTTQRKDIITHKPFEVEGNHRNTRVRPFKSNFRGGRCQPNYKSGLVQKSLYIQAKYQRLRFTGPRGFITHKFRERLMRKKKEYTDVATGI

SEQ ID NO: 9505 - protein, 502 aa, Artificial Sequence
  Description of Artificial Sequence: Synthetic coding sequence
MAIHLDKQNIILKNDKDEYLKKTRDGVLPPYQDAKPPSPASIKKTYTTSKFNDAEPAKGNLFIGVEVLPENLHLDESETSEEDHGSLEKEKYEQFLSLEEGTKAHYFFEKVVNAAQTWFSLFGWPEGPHSFSIPETIRRDVYKMQFYSSTSPPQKFSRQNDFSKYNKTIYDVLLHLSGKMPPGINSSQSLPVDNHEKRVIQLHLQHSSLLDFLNAQGGCISHVLPEFLLEPEDYKRWIEIMSSTNTMPVSSCTPKKKCSIVIEMSKFEAWSKRAWTDVFLQIYKVLVLSRVVPYCSNNMPPICVQNTPKVNPCFASSNIYSDSERILLSWMNINYENTRHVIWKNCHKDVIPSERWIVNFDKDLSDGLVFATQLGAYCPFLIESHFINMYTRPKSPEEYLHNCLIIVNTLYEIDFDVEIQVCLRVFPKEMDAGVSGLRKEDMPSVWVVTIRLAVAVARTKRQKKGDIQFACFFVCLFFFIFVVISFSLWSRMHFFLLLPLDI

SEQ ID NO: 9506 - protein, 502 aa, Artificial Sequence; identical to SEQ ID NO: 9505
  Description of Artificial Sequence: Synthetic coding sequence

SEQ ID NO: 9507 - protein, 156 aa, Artificial Sequence
  Description of Artificial Sequence: Synthetic coding sequence
MLLNYIPVCYKILHLTGEVKSPELLFDPPFIFFTPVPLDITTVMDINILPQNYFRNSTLCVQIPTVRLLDGEEIHPLSVKFPKGRVIPGSHSGINNKLTCHLSFKSSKPVSFFTNLLFCDDRKNWCFHFQLLQQQKTAFLLFTHIWQFIWISKTLF

SEQ ID NO: 9508 - protein, 153 aa, Artificial Sequence
  Description of Artificial Sequence: Synthetic coding sequence
MLLNYIPVCYKILHLTGEVKSPELLFDPPFIFFTPVPLDITTVMDINILPQNYFRNSTLCVQIPTVRLLDGEEIHPLSVKFPKGRVIPGSHSGINNKLTCHLSFKSSKPVSFFTNLLFCDDRKNWCFHFQLLQQQKTAFLLFTHIWQFIWISK

SEQ ID NO: 9509 - protein, 361 aa, Artificial Sequence
  Description of Artificial Sequence: Synthetic coding sequence
MNLVICVLLLSIWKNNCMTTNQTNGSSTTGDKPVESMQTKLNYLRRNLLILVGIIIMVFVFICFCYLHYNCLSDDASKAGMVKKKGIAAKSSKTSFSEAKTASQCSPETQPMLSTADKSSDSSSPERASAQSSTEKLIRPSSLQKPSIPNSAGKLTRPSYPKRSSKSSCSKKLSKSSHLEKAHKKGSLEKLCKLDYACKLASSDKPVRPPQLFKPLYSSHPQNEISPSKPFGPQELAKPPKHFNPKRSVSLGRAALLSNSELAETCQPYKKKHLVAKTYRPLVNDISEAKEKNTQNLHVSSKVKSSSRSFRKLDSRNNAYGDHVNDSDTMKYYSEVDSDKVIIITCDRGYNQVTSEVTLND

SEQ ID NO: 9510 - protein, 99 aa, Artificial Sequence
  Description of Artificial Sequence: Synthetic coding sequence
MEPQKLLIIGFLLCSLTCLLLETVASSPLPLSALGIQEKTGSKPRSGGNHRSWLNNFRDYLWQLIKSALPPAAIVAFLLTSALMGILCCFTILVVDPVH

SEQ ID NO: 9511 - protein, 2017 aa, Artificial Sequence
  Description of Artificial Sequence: Synthetic coding sequence
MSLGLARAQEVELTLETVIQTLESSVLCQEKGLGARDLAQDAQITSLPALIREIVTRNLSQPESPVLLPATEMASLLSLQEENQLLQQELSRVEDLLAQSRAERDELAIKYNAVSERLEQALRLEPGELETQEPRGLVRQSVELRRQLQEEQASYRRKLQAYQEGQQRQAQLVQRLQGKILQYKKRCSELEQQLLERSGELEQQRLRDTEHSQDLESALIRLEEEQQRSASLAQVNAMLREQLDQAGSANQALSEDIRKVTNDWTRCRKELEHREAAWRREEESFNAYFSNEHSRLLLLWRQVVGFRRLVSEVKMFTERDLLQLGGELARTSRAVQEAGLGLSTGLRLAESRAEAALEKQALLQAQLEEQLRDKVLREKDLAQQQMQSDLDKADLSARVTELGLAVKRLEKQNLEKDQVNKDLTEKLEALESLRLQEQAALETEDGEGLQQTLRDLAQAVLSDSESGVQLSGSERTADASNGSLRGLSGQRTPSPPRRSSPGRGRSPRRGPSPACSDSSTLALIHSALHKRQLQVQDMRGRYEASQDLLGTLRKQLSDSESERRALEEQLQRLRDKTDGAMQAHEDAQREVQRLRSANELLSREKSNLAHSLQVAQQQAEELRQEREKLQAAQEELRRQRDRLEEEQEDAVQDGARVRRELERSHRQLEQLEGKRSVLAKELVEVREALSRATLQRDMLQAEKAEVAEALTKAEAGRVELELSMTKLRAEEASLQDSLSKLSALNESLAQDKLDLNRLVAQLEEEKSALQGRQRQAEQEATVAREEQERLEELRLEQEVARQGLEGSLRVAEQAQEALEQQLPTLRHERSQLQEQLAQLSRQLSGREQELEQARREAQRQVEALERAAREKEALAKEHAGLAVQLVAAEREGRTLSEEATRLRLEKEALEGSLFEVQRQLAQLEARREQLEAEGQALLLAKETLTGELAGLRQQIIATQEKASLDKELMAQKLVQAEREAQASLREQRAAHEEDLQRLQREKEAAWRELEAERAQLQSQLQREQEELLARLEAEKEELSEEIAALQQERDEGLLLAESEKQQALSLKESEKTALSEKLMGTRHSLATISLEMERQKRDAQSRQEQDRSTVNALTSELRDLRAQREEAAAAHAQEVRRLQEQARDLGKQRDSCLREAEELRTQLRLLEDARDGLRRELLEAQRKLRESQEGREVQRQEAGELRRSLGEGAKEREALRRSNEELRSAVKKAESERISLKLANEDKEQKLALLEEARTAVGKEAGELRTGLQEVERSRLEARRELQELRRQMKMLDSENTRLGRELAELQGRLALGERAEKESRRETLGLRQRLLKGEASLEVMRQELQVAQRKLQEQEGEFRTRERRLLGSLEEARGTEKQQLDHARGLELKLEAARAEAAELGLRLSAAEGRAQGLEAELARVEVQRRAAEAQLGGLRSALRRGLGLGRAPSPAPRPVPGSPARDAPAEGSGEGLNSPSTLECSPGSQPPSPGPATSPASPDLDPEAVRGALREFLQELRSAQRERDELRTQTSALNRQLAEMEAERDSATSRARQLQKAVAESEEARRSVDGRLSGVQAELALQEESVRRSERERRATLDQVATLERSLQATESELRASQEKISKMKANETKLEGDKRRLKEVLDASESRTVKLELQRRSLEGELQRSRLGLSDREAQAQALQDRVDSLQRQVADSEVKAGTLQLTVERLNGALAKVEESEGALRDKVRGLTEALAQSSASLNSTRDKNLHLQKALTACEHDRQVLQERLDAARQALSEARKQSSSLGEQVQTLRGEVADLELQRVEAEGQLQQLREVLRQRQEGEAAALNTVQKLQDERRLLQERLGSLQRALAQLEAEKREVERSALRLEKDRVALRRTLDKVEREKLRSHEDTVRLSAEKGRLDRTLTGAELELAEAQRQIQQLEAQVVVLEQSHSPAQLEVDAQQQQLELQQEVERLRSAQAQTERTLEARERAHRQRVRGLEEQVSTLKGQLQQELRRSSAPFSPPSGPPEK

SEQ ID NO: 9512 - protein, 1898 aa, Artificial Sequence
  Description of Artificial Sequence: Synthetic coding sequence
EKGLGARDLAQDAQITSLPALIREIVTRNLSQPESPVLLPATEMASLLSLQEENQLLQQELSRVEDLLAQSRAERDELAIKYNAVSERDTEHSQDLESALIRLEEEQQRSASLAQVNAMLREQLDQAGSANQALSEDIRKVTNDWTRCRKELEHREAAWRREEESFNAYFSNEHSRLLLLWRQVVGFRRLVSEVKMFTERDLLQLGGELARTSRAVQEAGLGLSTGLRLAESRAEAALEKQALLQAQLEEQLRDKVLREKDLAQQQMQSDLDKADLSARVTELGLAVKRLEKQNLEKDQVNKDLTEKLEALESLRLQEQAALETEDGEGLQQTLRDLAQAVLSDSESGVQLSGSERTADASNGSLRGLSGQRTPSPPRRSSPGRGRSPRRGPSPACSDSSTLALIHSALHKRQLQVQDMRGRYEASQDLLGTLRKQLSDSESERRALEEQLQRLRDKTDGAMQAHEDAQREVQRLRSANELLSREKSNLAHSLQVAQQQAEELRQEREKLQAAQEELRRQRDRLEEEQEDAVQDGARVRRELERSHRQLEQLEGKRSVLAKELVEVREALSRATLQRDMLQAEKAEVAEALTKAEAGRVELELSMTKLRAEEASLQDSLSKLSALNESLAQDKLDLNRLVAQLEEEKSALQGRQRQAEQEATVAREEQERLEELRLEQEVARQGLEGSLRVAEQAQEALEQQLPTLRHERSQLQEQLAQLSRQLSGREQELEQARREAQRQVEALERAAREKEALAKEHAGLAVQLVAAEREGRTLSEEATRLRLEKEALEGSLFEVQRQLAQLEARREQLEAEGQALLLAKETLTGELAGLRQQIIATQEKASLDKELMAQKLVQAEREAQASLREQRAAHEEDLQRLQREKEAAWRELEAERAQLQSQLQREQEELLARLEAEKEELSEEIAALQQERDEGLLLAESEKQQALSLKESEKTALSEKLMGTRHSLATISLEMERQKRDAQSRQEQDRSTVNALTSELRDLRAQREEAAAAHAQEVRRLQEQARDLGKQRDSCLREAEELRTQLRLLEDARDGLRRELLEAQRKLRESQEGREVQRQEAGELRRSLGEGAKEREALRRSNEELRSAVKKAESERISLKLANEDKEQKLALLEEARTAVGKEAGELRTGLQEVERSRLEARRELQELRRQMKMLDSENTRLGRELAELQGRLALGERAEKESRRETLGLRQRLLKGEASLEVMRQELQVAQRKLQEQEGEFRTRERRLLGSLEEARGTEKQQLDHARGLELKLEAARAEAAELGLRLSAAEGRAQGLEAELARVEVQRRAAEAQLGGLRSALRRGLGLGRAPSPAPRPVPGSPARDAPAEGSGEGLNSPSTLECSPGSQPPSPGPATSPASPDLDPEAVRGALREFLQELRSAQRERDELRTQTSALNRQLAEMEAERDSATSRARQLQKAVAESEEARRSVDGRLSGVQAELALQEESVRRSERERRATLDQVATLERSLQATESELRASQEKISKMKANETKLEGDKRRLKEVLDASESRTVKLELQRRSLEGELQRSRLGLSDREAQAQALQDRVDSLQRQVADSEVKAGTLQLTVERLNGALAKVEESEGALRDKVRGLTEALAQSSASLNSTRDKNLHLQKALTACEHDRQVLQERLDAARQALSEARKQSSSLGEQVQTLRGEVADLELQRVEAEGQLQQLREVLRQRQEGEAAALNTVQKLQDERRLLQERLGSLQRALAQLEAEKREVERSALRLEKDRVALRRTLDKVEREKLRSHEDTVRLSAEKGRLDRTLTGAELELAEAQRQIQQLEAQVVVLEQSHSPAQLEVDAQQQQLELQQEVERLRSAQAQTERTLEARERAHRQRVRGLEEQVSTLKGQLQQELRRSSAPFSPPSGPPEK

SEQ ID NO: 9513 - protein, 1203 aa, Artificial Sequence
  Description of Artificial Sequence: Synthetic coding sequence
MEQAPNMAEPRGPVDHGVQIRFITEPVSGAEMGTLRRGGRRPAKDARASTYGVAVRVQGIAGQPFVVLNSGEKGGDSFGVQIKGANDQGASGALSSDLELPENPYSQVKGFPAPSQSSTSDEEPGAYWNGKLLRSHSQASLAGPGPVDPSNRSNSMLELAPKVASPGSTIDTAPLSSVDSLINKFDSQLGGQARGRTGRRTRMLPPEQRKRSKSLDSRLPRDTFEERERQSTNHWTSSTKYDNHVGTSKQPAQSQNLSPLSGFSRSRQTQDWVLQSFEEPRRSAQDPTMLQFKSTPDLLRDQQEAAPPGSVDHMKATIYGILREGSSESETSVRRKVSLVLEKMQPLVMVSSGSTKAVAGQGELTRKVEELQRKLDEEVKKRQKLEPSQVGLERQLEEKTEECSRLQELLERRKGEAQQSNKELQNMKRLLDQGEDLRHGLETQVMELQNKLKHVQGPEPAKEVLLKDLLETRELLEEVLEGKQRVEEQLRLRERELTALKGALKEEVASRDQEVEHVRQQYQRDTEQLRRSMQDATQDHAVLEAERQKMSALVRGLQRELEETSEETGHWQSMFQKNKEDLRATKQELLQLRMEKEEMEEELGEKIEVLQRELEQARASAGDTRQVEVLKKELLRTQEELKELQAERQSQEVAGRHRDRELEKQLAVLRVEADRGRELEEQNLQLQKTLQQLRQDCEEASKAKMVAEAEATVLGQRRAAVETTLRETQEENDEFRRRILGLEQQLKETRGLVDGGEAVEARLRDKLQRLEAEKQQLEEALNASQEEEGSLAAAKRALEARLEEAQRGLARLGQEQQTLNRALEEEGKQREVLRRGKAELEEQKRLLDRTVDRLNKELEKIGEDSKQALQQLQAQLEDYKEKARREVADAQRQAKDWASEAEKTSGGLSRLQDEIQRLRQALQASQAERDTARLDKELLAQRLQGLEQEAENKKRSQDDRARQLKGLEEKVSRLETELDEEKNTVELLTDRVNRGRDQVDQLRTELMQERSARQDLECDKISLERQNKDLKTRLASSEGFQKPSASLSQLESQNQLLQERLQAEEREKTVLQSTNRKLERKVKELSIQIEDERQHVNDQKDQLSLRVKALKRQVDEAEEEIERLDGLRKKAQREVEEQHEVNEQLQARIKSLEKDSWRKASRSAAESALKNEGLSSDEEFDSVYDPSSIASLLTESNLQTSSC

SEQ ID NO: 9514 - protein, 291 aa, Artificial Sequence
  Description of Artificial Sequence: Synthetic coding sequence
MEQAPNMAEPRGPVDHGVQIRFITEPVSGAEMGTLRRGGRRPAKDARASTYGVAVRVQGIAGQPFVVLNSGEKGGDSFGVQIKGANDQGASGALSSDLELPENPYSQVKGFPAPSQSSTSDEEPGAYWNGKLLRSHSQASLAGPGPVDPSNRSNSMLELAPKVASPGSTIDTAPLSSVDSLINKFDSQLGGQARGRTGRRTRMLPPEQRKRSKSLDSRLPRDTFEERERQSTNHWTSSTKYDNHVGTSKQPAQSQNLSPLSGFSRSRQTQDWVLQSFEEPRRSAQDPTMLQ

SEQ ID NO: 9515 - protein, 170 aa, Artificial Sequence
  Description of Artificial Sequence: Synthetic coding sequence
MEQAPNMAEPRGPVDHGVQIRFITEPVSGAEMGTLRRGGRRPAKDARASTYGVAVRVQGIAGQPFVVLNSGEKGGDSFGVQIKGANDQGASGALSSDLELPENPYSQVKGFPAPSQSSTSDEEPGAYWNGKLLRSHSQASLAGPGPVDPSNRSNSMLELAPKVASPGSTI

SEQ ID NO: 9516 - protein, 170 aa, Artificial Sequence; identical to SEQ ID NO: 9515
  Description of Artificial Sequence: Synthetic coding sequence

SEQ ID NO: 9517 - protein, 232 aa, Artificial Sequence
  Description of Artificial Sequence: Synthetic coding sequence
MPGWFKKAWYGLASLLSFSSFILIIVALVVPHWLSGKILCQTGVDLVNATDRELVKFIGDIYYGLFRGCKVRQCGLGGRQSQFTIFPHLVKELNAGLHVMILLLLFLALALALVSMGFAILNMIQVPYRAVSGPGGICLWNVLAGGVVALAIASFVAAVKFHDLTERIANFQEKLFQFVVVEEQYEESFWICVASASAHAANLVVVAISQIPLPEIKTKIEEATVTAEDILY

SEQ ID NO: 9518 - protein, 226 aa, Artificial Sequence
  Description of Artificial Sequence: Synthetic coding sequence
MPTTKKTLMFLSSFFTSLGSFIVICSILGTQAWITSTIAVRDSASNGSIFITYGLFRGESSEELSHGLAEPKKKFAVLEILNNSSQKTLHSVTILFLVLSLITSLLSSGFTFYNSISNPYQTFLGPTGVYTWNGLGASFVFVTMILFVANTQSNQLSEELFQMLYPATTSKGTTHSYGYSFWLILLVILLNIVTVTIIIFYQKARYQRKQEQRKPMEYAPRDGILF

SEQ ID NO: 9519 - protein, 228 aa, Artificial Sequence
  Description of Artificial Sequence: Synthetic coding sequence
MASTASEIIAFMVSISGWVLVSSTLPTDYWKVSTIDGTVITTATYWANLWKACVTDSTGVSNCKDFPSMLALDGYIQACRGLMIAAVSLGFFGSIFALFGMKCTKVGGSDKAKAKIACLAGIVFILSGLCSMTGCSLYANKITTEFFDPLFVEQKYELGAALFIGWAGASLCIIGGVIFCFSISDNNKTPRYTYNGATSVMSSRTKYHGGEDFKTTNPSKQFDKNAYV

SEQ ID NO: 9520 - protein, 73 aa, Artificial Sequence
  Description of Artificial Sequence: Synthetic coding sequence
MIAAVSLGFFGSIFALFGMKCTKVGGSDKAKAKIACLAGIVFILSGLCSMTGCSLYANKITTEFFDPLFVEQK

SEQ ID NO: 9521 - protein, 226 aa, Artificial Sequence
  Description of Artificial Sequence: Synthetic coding sequence
MSRAQIWALVSGVGGFGALVAATTSNEWKVTTRASSVITATWVYQGLWMNCAGNALGSFHCRPHFTIFKVAGYIQACRGLMIAAVSLGFFGSIFALFGMKCTKVGGSDKAKAKIACLAGIVFILSGLCSMTGCSLYANKITTEFFDPLFVEQKYELGAALFIGWAGASLCIIGGVIFCFSISDNNKTPRYTYNGATSVMSSRTKYHGGEDFKTTNPSKQFDKNAYV

SEQ ID NO: 9522 - protein, 244 aa, Artificial Sequence
  Description of Artificial Sequence: Synthetic coding sequence
MGCRDVHAATVLSFLCGIASVAGLFAGTLLPNWRKLRLITFNRNEKNLTVYTGLWVKCARYDGSSDCLMYDTTWYSSVDQLDLRVLQFALPLSMLIAMGALLLCLIGMCNTAFRSSVPNIKLAKCLVNSAGCHLVAGLLFFLAGTVSLSPSIWVIFYNIHLNKKFEPVFSFDYAVYVTIASAGGLFMTSLILFIWYCTCKSLPSPFWQPLYSHPPSMHTYSQPYSARSRLSAIEIDIPVVSHTT

SEQ ID NO: 9523 - protein, 187 aa, Artificial Sequence
  Description of Artificial Sequence: Synthetic coding sequence
MGCRDVHAATVLSFLCGIASVAGLFAGTLLPNWRKLRLITFNRNEKNLTVYTGLWVKCARYDGSSDCLMYDTTWYSSVDQLDLRVLQFALPLSMLIAMGALLLCLIGMCNTAFRSSVPNIKLAKCLVNSAGCHLVAGLLFFLAGTVSLSPSIWVIFYNIHLNKKFEPVFSFDYAVYVTIASAGGLFM

SEQ ID NO: 9524 - protein, 244 aa, Artificial Sequence; identical to SEQ ID NO: 9522
  Description of Artificial Sequence: Synthetic coding sequence

SEQ ID NO: 9525 - protein, 175 aa, Artificial Sequence
  Description of Artificial Sequence: Synthetic coding sequence
MGCRDVHAATVLSFLCGIASVAGLFAGTLLPNWRKLRLITFNRNEKNLTVYTGLWVKCARYDGSSDCLMYDTTWYSSVDQLDLRVLQFALPLSMLIAMGALLLCLIGMCNTAFRSSVPNIKLAKCLVNSAGCHLVAGLLFFLAGTVSLSPSIWVIFYNIHLNKKFEPVFSFDYAV

SEQ ID NO: 9526 - protein, 175 aa, Artificial Sequence; identical to SEQ ID NO: 9525
  Description of Artificial Sequence: Synthetic coding sequence

SEQ ID NO: 9527 - protein, 126 aa, Artificial Sequence
  Description of Artificial Sequence: Synthetic coding sequence
MGCRDVHAATVLSFLCGIASVAGLFAGTLLPNWRKLRLITFNRNEKNLTVYTGLWVKCARYDGSSDCLMYDTTWYSSVDQLDLRVLQFALPLSMLIAMGALLLCLIGMCNTAFRSSVPNIKLAKCL

SEQ ID NO: 9528 - protein, 244 aa, Artificial Sequence; identical to SEQ ID NO: 9522
  Description of Artificial Sequence: Synthetic coding sequence

SEQ ID NO: 9529 - protein, 244 aa, Artificial Sequence; identical to SEQ ID NO: 9522
  Description of Artificial Sequence: Synthetic coding sequence

SEQ ID NO: 9530 - protein, 228 aa, Artificial Sequence
  Description of Artificial Sequence: Synthetic coding sequence
MSMAVETFGFFMATVGLLMLGVTLPNSYWRVSTVHGNVITTNTIFENLWFSCATDSLGVYNCWEFPSMLALSGYIQACRALMITAILLGFLGLLLGIAGLRCTNIGGLELSRKAKLAATAGALHILAGICGMVAISWYAFNITRDFFDPLYPGTKYELGPALYLGWSASLISILGGLCLCSACCCGSDEDPAASARRPYQAPVSVMPVATSDQEGDSSFGKYGRNAYV

SEQ ID NO: 9531 - protein, 228 aa, Artificial Sequence; identical to SEQ ID NO: 9530
  Description of Artificial Sequence: Synthetic coding sequence

SEQ ID NO: 9532 - protein, 224 aa, Artificial Sequence
  Description of Artificial Sequence: Synthetic coding sequence
MAFYPLQIAGLVLGFLGMVGTLATTLLPQWRVSAFVGSNIIVFERLWEGLWMNCIRQARVRLQCKFYSSLLALPPALETARALMCVAVALSLIALLIGICGMKQVQCTGSNERAKAYLLGTSGVLFILTGIFVLIPVSWTANIIIRDFYNPAIHIGQKRELGAALFLGWASAAVLFIGGGLLCGFCCCNRKKQGYRYPVPGYRVPHTDKRRNTTMLSKTSTSYV

SEQ ID NO: 9533 - protein, 230 aa, Artificial Sequence
  Description of Artificial Sequence: Synthetic coding sequence
MASLGLQLVGYILGLLGLLGTLVAMLLPSWKTSSYVGASIVTAVGFSKGLWMECATHSTGITQCDIYSTLLGLPADIQAAQAMMVTSSAISSLACIISVVGMRCTVFCQESRAKDRVAVAGGVFFILGGLLGFIPVAWNLHGILRDFYSPLVPDSMKFEIGEALYLGIISSLFSLIAGIILCFSCSSQRNRSNYYDAYQAQPLATRSSPRPGQPPKVKSEFNSYSLTGYV

SEQ ID NO: 9534 - protein, 230 aa, Artificial Sequence; identical to SEQ ID NO: 9533
  Description of Artificial Sequence: Synthetic coding sequence

SEQ ID NO: 9535 - protein, 230 aa, Artificial Sequence; identical to SEQ ID NO: 9533
  Description of Artificial Sequence: Synthetic coding sequence

SEQ ID NO: 9536 - protein, 219 aa, Artificial Sequence
  Description of Artificial Sequence: Synthetic coding sequence
MASAGLQLLAFILALSGVSGVLTATLLPNWKVNVDVDSNIITAIVQLHGLWMDCTWYSTGMFSCALKHSILSLPIHVQAARATMVLACVLSALGICTSTVGMKCTRLGGDRETKSHASFAGGVCFMSAGISSLISTVWYTKEIIANFLDLTVPESNKHEPGGAIYIGFISAMLLFISGMIFCTSCIKRNPEARLDPPTQQPISNTQLENNSTHNLKDYV

SEQ ID NO: 9537 - protein, 220 aa, Artificial Sequence
  Description of Artificial Sequence: Synthetic coding sequence
MALVFRTVAQLAGVSLSLLGWVLSCLTNYLPHWKNLNLDLNEMENWTMGLWQTCVIQEEVGMQCKDFDSFLALPAELRVSRILMFLSNGLGFLGLLVSGFGLDCLRIGESQRDLKRRLLILGGILSWASGVTALVPVSWVAHKTVQEFWDENVPDFVPRWEFGEALFLGWFAGLSLLLGGCLLHCAACSSHAPLASGHYAVAQTQDHHQELETRNTNLKH

SEQ ID NO: 9538 - protein, 292 aa, Artificial Sequence
  Description of Artificial Sequence: Synthetic coding sequence
MRTPVVMTLGMVLAPCGLLLNLTGTLAPGWRLVKGFLNQPVDVELYQGLWDMCREQSSRERECGQTDQWGYFEAQPVLVARALMVTSLAATVLGLLLASLGVRCWQDEPNFVLAGLSGVVLFVAGLLGLIPVSWYNHFLGDRDVLPAPASPVTVQVSYSLVLGYLGSCLLLLGGFSLALSFAPWCDERCRRRRKGPSAGPRRSSVSTIQVEWPEPDLAPAIKYYSDGQHRPPPAQHRKPKPKPKVGFPMPRPRPKAYTNSVDVLDGEGWESQDAPSCSTHPCDSSLPCDSDL

SEQ ID NO: 9539 - protein, 229 aa, Artificial Sequence
  Description of Artificial Sequence: Synthetic coding sequence
MAWSFRAKVQLGGLLLSLLGWVCSCVTTILPQWKTLNLELNEMETWIMGIWEVCVDREEVATVCKAFESFLSLPQELQVARILMVASHGLGLLGLLLCSFGSECFQFHRIRWVFKRRLGLLGRTLEASASATTLLPVSWVAHATIQDFWDDSIPDIIPRWEFGGALYLGWAAGIFLALGGLLLIFSACLGKEDVPFPLMAGPTVPLSCAPVEESDGSFHLMLRPRNLVI

SEQ ID NO: 9540 - protein, 220 aa, Artificial Sequence
  Description of Artificial Sequence: Synthetic coding sequence
MASAGMQILGVVLTLLGWVNGLVSCALPMWKVTAFIGNSIVVAQVVWEGLWMSCVVQSTGQMQCKVYDSLLALPQDLQAARALCVIALLVALFGLLVYLAGAKCTTCVEEKDSKARLVLTSGIVFVISGVLTLIPVCWTAHAIIRDFYNPLVAEAQKRELGASLYLGWAASGLLLLGGGLLCCTCPSGGSQGPSHYMARYSTSAPAISRGPSEYPTKNYV

SEQ ID NO: 9541 - protein, 220 aa, Artificial Sequence; identical to SEQ ID NO: 9540
  Description of Artificial Sequence: Synthetic coding sequence

SEQ ID NO: 9542 - protein, 211 aa, Artificial Sequence
  Description of Artificial Sequence: Synthetic coding sequence
MANSGLQLLGFSMALLGWVGLVACTAIPQWQMSSYAGDNIITAQAMYKGLWMDCVTQSTGMMSCKMYDSVLALSAALQATRALMVVSLVLGFLAMFVATMGMKCTRCGGDDKVKKARIAMGGGIIFIVAGLAALVACSWYGHQIVTDFYNPLIPTNIKYEFGPAIFIGWAGSALVILGGALLSCSCPGNESKAGYRVPRSYPKSNSSKEYV

SEQ ID NO: 9543 - protein, 211 aa, Artificial Sequence; identical to SEQ ID NO: 9542
  Description of Artificial Sequence: Synthetic coding sequence

SEQ ID NO: 9544 - protein, 145 aa, Artificial Sequence
  Description of Artificial Sequence: Synthetic coding sequence
MANSGLQLLGFSMALLGWVGLVACTAIPQWQMSSYAGDNIITAQAMYKGLWMDCVTQSTGMMSCKMYDSVLALSAALQATRALMVVSLVLGFLAMFVATMGMKCTRCGGDDKVKKARIAMGGGIIFIVAGMSLALPSLLAGQGLP

SEQ ID NO: 9545 - protein, 225 aa, Artificial Sequence
  Description of Artificial Sequence: Synthetic coding sequence
MATHALEIAGLFLGGVGMVGTVAVTVMPQWRVSAFIENNIVVFENFWEGLWMNCVRQANIRMQCKIYDSLLALSPDLQAARGLMCAASVMSFLAFMMAILGMKCTRCTGDNEKVKAHILLTAGIIFIITGMVVLIPVSWVANAIIRDFYNSIVNVAQKRELGEALYLGWTTALVLIVGGALFCCVFCCNEKSSSYRYSIPSHRTTQKSYHTGKKSPSVYSRSQYV

SEQ ID NO: 9546 - protein, 225 aa, Artificial Sequence; identical to SEQ ID NO: 9545
  Description of Artificial Sequence: Synthetic coding sequence

SEQ ID NO: 9547 - protein, 233 aa, Artificial Sequence
  Description of Artificial Sequence: Synthetic coding sequence
MATHALEIAGLFLGGVGMVGTVAVTVMPQWRVSAFIENNIVVFENFWEGLWMNCVRQANIRMQCKIYDSLLALSPDLQAARGLMCAASVMSFLAFMMAILGMKCTRCTGDNEKVKAHILLTAGIIFIITGMVVLIPVSWVANAIIRDFYNSIVNVAQKRELGEALYLGWTTALVLIVGGALFCCVFCCNEKSSSYRYSIPSHRTTQKSYHTGKKSRLLQKSVCVVVYVFLTLL

SEQ ID NO: 9548 - protein, 217 aa, Artificial Sequence
  Description of Artificial Sequence: Synthetic coding sequence
MASTGLELLGMTLAVLGWLGTLVSCALPLWKVTAFIGNSIVVAQVVWEGLWMSCVVQSTGQMQCKVYDSLLALPQDLQAARALCVIALLLALLGLLVAITGAQCTTCVEDEGAKARIVLTAGVILLLAGILVLIPVCWTAHAIIQDFYNPLVAEALKRELGASLYLGWAAAALLMLGGGLLCCTCPPPQVERPRGPRLGYSIPSRSGASGLDKRDYV

SEQ ID NO: 9549 - protein, 253 aa, Artificial Sequence
  Description of Artificial Sequence: Synthetic coding sequence
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHTNRKEYTLMKAYRVA

SEQ ID NO: 9550 - protein, 253 aa, Artificial Sequence; identical to SEQ ID NO: 9549
  Description of Artificial Sequence: Synthetic coding sequence

SEQ ID NO: 9551 - protein, 253 aa, Artificial Sequence; identical to SEQ ID NO: 9549
  Description of Artificial Sequence: Synthetic coding sequence

SEQ ID NO: 9552 - protein, 253 aa, Artificial Sequence; identical to SEQ ID NO: 9549
  Description of Artificial Sequence: Synthetic coding sequence

SEQ ID NO: 9553 - protein, 276 aa, Artificial Sequence
  Description of Artificial Sequence: Synthetic coding sequence
MGGDRLENKTSVSVASWSSLNARMDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHTNRKEYTLMKAYRVA

SEQ ID NO: 9554 - protein, 239 aa, Artificial Sequence
  Description of Artificial Sequence: Synthetic coding sequence
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHT

SEQ ID NO: 9555 - protein, 253 aa, Artificial Sequence; identical to SEQ ID NO: 9549
  Description of Artificial Sequence: Synthetic coding sequence

SEQ ID NO: 9556 - protein, 89 aa, Artificial Sequence
  Description of Artificial Sequence: Synthetic coding sequence
MDNRFATAFVIACVLSLISTIYMAASIGTDFWYEYRSPVQENSSDLNKSIWDEFISDEADEKTYNDALFRYNGTVGLWRRCITIPKNMH

SEQ ID NO: 9557 - protein, 177 aa, Artificial Sequence
  Description of Artificial Sequence: Synthetic coding sequence
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILH

SEQ ID NO: 9558 - protein, 145 aa, Artificial Sequence
  Description of Artificial Sequence: Synthetic coding sequence
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPF

SEQ ID NO: 9559 - protein, 172 aa, Artificial Sequence
  Description of Artificial Sequence: Synthetic coding sequence
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIA

SEQ ID NO: 9560 - protein, 237 aa, Artificial Sequence
  Description of Artificial Sequence: Synthetic coding sequence
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAA

SEQ ID NO: 9561 - protein, 253 aa, Artificial Sequence; identical to SEQ ID NO: 9549
  Description of Artificial Sequence: Synthetic coding sequence

SEQ ID NO: 9562 - protein, 158 aa, Artificial Sequence
  Description of Artificial Sequence: Synthetic coding sequence
MGESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHTNRKEYTLMKAYRVA

SEQ ID NO: 9563 - protein, 97 aa, Artificial Sequence
  Description of Artificial Sequence: Synthetic coding sequence
MDNRFATAFVIACVLSLISTIYMAASIGTDFWYEYRSPVQENSSDLNKSIWDEFISDEADEKTYNDALFRYNGTVGLWRRCITIPKNMHWYSPPERT

SEQ ID NO: 9564 - protein, 253 aa, Artificial Sequence; identical to SEQ ID NO: 9549
  Description of Artificial Sequence: Synthetic coding sequence

SEQ ID NO: 9565 - protein, 245 aa, Artificial Sequence
  Description of Artificial Sequence: Synthetic coding sequence
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHTNRKEYT

SEQ ID NO: 9566 - protein, 213 aa, Artificial Sequence
  Description of Artificial Sequence: Synthetic coding sequence
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFG

SEQ ID NO: 9567 - protein, 180 aa, Artificial Sequence
  Description of Artificial Sequence: Synthetic coding sequence
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLA

SEQ ID NO: 9568 - protein, 167 aa, Artificial Sequence
  Description of Artificial Sequence: Synthetic coding sequence
MGVKRSLQSGGILLSLVANVLMVLSTATNYWTRQQEGHSGLWQECNHGICSSIPCQTTLAVTVACMVLAVGVGVVGMVMGLRIRCDEGESLRGQTTSAFLFLGGLLLLTALIGYTVKNAWKNNVFFSWSYFSGWLALPFSILAGFCFLLADMIMQSTDAISGFPVCL

SEQ ID NO: 9569 - protein, 354 aa, Artificial Sequence
  Description of Artificial Sequence: Synthetic coding sequence
MGPVSLLPKYQKLNTWNGDLAKMTHLQAGLSPETIEKARLELNENPDVLHQDIQQVRDMIITRPDIGFLRTDDAFILRFLRARKFHQADAFRLLAQYFQYRQLNLDMFKNFKADDPGIKRALIDGFPGVLENRDHYGRKILLLFAANWDQSRNSFTDILRAILLSLEVLIEDPELQINGFILIIDWSNFSFKQASKLTPSILKLAIEGLQDSFPARFGGVHFVNQPWYIHALYTLIKPFLKDKTRKRIFLHGNNLNSLHQLIHPEFLPSEFGGTLPPYDMGTWARTLLGPDYSDENDYTHTSYNAMHVKHTSSNLERECSPKLMKRSQSVVEAGTLKHEEKGENENTQPLLALD

SEQ ID NO: 9570 - protein, 354 aa, Artificial Sequence; identical to SEQ ID NO: 9569
  Description of Artificial Sequence: Synthetic coding sequence

SEQ ID NO: 9571 - protein, 79 aa, Artificial Sequence
  Description of Artificial Sequence: Synthetic coding sequence
MGPVSLLPKYQKLNTWNGDLAKMTHLQAGLSPETIEKARLELNENPDVLHQDIQQVRDMIITRPDIGFLRTDDAFILRF

SEQ ID NO: 9572 - protein, 327 aa, Artificial Sequence
  Description of Artificial Sequence: Synthetic coding sequence
MTHLQAGLSPETLEKARLELNENPDTLHQDIQEVRDMVITRPDIGFLRTDDAFILRFLRARKFHHFEAFRLLAQYFEYRQQNLDMFKSFKATDPGIKQALKDGFPGGLANLDHYGRKILVLFAANWDQSRYTLVDILRAILLSLEAMIEDPELQVNGFVLIIDWSNFTFKQASKLTPSMLRLAIEGLQDSFPARFGGIHFVNQPWYIHALYTVIRPFLKEKTRKRIFLHGNNLNSLHQLIHPEILPSEFGGMLPPYDMGTWARTLLDHEYDDDSEYNVDSYSMPVKEVEKELSPKSMKRSQSVVDPTVLKRMDKNEEENMQPLLSLD

SEQ ID NO: 9573 - protein, 181 aa, Artificial Sequence
  Description of Artificial Sequence: Synthetic coding sequence
MIEDPELQVNGFVLIIDWSNFTFKQASKLTPSMLRLAIEGLQDSFPARFGGIHFVNQPWYIHALYTVIRPFLKEKTRKRIFLHGNNLNSLHQLIHPEILPSEFGGMLPPYDMGTWARTLLDHEYDDDSEYNVDSYSMPVKEVEKELSPKSMKRSQSVVDPTVLKRMDKNEEENMQPLLSLD

SEQ ID NO: 9574 - protein, 669 aa, Artificial Sequence
  Description of Artificial Sequence: Synthetic coding sequence
MAAAQEADGARSAVVAAGGGSSGQVTSNGSIGRDPPAETQPQNPPAQPAPNAWQVIKGVLFRIFIIWAISSWFRRGPAPQDQAGPGGAPRVASRNLFPKDTLMNLHVYISEHEHFTDFNATSALFWEQHDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWHPNITINIVDDHTPWVKGSVPPPLDQYVKFDAVSGDYYPIIYFNDYWNLQKDYYPINESLASLPLRVSFCPLSLWRWQLYAAQSTKSPWNFLGDELYEQSDEEQDSVKVALLETNPYLLALTIIVSIVHSVFEFLAFKNDIQFWNSRQSLEGLSVRSVFFGVFQSFVVLLYILDNETNFVVQVSVFIGVLIDLWKITKVMDVRLDREHRVAGIFPRLSFKDKSTYIESSTKVYDDMAFRYLSWILFPLLGCYAVYSLLYLEHKGWYSWVLSMLYGFLLTFGFITMTPQLFINYKLKSVAHLPWRMLTYKALNTFIDDLFAFVIKMPVMYRIGCLRDDVVFFIYLYQRWIYRVDPTRVNEFGMSGEDPTAAAPVAEVPTAAGALTPTPAPTTTTATREEASTSLPTKPTQGASSASEPQEAPPKPAEDKKKD

SEQ ID NO: 9575 - protein, 686 aa, Artificial Sequence
  Description of Artificial Sequence: Synthetic coding sequence
MAAAQEADGARSAVVAAGGGSSGQVTSNGSIGRDPPAETQPQNPPAQPAPNAWQVIKGVLFRIFIIWAISSWFRRGPAPQDQAGPGGAPRVASRNLFPKDTLMNLHVYISEHEHFTDFNATSALFWEQHDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWHPNITINIVDDHTPWVKGSVPPPLDQYVKFDAVSGDYYPIIYFNDYWNLQKDYYPINESLASLPLRVSFCPLSLWRWQLYAAQSTKSPWNFLGDELYEQSDEEQDSVKVALLETNPYLLALTIIVSIVHSVFEFLAFKNDIQFWNSRQSLEGLSVRSVFFGVFQSFVVLLYILDNETNFVVQVSVFIGVLIDLWKITKVMDVRLDREHRVAGIFPRLSFKDKSTYIESSTKVYDDMAFRYLSWILFPLLGCYAVYSLLYLEHKGWYSWVLSMLYGFLLTFGFITMTPQLFINYKLKSVAHLPWRMLTYKALNTFIDDLFAFVIKMPVMYRIGCLRDDVVFFIYLYQRWIYRVDPTRVNEFGMSGEDPTAAAPVAEVPTAAGALTPTPAPTTTTATREEASTSLPTKPTQGASSASEPQGLFVEALSVPLSLCVSSHLALPAQHHWESW

SEQ ID NO: 9576 - protein, 655 aa, Artificial Sequence
  Description of Artificial Sequence: Synthetic coding sequence
MSRKAHITEKVTSNGSIGRDPPAETQPQNPPAQPAPNAWQVIKGVLFRIFIIWAISSWFRRGPAPQDQAGPGGAPRVASRNLFPKDTLMNLHVYISEHEHFTDFNATSALFWEQHDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWHPNITINIVDDHTPWVKGSVPPPLDQYVKFDAVSGDYYPIIYFNDYWNLQKDYYPINESLASLPLRVSFCPLSLWRWQLYAAQSTKSPWNFLGDELYEQSDEEQDSVKVALLETNPYLLALTIIVSIVHSVFEFLAFKNDIQFWNSRQSLEGLSVRSVFFGVFQSFVVLLYILDNETNFVVQVSVFIGVLIDLWKITKVMDVRLDREHRVAGIFPRLSFKDKSTYIESSTKVYDDMAFRYLSWILFPLLGCYAVYSLLYLEHKGWYSWVLSMLYGFLLTFGFITMTPQLFINYKLKSVAHLPWRMLTYKALNTFIDDLFAFVIKMPVMYRIGCLRDDVVFFIYLYQRWIYRVDPTRVNEFGMSGEDPTAAAPVAEVPTAAGALTPTPAPTTTTATREEASTSLPTKPTQGASSASEPQEAPPKPAEDKKKD

SEQ ID NO: 9577 - protein, 567 aa, Artificial Sequence
  Description of Artificial Sequence: Synthetic coding sequence
MNLHVYISEHEHFTDFNATSALFWEQHDLVYGDWTSGENSDGCYEHFAELDIPQSVQQNGSIYIHVYFTKSGFHPDPRQKALYRRLATVHMSRMINKYKRRRFQKTKNLLTGETEADPEMIKRAEDYGPVEVISHWHPNITINIVDDHTPWVKGSVPPPLDQYVKFDAVSGDYYPIIYFNDYWNLQKDYYPINESLASLPLRVSFCPLSLWRWQLYAAQSTKSPWNFLGDELYEQSDEEQDSVKVALLETNPYLLALTIIVSIVHSVFEFLAFKNDIQFWNSRQSLEGLSVRSVFFGVFQSFVVLLYILDNETNFVVQVSVFIGVLIDLWKITKVMDVRLDREHRVAGIFPRLSFKDKSTYIESSTKVYDDMAFRYLSWILFPLLGCYAVYSLLYLEHKGWYSWVLSMLYGFLLTFGFITMTPQLFINYKLKSVAHLPWRMLTYKALNTFIDDLFAFVIKMPVMYRIGCLRDDVVFFIYLYQRWIYRVDPTRVNEFGMSGEDPTAAAPVAEVPTAAGALTPTPAPTTTTATREEASTSLPTKPTQGASSASEPQEAPPKPAEDKKKD

SEQ ID NO: 9578 - protein, 707 aa, Artificial Sequence
  Description of Artificial Sequence: Synthetic coding sequence
MLGSLVLRRKALAPRLLLRLLRSPTLRGHGGASGRNVTTGSLGEPQWLRVATGGRPGTSPALFSGRGAATGGRQGGRFDTKCLAAATWGRLPGPEETLPGQDSWNGVPSRAGLGMCALAAALVVHCYSKSPSNKDAALLEAARANNMQEVSRLLSEGADVNAKHRLGWTALMVAAINRNNSVVQVLLAAGADPNLGDDFSSVYKTAKEQGIHSLEDGGQDGASRHITNQWTSALEFRRWLGLPAGVLITREDDFNNRLNNRASFKGCTALHYAVLADDYRTVKELLDGGANPLQRNEMGHTPLDYAREGEVMKLLRTSEAKYQEKQRKREAEERRRFPLEQRLKEHIIGQESAIATVGAAIRRKENGWYDEEHPLVFLFLGSSGIGKTELAKQTAKYMHKDAKKGFIRLDMSEFQERHEVAKFIGSPPGYVGHEEGGQLTKKLKQCPNAVVLFDEVDKAHPDVLTIMLQLFDEGRLTDGKGKTIDCKDAIFIMTSNVASDEIAQHALQLRQEALEMSRNRIAENLGDVQISDKITISKNFKENVIRPILKAHFRRDEFLGRINEIVYFLPFCHSELIQLVNKELNFWAKRAKQRHNITLLWDREVADVLVDGYNVHYGARSIKHEVERRVVNQLAAAYEQDLLPGGCTLRITVEDSDKQLLKSPELPSPQAEKRLPKLRLEIIDKDSKTRRLDIRAPLHPEKVCNTI

SEQ ID NO: 9579 - protein, 662 aa, Artificial Sequence
  Description of Artificial Sequence: Synthetic coding sequence
MPRGCHLGTPSWSRRNTPRTGQLERGPQQGRTGHVRPGRSAGGSLLQQESVQQGCSPVGSCPCQQYARSQQPQETAKNDAQSRSWAGLNAGVSLKNTKISSSEWPLRLLSEGADVNAKHRLGWTALMVAAINRNNSVVQVLLAAGADPNLGDDFSSVYKTAKEQGIHSLEDGGQDGASRHITNQWTSALEFRRWLGLPAGVLITREDDFNNRLNNRASFKGCTALHYAVLADDYRTVKELLDGGANPLQRNEMGHTPLDYAREGEVMKLLRTSEAKYQEKQRKREAEERRRFPLEQRLKEHIIGQESAIATVGAAIRRKENGWYDEEHPLVFLFLGSSGIGKTELAKQTAKYMHKDAKKGFIRLDMSEFQERHEVAKFIGSPPGYVGHEEGGQLTKKLKQCPNAVVLFDEVDKAHPDVLTIMLQLFDEGRLTDGKGKTIDCKDAIFIMTSNVASDEIAQHALQLRQEALEMSRNRIAENLGDVQISDKITISKNFKENVIRPILKAHFRRDEFLGRINEIVYFLPFCHSELIQLVNKELNFWAKRAKQRHNITLLWDREVADVLVDGYNVHYGARSIKHEVERRVVNQLAAAYEQDLLPGGCTLRITVEDSDKQLLKSPELPSPQAEKRLPKLRLEIIDKDSKTRRLDIRAPLHPEKVCNTI

SEQ ID NO: 9580 - protein, 677 aa, Artificial Sequence
  Description of Artificial Sequence: Synthetic coding sequence
MLGSLVLRRKALAPRLLLRLLRSPTLRGHGGASGRNVTTGSLGEPQWLRVATGGRPGTSPALFSGRGAATGGRQGGRFDTKCLAAATWGRLPGPEETLPGQDSWNGVPSRAGLGMCALAAALVVHCYSKSPSNKDAALLEAARANNMQEVSRLLSEGADVNAKHRLGWTALMVAAINRNNSVVQVLLAAGADPNLGDDFSSVYKTAKEQGIHSLEVLITREDDFNNRLNNRASFKGCTALHYAVLADDYRTVKELLDGGANPLQRNEMGHTPLDYAREGEVMKLLRTSEAKYQEKQRKREAEERRRFPLEQRLKEHIIGQESAIATVGAAIRRKENGWYDEEHPLVFLFLGSSGIGKTELAKQTAKYMHKDAKKGFIRLDMSEFQERHEVAKFIGSPPGYVGHEEGGQLTKKLKQCPNAVVLFDEVDKAHPDVLTIMLQLFDEGRLTDGKGKTIDCKDAIFIMTSNVASDEIAQHALQLRQEALEMSRNRIAENLGDVQISDKITISKNFKENVIRPILKAHFRRDEFLGRINEIVYFLPFCHSELIQLVNKELNFWAKRAKQRHNITLLWDREVADVLVDGYNVHYGARSIKHEVERRVVNQLAAAYEQDLLPGGCTLRITVEDSDKQLLKSPELPSPQAEKRLPKLRLEIIDKDSKTRRLDIRAPLHPEKVCNTI

SEQ ID NO: 9581 - protein, 506 aa, Artificial Sequence
  Description of Artificial Sequence: Synthetic coding sequence
MVAAINRNNSVVQVLLAAGADPNLGDDFSSVYKTAKEQGIHSLEVLITREDDFNNRLNNRASFKGCTALHYAVLADDYRTVKELLDGGANPLQRNEMGHTPLDYAREGEVMKLLRTSEAKYQEKQRKREAEERRRFPLEQRLKEHIIGQESAIATVGAAIRRKENGWYDEEHPLVFLFLGSSGIGKTELAKQTAKYMHKDAKKGFIRLDMSEFQERHEVAKFIGSPPGYVGHEEGGQLTKKLKQCPNAVVLFDEVDKAHPDVLTIMLQLFDEGRLTDGKGKTIDCKDAIFIMTSNVASDEIAQHALQLRQEALEMSRNRIAENLGDVQISDKITISKNFKENVIRPILKAHFRRDEFLGRINEIVYFLPFCHSELIQLVNKELNFWAKRAKQRHNITLLWDREVADVLVDGYNVHYGARSIKHEVERRVVNQLAAAYEQDLLPGGCTLRITVEDSDKQLLKSPELPSPQAEKRLPKLRLEIIDKDSKTRRLDIRAPLHPEKVCNTI

SEQ ID NO: 9582 - protein, 633 aa, Artificial Sequence
  Description of Artificial Sequence: Synthetic coding sequence
MPSCGACTCGAAAVRLITSSLASAQRGISGGRIHMSVLGRLGTFETQILQRAPLRSFTETPAYFASKDGISKDGSGDGNKKSASEGSSKKSGSGNSGKGGNQLRCPKCGDLCTHVETFVSSTRFVKCEKCHHFFVVLSEADSKKSIIKEPESAAEAVKLAFQQKPPPPPKKIYNYLDKYVVGQSFAKKVLSVAVYNHYKRIYNNIPANLRQQAEVEKQTSLTPRELEIRRREDEYRFTKLLQIAGISPHGNALGASMQQQVNQQIPQEKRGGEVLDSSHDDIKLEKSNILLLGPTGSGKTLLAQTLAKCLDVPFAICDCTTLTQAGYVGEDIESVIAKLLQDANYNVEKAQQGIVFLDEVDKIGSVPGIHQLRDVGGEGVQQGLLKLLEGTIVNVPEKNSRKLRGETVQVDTTNILFVASGAFNGLDRIISRRKNEKYLGFGTPSNLGKGRRAAAAADLANRSGESNTHQDIEEKDRLLRHVEARDLIEFGMIPEFVGRLPVVVPLHSLDEKTLVQILTEPRNAVIPQYQALFSMDKCELNVTEDALKAIARLALERKTGARGLRSIMEKLLLEPMFEVPNSDIVCVEVDKEVVEGKKEPGYIRAPTKESSEEEYDSGVEEEGWPRQADAANS

SEQ ID NO: 9583 - protein, 533 aa, Artificial Sequence
  Description of Artificial Sequence: Synthetic coding sequence
MPSCGACTCGAAAVRLITSSLASAQRGISGGRIHMSVLGRLGTFETQILQRAPLRSFTETPAYFASKDGISKDGSGDGNKKSASEGSSKKSGSGNSGKGGNQLRCPKCGDLCTHVETFVSSTRFVKCEKCHHFFVVLSEADSKKSIIKEPESAAEAVKLAFQQKPPPPPKKIYNYLDKYVVGQSFAKKVLSVAVYNHYKRIYNNIPANLRQQAEVEKQTSLTPRELEIRRREDEYRFTKLLQIAGISPHGNALGASMQQQVNQQIPQEKRGGEVLDSSHDDIKLEKSNILLLGPTGSGKTLLAQTLAKCLDVPFAICDCTTLTQAGYVGEDIESVIAKLLQDANYNVEKAQQGIVFLDEVDKIGSVPGIHQLRDVGGEGVQQGLLKLLEGTIVNVPEKNSRKLRGETVQVDTTNILFVASGAFNGLDRIISRRKNEKYLGFGTPSNLGKGRRAAAAADLANRSGESNTHQDIEEKDRLLRHVEARDLIEFGMIPEFVGRLPVVVPLHSLDEKTLVQILTEPPHPALFTIFNPF

SEQ ID NO: 9584 - protein, 874 aa, Artificial Sequence
  Description of Artificial Sequence: Synthetic coding sequence
MLKKFDKKDEESGGGSNPFQHLEKSAVLQEARVFNETPINPRKCAHILTKILYLINQGEHLGTTEATEAFFAMTKLFQSNDPTLRRMCYLTIKEMSCIAEDVIIVTSSLTKDMTGKEDNYRGPAVRALCQITDSTMLQAIERYMKQAIVDKVPSVSSSALVSSLHLLKCSFDVVKRWVNEAQEAASSDNIMVQYHALGLLYHVRKNDRLAVNKMISKVTRHGLKSPFAYCMMIRVASKQLEEEDGSRDSPLFDFIESCLRNKHEMVVYEAASAIVNLPGCSAKELAPAVSVLQLFCSSPKAALRYAAVRTLNKVAMKHPSAVTACNLDLENLVTDSNRSIATLAITTLLKTGSESSIDRLMKQISSFMSEISDEFKVVVVQAISALCQKYPRKHAVLMNFLFTMLREEGGFEYKRAIVDCIISIIEENSESKETGLSHLCEFIEDCEFTVLATRILHLLGQEGPKTTNPSKYIRFIYNRVVLEHEEVRAGAVSALAKFGAQNEEMLPSILVLLKRCVMDDDNEVRDRATFYLNVLEQKQKALNAGYILNGLTVSIPGLERALQQYTLEPSEKPFDLKSVPLATAPMAEQRTESTPITAVKQPEKVAATRQEIFQEQLAAVPEFRGLGPLFKSSPEPVALTESETEYVIRCTKHTFTNHMVFQFDCTNTLNDQTLENVTVQMEPTEAYEVLCYVPARSLPYNQPGTCYTLVALPKEDPTAVACTFSCMMKFTVKDCDPTTGETDDEGYEDEYVLEDLEVTVADHIQKVMKLNFEAAWDEVGDEFEKEETFTLSTIKTLEEAVGNIVKFLGMHPCERSDKVPDNKNTHTLLLAGVFRGGHDILVRSRLLLLDTVTMQVTARSLEELPVDIILASVG

SEQ ID NO: 9585 - protein, 177 aa, Artificial Sequence
  Description of Artificial Sequence: Synthetic coding sequence
MEALILEPSLYTVKAILILDNDGDRLFAKYYDDTYPSVKEQKAFEKNIFNKTHRTDSEIALLEGLTVVYKSSIDLYFYVIGSSYENELMLMAVLNCLFDSLSQMLRKNVEKRALLENMEGLFLAVDEIVDGGVILESDPQQVVHRVALRGEDVPLTEQTVSQVLQSAKEQIKWSLLR

SEQ ID NO: 9586 - protein, 126 aa, Artificial Sequence
  Description of Artificial Sequence: Synthetic coding sequence
MMEIDFLPSTMTTPTPVSRSKRPLRRTFSTRPIGLTLMLMAVLNCLFDSLSQMLRKNVEKRALLENMEGLFLAVDEIVDGGVILESDPQQVVHRVALRGEDVPLTEQTVSQVLQSAKEQIKWSLLR

SEQ ID NO: 9587 - protein, 154 aa, Artificial Sequence
  Description of Artificial Sequence: Synthetic coding sequence
MEALILYYDDTYPSVKEQKAFEKNIFNKTHRTDSEIALLEGLTVVYKSSIDLYFYVIGSSYENELMLMAVLNCLFDSLSQMLRKNVEKRALLENMEGLFLAVDEIVDGGVILESDPQQVVHRVALRGEDVPLTEQTVSQVLQSAKEQIKWSLLR

SEQ ID NO: 9588 - protein, 92 aa, Artificial Sequence
  Description of Artificial Sequence: Synthetic coding sequence
MEALILEPSLYTVKAILILDNDGDRLFAKYYDDTYPSVKEQKAFEKNIFNKTHRTDSEIALLEGLTVVYKSSIDLYFYVIGSSYENELMLMA

SEQ ID NO: 9589 - protein, 247 aa, Artificial Sequence
  Description of Artificial Sequence: Synthetic coding sequence
MAWAGSRRVPAGTRAAAERCCRLSLSPGAQPAPPPGPLPPPRPMRFLTSCSLLLPRAAQILAAEAGLPSSRSFMGFAAPFTNKRKAYSERRIMGYSMQEMYEVVSNVQEYREFVPWCKKSLVVSSRKGHLKAQLEVGFPPVMERYTSAVSMVKPHMVKAVCTDGKLFNHLETIWRFSPGIPAYPRTCTVDFSISFEFRSLLHSQLATMFFDEVVKQNVAAFERRAATKFGPETAIPRELMFHEVHQT

SEQ ID NO: 9590 - protein, 215 aa, Artificial Sequence
  Description of Artificial Sequence: Synthetic coding sequence
MLLQVVREGKFSGFLTSCSLLLPRAAQILAAEAGLPSSRSFMGFAAPFTNKRKAYSERRIMGYSMQEMYEVVSNVQEYREFVPWCKKSLVVSSRKGHLKAQLEVGFPPVMERYTSAVSMVKPHMVKAVCTDGKLFNHLETIWRFSPGIPAYPRTCTVDFSISFEFRSLLHSQLATMFFDEVVKQNVAAFERRAATKFGPETAIPRELMFHEVHQT

SEQ ID NO: 9591 - protein, 230 aa, Artificial Sequence
  Description of Artificial Sequence: Synthetic coding sequence
MHSSSPSPTNDRGLRRTIRLAPLSFGLRFLTSCSLLLPRAAQILAAEAGLPSSRSFMGFAAPFTNKRKAYSERRIMGYSMQEMYEVVSNVQEYREFVPWCKKSLVVSSRKGHLKAQLEVGFPPVMERYTSAVSMVKPHMVKAVCTDGKLFNHLETIWRFSPGIPAYPRTCTVDFSISFEFRSLLHSQLATMFFDEVVKQNVAAFERRAATKFGPETAIPRELMFHEVHQT

SEQ ID NO: 9592 - protein, 64 aa, Artificial Sequence
  Description of Artificial Sequence: Synthetic coding sequence
  MOD_RES (1)..(1): Any amino acid
XRTCTVDFSISFEFRSLLHSQLATMFFDEVVKQNVAAFERRAATKFGPETAIPRELMFHEVHQT

SEQ ID NO: 9593 - protein, 238 aa, Artificial Sequence
  Description of Artificial Sequence: Synthetic coding sequence
MAARTGHTALRRVVSGCRPKSATAAGAQAPVRNGRYLASCGILMSRTLPLHTSILPKEICARTFFKITAPLINKRKEYSERRILGYSMQEMYDVVSGVEDYKHFVPWCKKSDVISKRSGYCKTRLEIGFPPVLERYTSVVTLVKPHLVKASCTDGRLFNHLETIWRFSPGLPGYPRTCTLDFSISFEFRSLLHSQLATLFFDEVVKQMVAAFERRACKLYGPETNIPRELMLHEVHHT

SEQ ID NO: 9594 - protein, 210 aa, Artificial Sequence
  Description of Artificial Sequence: Synthetic coding sequence
MGVCVWRYLASCGILMSRTLPLHTSILPKEICARTFFKITAPLINKRKEYSERRILGYSMQEMYDVVSGVEDYKHFVPWCKKSDVISKRSGYCKTRLEIGFPPVLERYTSVVTLVKPHLVKASCTDGRLFNHLETIWRFSPGLPGYPRTCTLDFSISFEFRSLLHSQLATLFFDEVVKQMVAAFERRACKLYGPETNIPRELMLHEVHHT

SEQ ID NO: 9595 - protein, 195 aa, Artificial Sequence
  Description of Artificial Sequence: Synthetic coding sequence
MSRTLPLHTSILPKEICARTFFKITAPLINKRKEYSERRILGYSMQEMYDVVSGVEDYKHFVPWCKKSDVISKRSGYCKTRLEIGFPPVLERYTSVVTLVKPHLVKASCTDGRLFNHLETIWRFSPGLPGYPRTCTLDFSISFEFRSLLHSQLATLFFDEVVKQMVAAFERRACKLYGPETNIPRELMLHEVHHT
